United States Patent 7,892,730 (COMPOSITIONS AND METHODS FOR CANCER) - sequence listing, part 18

SEQ ID NO: 1948 - DNA, 226215 bp, Homo sapiens
gctatttatagatgcaatcccacaactgatcatcatgggagtttttacctgctccatttctgacctgggctggttcaccccacctaggcaacctggtggttccctgttcccgggaggtgaccatattaatgctgaacttagtgcagacacccaatcagcgtagcacactacagcccagaacccctgggctgaagccatcctcccacctcagtctctgagtagctaggactataggcacggaccattgcgcccggcaatcctggacaatttcaatgacccttcctccaacccattaagaaggtcaaccctcctaaaaagaaagaataagtgtcacttgtgcctcctgacttaagtacgaagactttggattagcatttatagcttcccattattttgcctcaactttttctgaaagtatttctccaaattcttctactgaaatttataatttaatctcaatggtacctacagctgttttgtatcttcctgcttcttaactcatatccactcactacccatcatccaacaaatatttactgagtggttgctgttttctaatagctgttctgggcatggtaaaaggcacaaaaaaagataagaccctccaaatgggcaagataatagctatgctattgcagatctcacaacctaatgaaagacactgacatatgagcaaaaaatttcagtaaaatatggcaacagatgatagcaacacaagccaggtgcccgagagctcagtggaaggaatagtgtggctgtcttctttgtgattccctcctcaacttagaagcagctctgagttagaggaaagagcactgatcttgggagataaaaagctggattttagccaattaatttctgcaattaatttcttggcaaattcaataaattgataagtttctatccatggagtaaaaaaaaaagggatggataatactcatagaattttattaagagtgagaattaataatgctctgtaattggaaaagtactatgtatatatgattccatgtttacctatgaaaaaggtcagaatatgccaccccaaaatatgccactttggcataaggattattttgagcttaaggcaattaaaagcagaaaacacagaaaaagctctttgccctcccccatcggcttaaaagcaggacataaatttccctttaaaaaggtgctcccctttcctttcccaaaaaagaaagagatcaaccattatcattagcgacagaaagtgttaaaagaaaaacttcagctgaattaaattaaaaggagtttaattgagtaatgaatgattcacagattgggcagcctccagaatcacagcagattcagagagactccagaggtgccttgtggtcagaacaaatttatagacaaaaaagtagagagacatacaggaatcgaaagtgaggtacagaaacagctggattggttacaggttggcatttgccttatttgaacacagtttgaacactcggcagtctatgagtggttgaaatatggctgctaggattggccaaaactcagatattgttataggcacatactcctaagttaggttttcaatcttgtctacctattaagttaggtcacagttcatccacaagggctcaaatatagaagtacagagtctttctcaggacatatttagtttgctttaacaaaagtcagcaccaagatgagtctgtaggaacaaaccttactaaagcaacccttactttccattagtttcccttgcatattaccatcccacaatttactgtctcttgaagctcaaacctattttcctttgccttgtcactttcccgtaatttatcaccctctgttaaaatggtacgtgagtccttgggtcaaactgcttcactggttcttccattcttttctatgaaggcctctgtgcacataaaaattagaatattaacacaaaaattttcgtatgtcttttcttctgttaatctgtattttgcccattcaattcaaaggccccagtgaaaacatgagagaatagaagaaatatttctttcctcctctacacttatttaaccaaaacatatgatttatgacccagattatatactatttattctttccttcctacacgtttatagtgctatttttttggtgctcatcataaaggaactgtttttccatctaaaaattatgtgtggtgaaatataatcaacctatggaaaaatgcataaaacacaaatatgcaacctaataaactactgtaataggaacaaccctgaaccctttctagagtcaaaaacataacaacaaccttaggagaaccctatgtatactttatataagcacttttcacatgctgttttatctgccttattaaattgcaaggattttgaagacgggcatattagccaagattcttatgttggaaattataaaacccaaattaaccaaacttaaacagaaaatgagaaatttattgcaaacaaaattaaatgctgggaagtatgcagtggagctggacttaggataacctaggatgcaagcactatcacttcctccctgtcacttcctcttttctccttgctttccatcctccctgatctctctgcctgatatcctcactgtcacaaaatggttcccctggagactcataccctgtagtcctcagaccagaaaagagattctctttattcagcttgagtttagaagtaaaacatcctgggaaaggtctactgtctgacctgaggtccatgccccaatctgttatcagaaggaggatgaggtcagagagagatgctggcaacagaaaacaacagctatgacagaggcaccatttcttgttcaatacctcaaatgatcattacattcttcacagaggaggcaatcctatcattaatattgcaagggtcgcagcaggaacttcaactgggcctcctctggtattcaggcatgtttgggtttgtcaggaagactgctgagtgtggttctctgtgtgccagggatcaattcctgtgacgggcttaagagacttcagggaaaagaatatcaccctaagtgaagtcagagacaaggagcatctttagtgtaaggacatcaaaggactggtgacttctgaggacagaatatgtttgttactcagattgtcccctaagctacctctctgagactgaggtctatgcgtagaaaagagtttctaacagttgaggtcagataattcattgttgcaggggctgttccgtacattgtaggatgtttagcagcttccctggattgaccctctagataccaatagcattcttattttctaggcatgcaaaacagtaatgacttcagacattatgtcccctgagggacaaaatcaccttttcttgagaaccactggcctagaaggaagaagctataaaaaggaggaaaagaagtaaataaaaacggaaagagctgctgtccaaggcagccatgtagtctcactcgcaatatctacaaagggccatttcttgtcctagcaaggatgcgtagggtgagttaacagagctcataggtaaaatacctttgagagaacttgaaataaaatttggggaagtcagggatgctagtttctgttaatcagacagactaaagctggagaaatatttttgtgttatttttgacagttcttatgacatatttttaccttcaggctgatatggcttgggaaacattagttaaatttgaatgaatggatgattttagtgaatgaggttaacaattttttttcttaatggcatgcttcaattcacacattactactgtggggttagaattttagaagtgtcaggtacattaatctacattatactactgtaaaatagtgatgaactttctgtgaaaattgatcccacacaaagttctaagattagaaactaaaaatttgatgtatcaccaagtgttcaatttaaattccatgataagtggcctaaacatgaaagaaaattttcaaaataggctactgtgagacatcttcacattcagtgggttactcatcagtttttaaaagagaatttatatctttaaaacttgcattaatttgttttaaaataccaattctgattccactggaaatgtgttttgaagcagtaatggggcaggagaggatatagtaaaagaaaatattaaaaggaagtaataaaattcctcaattaagtctacttttaaaagatggagaaaatgaagagccatctctccgcctgtgcagtatagcatccctttcccttatggaggtaagagaacttcactcttccttgggggaagtcctccttccccatttcacataccctgtcctccccacctctcttctccctgtctcagcacagtgagaggttcatgacctagacttgaccaattagattctcctgggaatttgaatcttggatggagtggagttatttgggttcctggctttacaaaaagcttgcatattcaggttttccctcccagtccctcaattctatgagccaccagtatccttccaattaagtatcttcttcactttatttccagtaatgaggttatcaataatcaatttcagttgcttaaaacagaagcaaaaacctgtaactaacacaaggaactctgatttaaaagtattgtgactcatttgtcactatgattaaagagaacgggaaagggtcaggaaagaatatggaattagaactgaaaggtagatttcttgagtctatgctgaccaaacgttgaaatgtgttgatatgaaatatgtattcatatgtgtttcatttgtttgtttttgaatcttctacttctaccaggtttatatatgggtgaagttatgtagtttccaattttgcttgattaattttaggattcccacaatatttaagcaattttttttctgactgtgatgcttattattttccaataatgcaattaaaagtgttataatagccacttttataaattgattctaaaaagtaatgcttttaatttactaatgtattttaatataaatattattcatgctcatcataaaaataataaacagtacagaaaggtagaaaatgaaaaataaaagagccacatcatcccccttttcagagaaaatcaagttgcttacttaagatatttctagctataactgatatgcctttggttcctggtgttttctcgtacttgggctcttgcccattcaactaagtaggcattttataaaacttgcctcagtggagggataacattagagaccacaggttaagaaaaccaatcaaccaaccgaatttgcttcttgatgtaatgagtttcaaaaggccagtcctcagtggaaaggcagggtctatttacacaggaacagaaagagtttcagggaaaaaaacccgatgaggaagagtgaatcttgctaactgggaggactggataggcttccctgggctgggatgatgggaagatcatgactactcagtaagggaacatggtcagggaaagggacctggtcaaggaaaatccttggagagcagagttggcatcacagacaccatcctctaacactatgagcactgctggtcacctccaggacctgttggcactgagtcttcattcaactaagacctatacaactgttagttttcctttccatggcattccaccttccaaaatccaggaggagagaatatgtgccctaagaggggcctatcctgaccttttgatggcctaggacatgtgtgagttccccaggttagagagtgacacacagcatcgatggtactgaggtgacatggaaggtccagcaccttgatgtgtatggcactgaacagagccagcttcagattcacccctctcctcctgagccagtaaaatggaaaaacacacacaattacacacacacacacacacatctccctccttctcttcctctacttttacacaaactgcatcacattatacctattgatcttccacttgcatttttcacttagtgatatagctttgatatcagtctgcaaggatctaatctgttttttaaatggctacttggtatcttcataatttgactggtccccaactgatggacctttagttctctctgtccctgtctctcttctcccttctccctccccttttctctctcaaatattaccaagctatcatgagtatcctttcacataagtctttgaacttttgtttgaggtaaccctaggatgaattcttagaattggaattactggaccaaaaagtatgagcttttaagaaaaaaataatgaatgtaaatattgacaagttgttttccaaaatatttttttgacttggattctcataagctcttctttacccatattctctgtagcactaggtattgtaatctttttataatctttgccaatctgatacatgaaaattacaatttatttttaaatctgccttatcttaatgatgactaagaatcctctttatattttgttgaacctatttaattatgtaattacgatattctttcttacagttaggggctattttctattcagcactgtaaatttttacaaagctcccatcatgtgtctagttgattatgttgaattagactgaaaacaacaacagcatttgatatcacagaatgtggcagagaaaatgtaaacatgaaatagtttaacagtaaaaagtttcctgtggcactagttttgagttacactggcgctggctcctgatgaataggatgaattagctacaaaatgtacccataggtaattgagtaaagctaagtgttagctagagttgttttgtgttatccacttgaaaactagagaacatcagccaaaaatcaattttggttttggcataattaatgctgctctgttctcttgagtagtacagtaattagaaatatggctcagtgattccttaatgtcactactggtttgtgacagaaaaccacgacactggcattaagaatgacaatttcctccttacttgcttcgggaggaggcagctatcaggaattgaacaaagaactatgacatagctctctttcatgatgtagttttagctagaaatctgatctgtgtagagacagtttcaaatctgattctcccagagctgttagaatacagactttataaaaactcacagcactagatttatgctaccctcctatatcttggctcatggacaagctgatgatagatgaaaaaaatgctgcagaaacttgtgttccaagatgcttatcaaagtatattaagaggcaagctgagaaaaacaaaaaagtgttacctactcaaccaaactctaggatacttgtttaagaaagtgaaagaggtttctttcgtgtaagacctcagtctttaatataccaatgtgacatgaacctagttttcagtgtttccccaactcatttgacctggcacccaatttcctatagtgaatatatgctattttccagccacccagtgtccacttttctttttatatctagtggggctatgagcaggggtcccacactaccacaactgagggacaggccaatgctccaggctaaaacaactggaagctgcagactacaactgggagtacaaagagcaatcaattgggactcacccatttcagcaatggaagacaccatctcataacgttcctgtcctgatattatcctgttgtcactgcttctgtgccctctggagttctcctgctggctttctatcctgggtatctagctaggcttcccatcaattcttagagctcctgatatccttctactaagttccttcttgcctaaattaggcagagagttttcagttgcaaccaaagactcacactttaaaaaaaaaaatcttcttcagctcatccctcataacatcactagattgaaacaggaacaatgtatatttattgacaactaaaagacctacatggattataccacctaacacattctaggagctcaaaaaattgctgaacaaataataagtattccaaaaaacagcttttgggaagtattattttaagtcattttcttaataaggagaaagactatatataatggtacctaagagagaaatggtgcctaacacctagttgctcctctaggagtggagtaaactgcaacatatgtttgtgttgaattttggtggctattgaataaactaatgtctcttattttagagaaataaaatacttaagacaaaatataaactttaaatcaatactaaggagccatttaggaaaatcttgccctctctgaactagacattttactaggcatttaccatttaaacctcaacgccatgtgtcaatgaacaatatttagtgagccgatactatgtggcagacattgtgctagggccaggagataccctgagacactcagcttgggcagtaagagactcttccatagtcacacagatggtgagttggtggtgtaaatattcttttcctgtgtaaatgcaattatagtctttgctctatttaattatactaaataaatagctgctatttattctaaacagataatccaatcaatatagatgggcttaaaattttaagtattctcactttagtgacaaacaccttggggatcttaaaggactgttttatttattgataccagtcactgtcaatatttttggttcaaagacgctttcatattcgattttctgatagaagacaacgcaatgaaaactatcaagttgcttatgaaaaattcttaggatgacactgcacctaatgtttgtagtcagttgtttgtcattctttcccttgtcctatgctgtgtccaggactgctagataagtaggtacccagcatcctagcgtccagatatcaaaaccatgaaaatgaagcactacaagccagacagataacccccagagggagcaaacgaataaacccccaaatcctgtggatctagaagtagaaaataatcgctgaaccactgatttgagaccaatgagaacattaaggacacctcaaaatagatcagggcactgttcctagcccaactctgtggcagaacataaacctgcaagaaataggattaacatactatctttgcagtaagttaaatcctgaacttctacaaaatacagtttactccaatttagttacactcttcctgcttctggtgtcttacctccacgttggactaaggttttcaattcggtggtggaatacttacctattaaaattacccactttgctttagtgtgagtttctcagcatgttttacacaggagtgacctgaatgactcggaagtggcactagagtgtgccaggccctggaatttaatggtatggttctgtggttgttgtctgtttgcggttttattgctgaattagtagtaaccacagtaatcacaccctttctcatttctcaggcttggggatttcgtccacctctggcgggttggttcccctgacgtttcttaaagttactgtgaatttgttctggtcagtaccatagagtgtattatcctaaggagggccactgtagggccgctaggactagaggcaacttgaacttcacaagttagcagagcaaggactccctggaacaccgagttagggccacggggtctgtttgctcagattgcccgccagccctgggaaaggagtctgggggcgagcaggctgggttcccgggtctcagtcgccgcagtggtggctacagactgcgcatgtgacccaggggccggcgacgcaggtgcctgagagcgaggaggagggcggcgtggaggagggtacttccgggaccggcgggcgcgcgctggcagctcgccgacggcgggggcgggggcggggggcggcaggggagcgagcgcgctggcggcgggcggcggcgttgcgcgcggggtggcgagaggatgtgcgcgggatcgcgggggagggggagggagcgcgcgggctagctggaggcgggagggggcggagccctgtggcgtctgaacccgccccgggggtgccaaggtgcgtctccagtctgacgcgaccgcctggggcggagtcagcgggacgtgccacctgcagtgctggctagggctttttatttactagggagcagtttccccgcgcgacagttcgggagcgcgcaggcagtcgcgcgcacacacgcacgcaggcacacacacacacacacacacacacacacacactttcgcacacacaaacacgctaggacgctcgtcttcgctactgcatccccgaaccagcagagcgaagctactgcgggttctgttaacctcagcatcgtggggcgaagcagagccattgtgcatcaaggagaggccggtgcctgcgctgccgtctctggcacctaacccagcagaccgctcaccccatcgggtaagccagtctctctccttgtaacctgttctgcagacctgaggaagagggtgggaggctgctggtgcgccaagtgggggcagacccggagttgacatttcaggggcttgcagcccatgcagcctctgcccgtgtcgtctaacgggagcagccactactcaggttacttatgctgccagccctggagtcgctccccctttcttccctccccctgagcccaatatgtactgtgctccttggttgccaaggagacttgcttaaacatcagccgtgggacatctattgaaagaactggtttcttaaatgatgccgttatttattttgatatttaaaataaaatatacactgaggacctttcgtaatttggcatttgttaatctgtattcaggtggcggtttcattcaacttcaagaaaagccgtaattgcactatatggtatgctttaaaaaggattcgtcagatgaatttttcaacggattgtgtcttgaatcataatttactcccattttggtgatcttataaagaaagatgactgcagtttagatcccttcttcccctctatttccagttttattttgcagttcacttagtcgtgattattttaaattaaaagcagatgatttaattgtgtttccccacacaagaatgagcttctattgtaaattgaccagaacaggaatacatttgtgaattcgtaacgtaagaaggtagcattcatgacatacatctttgctagcatttttatatcccctgcatcagtattgaagcgcagttttttgcacctctgctcatttctgagaagattctgttttttaaaaaatctcttattgattatttttagatctatctctatacacagatagagatagatataaaatgtgtgccatggcttactagagcttatatgaaagtgcagtggtttttgctttttgttttttttctgatgggactgggtcctctactggaacactgataggccaatggaacaggtcagcctaatacctgggctgtcagttttgttttattttgaggtctcgggtgtctattgggtgaacttgtaacacagtacttgaaggcatcagcaatccagtaattacactttgcacgaatttcatgcctccatcacaaacaaatggcccagtaaagatccactggcattcaagaattaattttgttttccttggatatttgttcatcttttctacttcttgttaaatgacccaaggaaataagtcaaattcttctaatttagattttaaactctgtcatagagagtgtaataaataatgtgaggagcaagtaagccaaataatgacagaggtagatagaggggatttatgcaattcacagagctttgggagatgaatgatgacaaacattttacattacagtgtagaaagcacttttcatatacttcttttttaatcctcacaacaaccctttgaggccaataaattaccttccatttaaagctgaggaacccaagactcaaaccttgctgaaggtcacagctagtgaatggggaagccctttctggatccagtctccttgcctttaaaaaaaagttgtgtgtgcgtttcagatgtgtgcagggatctgacaagtgagataaaggagtggagcaggcctagacaagacacgtgggagagagggtagggagtggagtgtgaactgtggcctctggaacttgcaaaccactgtaaaggaggcagctcccactccactgtagccgattgttactgtccaggctctaaaacatgacagttttttaaggaaaacagaagcttctggattttttttatgaggtatccttaattttaaaaactgtaaggaccacattaaaaattgtatctgggtcatatctagcctgtggcctgctagttagcaacccataattactgatgtctcactcaattataagttagtattctctaacaaaatactgatgtgaaaaaatacatccatcattgtgagtgatcagttttttatttcaatattaaagtctaataaatgctctacctttgtttttcaataaacaggttcaaaaattttttgaggttttctagatctctgtcttatatctcagaaaataaaagaccatgaagtgctctaaaataggaatttttgaatctggtgaaacaaaagcatatatagtttagaacttatgttcctggcttaatgttttttttcttgccataaggccaagaagtggagaaaaactcagttgagtgcttgttataggaagacgtaggattggtcagcaaatggagcatcctgagcctttaatgaaaatgtctgattaaagtgttagataattaggtaaaacccaccactgaatactgcaagatgccaaaggaatgaaaacataagtgggaactcagagacattaaatcccagcaccctggtatacaaaatgtttactcctttaataactatcttgtagtgaggtaaatacgtcttgagaagctgccattttctcgtgtttctcctagagctacagagatgctagtggacttcactgaagtaggtaagtagtcagagaggagtgtcattttatttacattgtctctttggtggatccagagaggtgtagttaaaaggaaaagccaaaagatttgaacagcgacttctcatggttctcttattccaaaatccccctctggaaagatgccttaacagtaaataaagccatttcagttttcctttcatggaaatatgttgcacctctagtaaggagctatgcaggtgtgtgttagtaatgttctaacaaagtcctggctgagtgcatggagataccgtctctgccctcaatgattcagagcaaacacactgctcctggcagcgtccacttttcgagctcttctgtgagcaagctacttccatatcggcttcacaatgactctataaagtgggcatcttatttccattttacagatggaggatctaagactgtgaagtccaattggagcaatgaaagaaatcttgcaacttcagctgctcttctcttttcacattccttcttctcaactgttacctaatgcaggttatagacatgtacataattgtgattttgagggagttatgtgttaaatgttacaatggaaatataagattccatagaagctcagacacagggaaaaaattttaaatgttctgattgtggagatcaggtcagtccctaggtagtagggggattagtgctggaacttgatggctgggtatgattatattaaatgaaaatccttatagctattgaaagatgggagtctccaccagacagtctgttggaaatgtgggttaagaggatgatgctagtgatacctaatattgatgagcttactgtagctgagcgagtgatgaaagctgtggaagaactatggtctggaagatggagtgcagcagaggatgcaactgcggatgggtgggaggggatggaggaagacaaatttgggaaggagactaggagaggagttgtagccatagaggagaatctggagaatgtagtactgattcttctaaagactgaacataaagtcaagggacaaaccaagtattatattctctatacagagactggcacacaataaatacccataaaccatgatgatgtgtctacatttttaatgtctgatggctggtatataatttcctctcatgatatcacttttctatagaaaaagcatacacgttttatatgaattcatttggagtgggtaaatatatggattttcaaaaatgggaaaagattctggcaaattagatgataaaagatgtaatcgtttttttctagtagagtcatagacttggaggctaaggaggctcttacagatacagattttaaggttgcatatacttttgatgaagtcttatatgtttgggacaagtaaaggaaaaatgtgggctgtaaaccatttgaaaagctgtactcaaatctagacagaaggctttggtgacagataaatgtactataatcttgatcctggttgggtcaatgtttttatttattacatcagtagagatatgaaagaaatgtgacaagcaagtgggagttagacttgcatttaactactagatcttcagtgactgggtgggagagctacctgttagaatgttcagcacaaggtaacaggatgaaataaaatagaaggcgtcatagctagagtctagcactggggatatttgtcatgacaggaatttactttaaagttggagggattttaattcctatcaagtacaatataagccaatatgatgatttgctcttcacagatatatttggcaagtaatggaaaatattatgaaaaaatgatactgtaaggagcccatctttcttaataagcaaggggctttttggtgacagcagagatagatgtggctatgtctctgtgccaggcagtgtcttacttcccttctctgcctataagactgcttattatttcagaattgttttccaatttgtagagcagaacttaagaatttatcctagaacattttactttctctgttgttgagaattagtaaatagaattcattttgttcacctttttcctggcatttctaatcagaaccttcattcccaggcccttcttgtcaagatctttacctaagaggagctgagcaatgtgaaatgctcaactttcttcatatttcttttgttctttccctatttcgtatacacattgcaatgcattaatgtatttaatttaacttgattttgacatatggcactataagttttggtgagatttttaaacgaactatgtaggaaaaaaaacagttttgcagacttgacttggagtcagattagttccacatatggcagaaagcattgaaagctgtaaatttgtctaaaatagcttcttcccttgcaaggttggagtcaccaacctgataagataatttttaaatgaagaagaaatgtctttggcagttttcatggactcttgacaacattttcctacatgtttatttgaggcataatgtattctactttccatgccagataagccagtaccagttacttagaagcaggctaccccctcccttccccacccagatgatacaacccgtttgttatacaagatattgatggaaaaagaagtcccatcctagctgattgcttcagtgagaacatatttgatgctaatggcacagacaatagagcagtggaggaggcattttgcaattttttatgacacaaattctgatacctcatttaaaatcattacttagaaaccttattatttatgatttttagttctacaattgaaagtgcaaggtagcatggcacaaccagaagaacctgagccttggagcctggatttgaatactaaatctgatacttcttggttctgtgactcacagtccagttacatatcccctctaactctcattttcctcatctgtaaaatgggaattatgttacctagattatggagttgttttaagattaaataagaaatgcatagaaacatctagtacattgttggtgtgtaataaaatctcagtacttattaattccttccctctgcctcccctttccccactcctttgccttcctcaaaatgatggtggaattcatttaaatttcctgagccatataaaatgttttaatctggtgtgccgaccttggagcagagctaccctcattatgctatggagcttttagtgatgcagtacgctgcttagatgggctctcccagggagagggatgcatagcttggactcaatgatgtcttttctctctgacaagccactgttccctcttttatgcagctcctggagcatcggcctggtcacaaggaaaaggagggagggtcagtcagtttcctcctacccaggcagctctctgggctctatcataggatctcttcaggggtccacatctgcaaaaagcacagagctgccccttgtgttctctgtagaattaatagtggcagcatcaagtacctggcgggtacagacctcctagcctttctgcaaggtcaatttctagagcccacatctttcttgacaactagaagtttcccttcatgctgaattatgtaaattttatgaaaaggtcaaaagctcaccaggataaaaaacaaacaaacaaacaaaaaacactcctcaaattctctttcaagtcagataggattaaaatcttcccgaacagaatactttctagttaaatctatgtttttttctttttctctgcaccacgacctcactcattccctgttcccaccagcaactccttcttctgtgttgaaatatcatgtggatttctgatgacccaggagtgcacatgagattagtatggcctgactcttttcaaagtcaccccccggctcatgggcttaagaagaacctagacagcagcaggaactgctagcagcctaccacataggaagttagcctgagcagtatattgtaggatcccatagactgagctaagctttgttttcatcatacaatggattataaagcctgtccttaaataaaatactttttcttgtgctaaatgtgttctgcttatacctggtatggatgtatgcatatgtttatatatttcaatatttctaaagatatagtgcaatttcataattcagatgcatttttactagttggtaacattacttgagatacctaaaataagaaagacaagtttagtgattgttaaagacagaaaatcctttactcatttctttatagctccagaaaagaatatggtaaaaaatgttttgtaatggagattgattatagtgagatgtagattctcagctgaaaaatatggtagccgagatgacatcagtgccaagtcttttgtctgcatcacattcacagaccagcaaagttacaaaatcattatgaaaaaaaagcctactctaaatgtgaagataccagtttattctaaactactccccaagcaatagttatggttattattttggaaatttaggttcataattaatatggatatctgagtggaggagatttattttgatagagtctctcgttcacttgtttcctcatctactctgcttgacattttctgaaaggagactttctcttaaaaaaaatactgttttgtgataggcagtggtgtagatgtaatcagatgcccctttggctgcataaagattcactagtctttcctagcctgatgtccttgagctgatagaactgactgggttattttttttttttttttgagatttcaaagcctaaagaaatatggaatcaatgtttttttttccatgaaaacattaattacctacaatctgatttaattttgccatagcttatcttctttagctttgggccaaagctatttatcatttcttggaggtattcaagatcacctacagatggggcctcctaatagagcaaaagtcatttaagaaactcatgcacagcccttaggcctttctatatagcatttaacttgacttttttctgaaatccctaagatttgtgagtcttagtgtcatttgtagggttttctgatgtttcccttctctcaccttgtactgtttcacaaagttgtcaatttccccccccccctttttttttttgagacagattctcgctctgtcacccaggctggagtgcagtggtatagtcagctcattgcagacttaatctcccgggctcaagcaatcctaccacctcagtctcccatgtagttggaactataggtgtgtatcaccacacccagctaatttttaaaaatttttttgtagagatgggtgtctcactatgtttccctggctggtctcgagctcctgggctcaagcaattcttccaccttgggcttccaaagtgctggaattagagatctgagccactgtaccttaccaagttgccaatttttgatttctgtgtttcatgctgtttttatcaatgttagccatcagaagcctgcaattaattattgtcattacattttgttaattgctttaacatcaaatattaatatattctgtatatgtaactgccaaggggtttgcagatgtgggtggaattctttgaccagcacatcattttcctagtggttaagggtttagtggttaaggatttcactagcatggaattaggacaggatgaattagttacatggtttatctgtgcaggagcatcaccccaacataacgcctttgaaaacaacgacatattttactcctggacccagtaagggatgaaattcccttacccctcaaaacacgtgccttgattactgaatttttccttttgggcactgtattcttggaattctgcttcctctacttggacctcttttgggagatttatatcctgtgattgcttcagaattccgttgccatccattctttgttcatgtggaaacttagagtgcctcagtcagcagctattggtgtaagactcctttgttggatgcagggacaaggcaaggttggaagaagacttcttgcctctcaacattaagtgagcccttcacatcagtggccaactgttgaccaagatgtttaagaaacacaggttatcattgctctcaagaacttccttagttcttagatgtgattcatttcccctttgtatctggagcctcatggttgacctcagggatggaagcatattgacagtttcaggagagagtctttctatgtggtggaatagcacccaccagtatctcagctgggacagagggtcatctcccaggagccagccacatgtccctccttggccagttttgagacctcctaaggacagtgccagggttaataaggccttttctttaggcagcagtcactcatggtggcttgagtcacagatcagtactgaaaatctctcactgttattgcttctgtggattacagttaggctaggggttgacacagtaagtggattgggagagcaaaagcaggtggaatcagtttccttgagttttcactctgtaaggagtgaccttgacttcagaactctgtgcctaagtctcctgtataaattgggataacacagataatctcacttttctcacattgtcatccatgaaataaaattagatatgttaagtgctttgtttgtattaagagtgctctgatactgcttttgactgggcattgtaggaccttgcgtcagaaaatcatatatttaccactgtcctgcaaatacgtgcactctagaggtttgcaacaaggctggtcctcagaatgacctgaggttgtttcgaaaatatagattactggatcttctatacttactgtgtgagaatctgcattagtattgagtcatttgtgtattaagaaactcccattgagtaattatggtgataggtctactttgggagatgtggtctagagtgcagtgagctgctcacactctgcttcttattcctaccttccgaggaccagccaggccatctggatctgggcctcagctttcttgtcattcacacttaacaacaacaacaaaaaaatagcaagttaaatcagttctgatgtcagtgctctccagatactcagtggacatttaaacaacacaaacaattctctaccaaccaggtgccctgtctgggtagaagtcttgatgtgtgattaacatctttactactgaaacagaggttatcattttctactaaaatttgtgtataactaattaggcggattgctgcagagagcagctaatatcctcatagttgtccatatggtagctcggttgattaataacatacatttctgcataagataaaactaaatactttttaattttatactttttagatttagagcattgatagtgattacatggctttatgtaagccaactggagaatgccatttccactgtggatataatcttatgggtcattgattaacaggttagtagtgaactgctgcaggatagtatggatatagcacgatatgaggagcagagagactacagtttcaaattgtagcttgatctttatttttgcgagagttcaaaatgtgcttttgaatattaggcattttgaagagatatgcaattgttaagcaccagtatacagataagaagaaaaagaaaccttgccattagacaacttggaaggcataaatgaattgccgacatctacaaaaatgatcaaggttatgcatggcaggatgttgcttaattgtaattttaagagaattcattttgtggtgtgtgactagctgagagaaaggcagacatcatacttaggtttgcctgtctatggtaatttaattattattgactattgtgatggcttccctgatgttgagttaggtacaaacctgctcaattcctattgcaggaaactttttaatacttaataatattttgacttgaagaaaaagtcttttgacctgaagaatgaccatttcaggactagaattgttttattgagttaccttttccccccataaagtaaggtaaatgctgtctgtggaacttcggcaaattagattttggttggactcttctgccttttttgtgaaggaaaagaggaggggtctgggagaaaagagggaacactaactgtgaaaccgcgtctatcatcaattgattttgaacttgcagcctcattaggtggttagtattgggccatccagccaaaattatctttttggccatctgtgccaaattatagggagtaatagccttgggcacagctgctgagtctaatgtgtatttctaacttgtgtattaatgataatgactgcatagagaagtccagtgaccaaatgtgcagaataaataagaaggaacaaaatatatgtaaatttagaattaaaagaaaggaaaatctctgttttacatcaggaaatgacagtacatatttatttaaatctctatgcaataatatgacctttttctactccatctcttcacagtttctcctaaggagaaataaatcttaagagagattggctttgaattttggtccttctatgtggtgcttcttgaatttgctctgtgataggacacgggttttattactgtatcccaacattgattgggccttttctcagctcagcctgtccctttaagagaatcactcaggagtgactgactgcctttggtgtcactgtactttttgttggtcagctggggccagcagtaggacctttataggcaggctaagtctaatgtcactagaaatataattaagaaattataagaaaatgagatattccataatccaatgactaaggataaagaatgctaagaatcaggattttaaatagacatgtctacattttgcatggccgttcatttctctaaagtatcttaactaatgaatatattggaaggaaacctaccttatagtgaaggaagccttttaaaaactcacccaaagaaagtgaaatgatttggcacatagaacatagtagcatagttccctatacatgctttacaattttttttccttcaagcctacctcatccagagcctctccatttttggttgttcagcacccaaaccttggaaacatccttagcttcttcctctcacaacttacatccaaacagtcaggaaattctgttggctctaccttcaaagtatacccagaatctgaccatatgtcacaacttcccactaccattcttgtcccagtcaacattacctgttgcttaaatcattgcagcagatccccagaaggtcttctttgcctcctatagactcttctccacacagcagccaaaaattttgttttaaaacctgaatgaggctatatttctttgcctaaaactgcagcagcttccatcccaagaaccagaccctgtataccatctatccctctcttatctcccattgccttgcccattcctgccttagaactggtgtctcacagttggtaataccctcggcctggaatgccctgcctcctgcctacccgcaggcccactgtcttacctccttcgggtctttgctcaaatgtcactttctcaatgaagtccattgtgatcactgtgcttaaaattacaacctgcccaccaccccaaccccttcactctcaattcatcttaccctgtatttttttccccacagctcttatcgattaaaaaaaaaaagttttactgagggaaaacttacatatcattaaagttcacccattgtaactgtgtacagttcagtagtttgtagcaaatgtatagcgttctgtagccaccaacacaatccagttttagaacatttctgtcaccccaaaatgttccctcatgcccatttgcagttattcgccaccccctctccatcataggtaacctctgctgtgcttctacatctgtacatttgcctgttctagacattggcatatttgtcttatttgcttagtgcttagcatgtgtggttcaaaagatgaaggagctgcatatttgttaaatttggatattaccatatttcttgtgtgtgtgtgaacttatttgcagataactagcgtcaggacatggggaaattggacagaaatggaagagagatgtaggggtgcctgtactccatccatgtgtgtctgtcgggcaacaatcctgaggttctctgggtgtgcctccactgccctgtccccctcagggagatgagctgactcctcacacgttttctattaatgaatgattccatgatttcttcattcagttgtggaggagagcatggaatcaatgtgtactcctgcctcaatattcagtcatcaggggctctcagcctctccttccacttcctcccgtgtccccctctaccctccatcctcacagctgcccttctgccttcagcttccttacagcttctctgtgccactttctttatccttccatcccttcctagggactgttgtcactaatatctttagagatgtggcttccatcatgtcactcttctttctaaaaacttctggcaacccttgaatacccatagcttgattggtctcaaaaagcatttctccacctgccttctaattcttccccaatgtgaaccgtgtctccttctcagactctgtaaataaacacactctcaggaaatactgattccttgacaacctttagtgttatgtatttctgattcctaagcctctttgtcaagtaatgaataatttaaaacaaacaaacagaaaaacccttaaagcccctaggagttgactatttgaagaaatccagtaacttatctgtatatgttttcctaagtctgtcattctcaaagcatcacagctccaaatttgctgtatatttaccaagggtgtctctggccaccagagtagtgaagttatagttacaagataattccatagtggaaaaaaaaacaaatgtgtggttcaggctcaccagcatcaggatcagacttcagttccactaggttccctattgttccctgccagagggtcctggggtccctggccaggtggtactggggcagggctgggccccacagtggacaccttctcttctgggctccaccttccggcatgcttctcgtgtcctgcagatacctcatcagcattctctgtgctgctgttgctgcttctgactgctctggtcctccctgatgaccagtggtattaaggctgcctgtggaccacactgttcaccagccactggcctcctccacagccagtgggctttggctgcttgtagcttcctttctctcttcctgcagcagcagcagcagcagcaggggatacatagatggaatggatttggaaatagacgggcctaagcttgaatcctggttctttcatatacaagttatttggtcttgggaaagttacttatttctttgaaccccagtattgtgctctggggacagttacacccaccctgcagtataatcatgtgacccacatgcagtgatgtatgtaagtttcattgtctagtgcctgacacagactcagcacccagtacgtttttgttgttgactgttatgatattctaaagtgaactgcaggggcccaggaagctaatggctgctcccctttcactgaggacagcaggcctttcttcccaggattactgctctatggatgtagggtaatgtgaatgtaggcagtcttttttgaccaccatctacattttccattactcagtctctaaagctagcaaacaactatgagacatgggccacaccttattggcttgcatggcccgcctctcccctcttcctgccattctgtcattgcaggatgaaagttagaaaatactgatgtattctgtgttgttattgcttcttaaagctgccattggtgtttttgcttataaaaacattgccagttttctcagtaatactgttttactctgtaaagaatgcttatttggcacacagttactgggcatctgtcaagtgtcaggcattatgccaaaggctgatgagtcagtggtgaggaagatagtcaggaacttgtcatctctgagctgacactctagtggaagcatttatcacacgatctcacaattaagagtgagattacaatacaaataaatgctgaggaggagaggttcatggcattgttaaaagtataaagtgggaagctttgacctgctctggaggttgatgaggaagccttccctaagggggtttgaaggacatgaggcatcagtgaggcaaaatggagagattggagagtgtttcaagtaatgggaaaaaattctaggaggaaacacagtgtcaacacagtggggtgcagagagccaagggcagtgaagggggaaatgtgctggaggacgggtagagaaggactgcacacaggcctataaagataggtatctttatcagaaatgccgagaagccattgaggaatgattgtaatgatgaagtggcaggaactggaaggctaagatgagatctgattacaggggaacagtaatcagaataggagggcactggagtccattgatctggttcagatcaaaggtcatagaagtagcttagcctagggaggtgggaatagagaaggagagaaattgcctaaggacaactcaggaggtaaaattttcagggcctggtgctggattgaatattgagggtgagggaagagaaacctgatgactcctacatgggcgtaggtggaggtgtcattctatacaactgcaagtgcgaaggtaacattccatacaactgcattaatgttggtgccatttatatgggttatagtactaatccatacaactgtgtgattatggcaatattaaatttgagctgtctttaggacgttgagatgaagatatcaaataggttattgtgtgtttggaggtcatagaaaacattggacccataatatgatttttgattgagattgaaattgcctagggatagaatagatcaattaaatctcaaggaactgtagctcttaatgattaggtagagagggataagcaaaaaggagaaaaaaataagtgtagccagagaggaaggaagaaaaccaggagagactggaatcctagaagccaatgcagtggtgtgattcaaggagagagcatttactgatgcagaatgctgctgatatccaaaatgtagaggagtgaaagtggcaactgaatttgatgttggtcaagataaagcatgcatggtgactcagagaccaaaggcagactgcagcccagacctcattactatgccactgcattaaatcccagaaccatactatagccctgcttaagcagccccaagaaggcagagcttcccaactggtagaacagataataagctgagttacagaaaacaggcaaatgaacagtttcttgcacaccagactttgtagtaagattcgtacttactctctaaatgctgtatagtcattcatttagcagacgttattggatgctgtatatagaaatgaggtgagaggcgctccatgccctgaatacattcatagaacagccgagagaaaagatataacaataatacacccataattgtgatgtaggcataaggtaagcatcactaacacaggcacaaattgttggaattcagagaatggaaagcgtaatagatgatgtgaaatgtacaaatcaaaaatagaaacgtgaagtgcatagtcctggaaatcagataattaacaccttaggatttactgtagagtggcactgatagctcattagcctttcttagccattatttcttcctttgtacttttgtaaataatttttcaagtcttttcaagggtttgtttacaaggttgaaattttaaaaaataaattttgcttgaaaatgctttaaaaggtacaacttctatgattcgcctgttcaagtcagcactactttaataaagatagtgaaaaaggtatattttgttctttccacctgggttgacactggtttcaaaaatattaactttgagaaatattcttaccaaatactaaggcttctctctaggaagtggtgaaacaaacatgcattttgatatttaatttaagagatatcatgattcttacttatcatgtattttctgaaaaacctgttgttattcccattaagaattagccatacttaatctgatttaattcttaaataagttttctgagtgacttacattttagtcaaatgaaatgatagctctgagaagcattgatattattaagcagaagaggtttgatatgatgtgatgaccaaaaaacaatcaaggtaagactagatgttgtagtcaacttcacgtaatccacgaaagcccctcttatgctatctcttgaataagtgagcctgagaaagtatcctctcaggagcctctgtggggttccctgctgcacaaggatcacctgggttggtgtcacatagctgctttttttctctgatttgtcctttactgatctcttccatctaagcaatgagaagacccccaagaacaatttggaacactttcctctgacctcttactttttctctgttgtgtgtaattgggatgaggggtcaggtgcaggaagtggttgtcccataactttttgagaatcaaataaatggtccagatccttattcctatgcaaaatgcatgtatgaatatggtctcagagaaagaatgcagaaaaagactggcatatgtactgtatatatagtaacttaggtaaggtctgtttatggaacccctttagaaacctctgttcttaactatcttgggccatgatctgaaagagttccctgaagcacatgtgttgctctaacattctcctgctttacagccagcggttaccccacagtcactgtttgttagcttaggcttcactgccttttgcagcccaagatctgctggccccacttgtctgggtcagtccagactggtgctgcccctgtactactgctgtccccctcaccatcctttccagctactgctgccacctcgcacctgccagatgcccaacatgcttcttcacctcaatctcagtccaaaatctgtgcatcaagccatctgtgctcaatacccatttcctccatgaaaccattcctgattagctctaccatgcaataatttcccttgttctagacatcttcatctaatctgccatttagctgtggagagttgccttttgttgttctctggttatcttatgtgtgttttcttaatttgaaagtatatgaatgatagaagctatgtcttgaagtgttaaggctggaaaggacattagcattgaaatcctcaatcttttatcccacttcaggaaatcagtaacagtgacttgctacagctgtggggtgtgtgtgtgtgtgtgtgtgtgtgtgtgtgtgtgtgattcagaatatcccttcagggtcatatttgattctcaaggaagaagagagaggggagaaagcatagagagattgaaaaagactttccccaggttattctgatgccaccacctccctttctacctccatctctagttttttattgtcctcattctgcagagaatcactccttacggcagaatggctttcgatcaagcctgagtaatgtgtagcaacctgttcacctctctcttgcccacatgccacagttaaaaattaaattaagcattcagggctagagatttagaggagggactgtaggctaaaagagaaaagagaaatgagatgtattgttcatgctccctctacacacacacacacacacacacacacacacacactctgtacatacacacacatatatgcacatacatatacacatatacacataccagcatatagacacatatgcacacacatatatacacatacatacacacacatgcctatacatacacacatacattctaaccacctatcctggggtaaaggactgtgatagggccattattcttttcctcaaaatggatttggcttatggtaaatgcagagttcatattcctctagaaccagctcttaaagggttggtctcttggtgtcattcacacaagacctgtgcggtaatatgatatttacttctatttccaagaagaagtaaaaaaaaaaaaaaaaccttatactgttctaccaaggagatttctcacccacacacaggctgacacctgttttacttattactgctgacccccgatgttggataacttcacatcagctgtaaatcccacaaactgatttaattggattcctccacattttgtatgagaaagcagaagcccagggaaacaaactggcttggccagtgaaacccttagtagcagagccgggaccaggacccaggtctccgaggtcttgtctttactggttgctcttctttggctttgcggcccctgtagtgcctcgcacaaacacatttcataagccttcactgcttccttttccagttaaacacttcgagcttcctgcttttttcttttgccatatgcacagacacttgccccagccatctggggaagggaaaagtcatatctggcaggggaacgagtgtgcagatgcattctttttataattactgaaaagaaggttgttggaggtatgatttatttagccagcttcttcagatctagattcaaaagctgttctcatgttcagaaaatattttattttgtacaaaactctcaggacattaaatccttctcaacctgtggtctcatttttcagcatgtgcctctcactgaaagctagttcaccaccagcattaatttgacccccagctgtattcgttccctgtcagttcttgtcctccaggctgttgctcatcgttatatcaaagatgggagcaactggaattagatgcctgtgattattaagacggtaattactgatcatgctgacaccagtaatattaactggtgtttaaataatttaaaatgttacctatgaggcatgcatgaattcaaggtatcagaataaaaggcactatctaaaagagcctaggcaagaataaaatatttgttcttgttttattcagatattctggcttaaaatgctatgcaaggatgatggacttcctctagtttaaacagttgtttttaagtttctttacaatagacctacataatatggttctaaggaatgctgtttgtggggaacaaattagttttattagatttctcaagtcattaacataacttaataacttaatattctactacaatggccccatctgccatatgggttttatgagtttgatgatgctatatattcatattgtacttcatagttcaggaagtacttgccaactcatcatgtcatttagtcttaaaagtattgtgggggatgtaggtttacctctgtcttaatggagaaataaatgttggctcagaaaggctatattacttgttcaagttgcatgagtaataagttgtgaggttagaagacgagatttgttggtgacttcacaacactttccaaatctgtgaagtgacagtaaactgtacaccatagccttgctgtacttgggaaaataaaagaaatactgtcttctttggtggaatcttctgaatctattcttcatcgaagaataaacagtcttaggaaggaaaagagcttttcatggacttacaagagcttttctttattggaagaatgatcgtctttactcttaaatttataattctaagaatataacatgacgttgacaactctttatttttatagatgattaaagtgtatgagttctgccatttatgagataattccaatgtgctgtgctgaatttctaggtctcttgttataaactacttaaaatatttttgttttaatttgggaagcatttccttgagaggttggatgcagcttccattacttaatttttatttattgttgtttttaaacatcatcatttaatcctagcacatggctgtgccagccctttatgctaattgtggatagtgcatggcagggataatgctaacactgtctgttgcttaccatgatgccacataactcaaaaccatgcttcttttgaagagttggaaaaccacatccaactcccttagagcagaaatcccagcctgtaccctaagactggggcatgcctgtggggcaggccctttcagagatcacagaccttgtggagagaataaaggtgcacacacttagttctagcccagtgggccagcgtcagagcaaaagtttaatttccaagtgcagcacagtgcctaccactcaattgtcccttcacccaagcctactcagactcaagaccaagtcctagaaagagaggggtgctttaaaaagggtaggaaaaaaaattttaagcattgttttactgaaacccctatgggatcctgagtgcacaacattggtgacttgggcagcactggcacttaaaattttggtcattgtaggaaatggcattcttgggcagtgtcttcttcagagaagtgggtggtagcttcccgggggagtcacaggctttagagccatgttcagtgcttttggcatgaacctgggccccgttggtgtctacatcagtagattcagaggctggcattgttgtacagtgtggaataatgagaatgtggaggctgacagggtgattatggttttgagagttagtgagacaaaccctggaactgaggagctggtcttcattgtgtagttaaagtttctgcagttatgggtgtggggtataaggccagacaaggatggtttttaactttttctggggtcttagcttttacttaaatggctgggatataagggtttacatgaatgataagatgagattcatcttgtttcatggaaaaatattcactttaccaaagaagtatcaacaggattagtaagcttttagatattcaaaatatgagtttatttaggaaaaaaatattttaaatattttgttttaagtgatatctccttttagaccaatctaaccattaagaatagatatataatatctattttcagtttctggtaaaagaattttttaacgtgaatccttcatctggatcccatttgtggtgctcagttttttaaagcacttattatctcgtggcacaccatatcacttacttatttgccatgtttattgtttgtctgtcttcttgtgtagacagttagctccacagggcaggcattttgtctgttctgttcactgatatgtcccaagaacctagaagtgcctggatatggtgaccactaaataattacttgttgattcttaagtcaagaatctgtcacttcactgctatgagctaggaattattgtaattgttttgtgagaaataggtagtgaggaacaagggcctggataattattttataatattgataattggacaagtatgggagaaagcacggtagtggcaggccacttctgaatttgtaattttcatcttatgtttttgccatttttgccaatcctgctccaactagacctaaggtagatcctaatgagataacagctcttatattcccatctttccctttactattcctctggattggctgattgttttatactctggttacttagggggaaaaaagtgtaagggttaacaaatgagaaatgatggtaaaagaaaaacaaagggaacggccataaaatgagctgtgaattgtagaaaaatattgggttctatatacttattaacagtgggcacatatttaattctaaacttccttagtagtcattgtgaaaaaagcagcttgattactttcttgatttaaagcatttgtaaatgttaaaagaaatttatctgggaggccattaggctgagacggctccagcaccttgggttcctacctaagtaaatgaaaccagtgttaatagtaaaatgaaacaaacataaccagctgaaatcatcaactaaccactaactggggactttccaccaatcatatccaaataaggcaaacacctaactgtagccaatcaagtaatttcttagttttgcttctgcattcaacctgtgtaagcctgaagctcacgctgcacagctgagttctctgaacctcctctggttccaagtgatgcccaattcatgaattgttcattgctcaaataaactgttatatttaatttgtctaaagtttttattttaacataaataagacacaaccacatgttaggaacatcgatacaatttatttctttatactaagaccaaaaataaatccctctcaaggattctcatgaaaaggacactgtgtgattaatgtcatgagcaatgtcttacaagcatctttacagggttatcacatctcttctctgatgcttttattaatggcatacctcaatatatacagagatggtaatttgggagtacagatgggaaggtatattgccttttgtactctggcataataatgattaaaactaacactttcacggattttatgctctttgcattgttcttagtaattatattgactcattaaactcttataaacatgctgtgaggtaagtagtattatattaatcatattttatagaatgaagaaactgaggcagagaggaattaagtacttgtccagagtcacactggtagtggctggggatttaaacctaggcagtttgattacaaagtttgcacccttatcttatgtcaaaaggatactacacagtgtccttttcagagaatccttgagagggacttctttctggtcttggcataaagaaatgaattgtatgatgctcctaaatgtttggtttggctagatgcctttctggaatccaaggctagattttagaggatccagaagagaaatgaacatttttcagaaaattgtctattgtaggttacttagaagttactgggcaattgtgagagtttttgctctctggaaaatccctgaagtctagctattccgtgttactaatgctagacgcagcacaatgtacaatgagcggtgtgaattttagtcagacttacctggattctaatcctggttctaccacttattagattggtgatcttgggaaagttatttcaccttgtacgtcaaacttgaggttggttcatatcctctgcttggtagatcatcatagttggtattcctagacatttctccagagagaccaaatatttttgtttttaataatgtggagaaaaaaaattcaaccaagacatcagatgattcctgagacctacagaaaaattttgtgatgtaggtgtgtccttatgtgggcaagtctatttttttgtgtgtgatacataattattgaaatcataggatatactttgggtctgtttcttcatgaaataaacatgatggttttattttcactaatagtatttagcagttttaagtacaggatatcacaaagggtaataatatcttggttagagaatacacttttttaaaaaacaacattatgtgatcatagattttgtgcattaggaaaattaggattgatgaaggagggatttaacttcagtcactgtgatggatttgacagcctttttcccctccacctccccaatgcaattctctctcagatttatcctcccacttgtcgagctcacccaagcctattgactgagccaagaaaacatactccactctcctcctctttttctgactcatgcgaaaaagtcatgtagcaattcaaacatttctgaaattacaaaacataatgtagaaaactttcttatctccgactttagaatcttttttattattttgatatttgcataagtaagattttagattaatttcatttcttcagaggctttccctgacaacacagtaaacacctgttgactcaatcacatcacgatgttttgtgcattttagcagccattgttatccagtgttttcttgtttgtctatttactgtttattcttcttagaatgtaagttctgtgaaaatagggacattgcatgtcttgttttaaactgtgtcttctaaaggtaatggcacatagtaggaattaataacttttcaaatggatgagtctttctaaaatcctcatgcattttacttcatttaaattgagtctccatagctccagctctgatattctagttagtcagttttctcttcatgcaattctttttgccatccttcacatttgttcacacttgttatcattgttcatttacccagatccagtgtctctgggttcatttctaatgttgccaccatctaccccgaccagcctttctttccacagatgtagacttgccaccatctttttgtgtaatgttgactgagttagtatttgataatctcatttttatttttgtaaaaattgtgaatattttccatttgactgactcacagtggtgagtccatttgactgactcacattaataatacagattattaatgacatctctcatttactttcataagatcatatcttcagagttccctggtgagattaatgattttgcattgtttaaatattcatagtgtaattggtactgtgattccgaaagcagaacttttctctctttttttcccctcctaaattttaatatttcacaaaggtatttagtagtagtaaaactaaggaagggaaattcagtaggtaaatggtttgccactaataactggaattaaatttactgacttaaaaattttttacttaaatcaatattgttttttcttttttaatagtaaaattatggctagtgttttgagtgctcattatattttcaaagtgccttatcttgctgttcagttactctgtaaaaagcaggacaatgtaatattgtcttaaaacagagccacagtgtatttttcaaagccaagattttaaagtgatattaatttaaaaattaaaatgaaattttgatttcttttgagttttgatatctcaaagttgttaaaattatgtgcatattctgtaaaagacttagaagcacatttttaatgacagaggcaagtgtttttggaggtgtctgaaatttctacatttgtgttaaaaaaaaaaaccattagctctctaaacaagaacaatgtctaaacaatacatttattagtaagtgttctaggaacatagctcattctagcaaagagaagagtgggatgtgatccctgcccctataattcatagttaagatgtcagttaacatgaagctcaacccagctgaaggaacttcacctcatgcccacgttctttcttctaccttacatctctttttaaaaaggaaaattatgctctaagtgatagcttttatcagttgtcacgttaaaaaaaaaaaacccagacactttgctttacaaaatcattttaatcttactcctttacatgcattcctggtgtatggtaagtgctatttaaatattgaatgagttgagtgagtgagtgaatgagtgaatgagtgaatggttagtgaacgactagttacagtaaattctttgttattcaacctggccagatgtattttcatggaaaaccaaatattttatctgagagaattagcatgttcgtcacaccaattaacataaccagttgaatagctgagggttgtcctctttgccatagacattgatattagtaacaagacaagggcatttcacatatgactcttgttctactttgattccacaacagaagacattcttatatctgagagcccatgagatgatagtgagaaaatgcaattttgggggtagacatgtgcatatagctgtcattgatttcttaaactcaagaaagccttgtaatacaaattactcagtttgaacaaaaaaaaagtacttctcacaaaacgtgtaattctgaatgttttgtaagttaggttagaactgtgacctgatctaaacataaagtggttaaatagaaatttaaaacatgatatttaaaattttattattaataatggaaaaatatacatgggtcagactcacatggtctcggtttgatgataagggagacttcaacaggctgagtaggacagggaagaagccaggaccagcttgggttcaggcaaaggaaacaaactgagctgtttgcatgagaggagatgtcaacagccctatacaccttgttcctggagtattatgaatttgggctgcatttacctagtgtctgtggctagaagttgggtactataaggggacagcagcaggaggaaagtttgcgactaatactcagagtcaggtgagcagtatgttgtttctaggtctattttaaatagtttccaaagagggctgggccatgtggggcatgttggacagtgcgccaccccacaccctgtaccttaaccatcgctggtaaggtagttactgataccttagagtttgccatcactaccatcatcttaccatcatcatcaagacaatattaattgctcactattaatattgagcaatatgcataccaaaactggtatgtactttggattgtctcatttaattgtctgtctcataaattgcattagttataatttagctaattaagttgtataccttgtgagataagttttatatattttttaaatttagcttttatttttaccagtgttatataaagagtcaaataatccacaaggcttgttatgtggaagtatagaagaggcaactgctttcaattattttagctgtttctttagatagcagcaggtcctggagtagcgttgttttgttcaatgccatttcattacaaggtcaatcagagaaaaaaattgattcccagctgggaccactgtctgtgtgaagtttgcacattctccccatgtctgcatgggttttttccaggtactttggattccccccacatcctaaaaatgtgcacattcggttcactggtgtgtctacattgtcccagagtgagtgagtgtgagtgtgtgtgagtgcaccctgtgatgggatggcatcctgtccaggatgggttcccgccttttgccctgagctgctaggatgggcttcagccacccaagaccttgaactggaataattgggtaaataattatcttacttgtttttattaatgtttcttaaatgtatgtatagctcatattaatttcattgtttaatattagaagtgttttgggcattttttaaaagaagtttggtgactttttgtgaccagaaatatgccataggaacttaactcttgtttttatgaattagcctatggtaaaattgaaactgcctttgtaaagaatatgacagcaagagaaatttgtgatggctgactccatcttgcttctagcctcacaggctggctggactcacttattcctaggtgtaggcccagctaaccatgggaggaatttagctaaagtctaactttgaagcaagaatcataatagctactccctaaaactgacgcttccttgttcagggactgaaactaccttttgtaagactaatgaaaggccacaagattaggattgtgagaggggcctgaattctgtaaagaggtgagcatagcttgcctttctataatcatttactgcactgtagtaaatgtatcatcacaaggtgatcacaagatttgtgacttccccagttgttcccatagataacatcactattgtagaacctaaggttggtcttttgagatgtttttcagacctttgtattctggtgaccaattgactccaccaggacccatgacttatgactcagccaggcctatggcccccacccagaggctgtcccagcacataaggattgtttaccacaaccctgtgagttcatccccaatcaatcagcagcacccattccctggtcccctgcctgctaacttaccataaaaaccctagcctctgagttcctggggaggctgatttgagtaataaactcctgtcctctcacttggctagctctacattaattaaactctttctctaccacaagactgctgtcttggtgaattagttttgtctgtgcagcaggcaagaagaccccatcagatgattacaaatttgattcattatacattgtttccaagaatctatcaataatgtatgtgagaacttactttatttacgtccatatttctcagtaacatgcttatgttgccagtcttggtttttgatgtttgagttgattggtttcccatgaaaaaagatgaaaatttaggtttcttgccaagcttgttggctcatgcctgtaataccagcactttggtaggctaaggcaggaggatcacttgaggcctggagttcaagaccagcttgaccaacatggcgaaaccctgtttgtactaaaaatacaaaaattagccgggtgtggtggcacataactgtaatccaagctactcaggaggctgaggcaggagaattgcttgaacctgggaggtggaggttgcagtgagccgagattgtaccactgtactccagcctgggtgacagagtgagactccatctcaaaaaaaaaaaagaaaatttagctttcttcattcattccctaaaatcacgccatcatacatacaggcttcccatccctccattctctcaattagttacactgatactttggttggatcattatttcatttttatatggttatgacaatctaaatgttatttatataatcaaaccatgattacttttcctttcctgcactacttttgtttttcattaatagttgtcttttttttttttgcttatgtttttatattgttatcaacaattcaatcctcaaactctcctctagctgtaaattgatagaaaccacattaggttttctgtttcaccttctggtcaaagtctctctggatctttctgaactcctctagtttgcctgtttttaataattgtagtttgggaacttccttcactatcacctgagaattcctatcatctctttcttgtgttgaatccttggtctcctgaatcacatgtcttccttttctcaatatgtactcccttgtttaggtggaaaacatcctctaataacttcctgggaaacaatgcctgggagataattgcttgtaatttgcaagtctggaaacatctttattctatttttagactttaaaaaaatgataatttgtttggatatggaagactacagtggaaaaaattgttttagttttctttccttcaattttttttttttttttttttttgcttagataattctcttttcttttcaaaattttggtgatgcttagatattcactcatattaaagagaaaaaaaactggctggaagctctgagcacatgggcaggcttgttatgcagcgattaccccataaagtgatctggttgagccatttatttgggaaacctatgatgtcagacttcttaggtttggtgttggcttagttatattccccagagagtaatcttctaatttccctggattatataaacctagctgctggcattctggaagttgaatggaacatgaaagcttaggggctccacattttctgtgtaaactttccctctctttgtttttcagatggcacctctaccctctactgaacctggcattccccagtctagagatacttttattttctccagagagcaaatatccattctgtcactgggatgagacggacagtaaccatgtagtgcagattaggggaagggacctaagagttcaaactgctttttaaatagatttttttctcctagtttctctattgtcaactgtcttagccagcttgggctgttataacaataacaaactaccatagactgggtagcttaaacaacaagtatatttctcacaattctgaagcctggaaagtcaaagatcaagatgctgccagattcaatgtctggggaagacctgcttcctagtttacagatgaccatcacattgtggagaaacgagagaggaagcaagctctgttttgtctcttcttataatagcattgatcccatcatgagtgcgccactgtcattacccaattacctcccaaaggctccacctcccagtaccatcacattggatataagagtttgaacacttgaattttgggggagacacattcagtccacagcatgaacctcatactcataccattggttcctgagtcttttggatatatattccttgatgcaaattgagttttttctttgaattgcccattgccaggttggaatttgcctttcttgtctcctgctgagtcagttattatgcatccaactgttctgttctctatcttcaataagttttatgtttttaatttcttctcttgttctctttgatcttgggggtttattgttgttttttcatctctttactatagtttcagtgaggttatttcctcaagagaaagatgaaaaaaatattttaaattaatgtttccttaaatcagggtgtgagttgcattcagtgcaaacatttgaatggatatgtgttcaatctgccacttttaacttttggtaagtgtattagtccattttcacactgctgataaagacatacccgaggccaggcacggtggctcatgcctgtaatcccagcactttgggaggctgaggcaggcagatcatctgaggtcaggagttcgagaccagctaggccaacatggtgaaaccccgtctctactaaaaatataaaaattagctgggcgtggtggtgggtgcctgtaatcccagctactcaggaggctgaggcaggagaattgcttgaacctgggaggcagaggttgcagtgagccaagattgcaccactgcactccaatctgagcaacagagcaagactccatctcaaacaacaataacaacaaaaaatatacccaagtctgggcaatttacaaaagacggatgtttattggacttacagttccatgtcatgtggctggtgaggcctcacaatcatactggaaggtgaaaggcacgtctcatatggtggcagacaagcaaagagagcttgtgctgggaatctcccctttttaaaaccatcaaatctcatgagacttattcactatcacgagaacagcatgagaaagacctgcccccatgattcagttacctctcactgggtccttcccacaacacttgggaattcaagatgagatttgggtggggaaacagccaaaccatatcagaaagtttcatttttatgccccttttactaattaggaaattgagatgtggagaaatgtagtaacttcatgaaggtcacataagcactattggagccagaatataaacctcttcctccaacagtcttcttccagaacccactcttcttacctgtatactatgctgcatctccatgtagtacaggtttctcattttacaaaactgtagcttggaggtctccatatctttgagtgtgttgtgcttctcatttggaaagctttctcctttctctccatcctttagtgctcccctacttggtctttactcagtattctaacccacatgcctctcctttggtaggataaagtggtgcagcagaatgtaagagctgggtttgagtctcagcttcagcagctaccagttttaccttaagcatttcagcttgctgagcctctcctttttcttctgggaaaaaagctcatttaattcttataatgttcgattgttgtaagaattaagtgtattagcacatgtacatacatacgcctagcccatatgtaggcacttgaacaacagtgtttccccagttctaatgtttcttgcagatgtaagaagcacatcaggtttttcaaggcaaaaaaatagtagcacattaaggtatatagtgatttaaaatacacctccaattttagacattataaatgaggaaaatttgtacctctctcaatagaagaaaatgcagaatgtcttatactgttagggtaactgcaaatgtggatgttatgcctttgattataagctttttgatttatgccaaagattataagctctttgaagacacagactatttttaatctttttatgtcactcctgatatctagttcaatgattaatggaaatgtattaagcgcttagcacatatttgatgaatgaacagtctatatattaaaattcaaaagtaagagcatttctctatttgaaaatggagtctggattacatctagatcataaatttgggaactctaaatctcatattttctatttgctaaaaggcaaaaattaatcactggagaatggtcatttgctattggattaagaactttttattacaggactttctaattaaaataattacatatatgtagaatgttcattttgtcatattataaagtaatatgttatttatcatacaaataatttctgtactagcaaaacactcaagatctacattgtgtcatctataaagatgaagatgaataatttattttaattttaactggtgtgaaagctttaagaaattccttaataaaaaaattttcatagcaatatttttaaaaagcacctcaggatgttataattgcaggttaggttattttgacaagactgtgtaactgatccatgcattttatgtttctattcatagaggagtgatggagctaaaaattaaattaaaataagagctgaaaaggcatgtgctaatgtgactggaagaacttacacattatattttaatttggttcccaaggtctccagctgtattcatgagggtgactagataccttatccttattcttatataaagaaacttttattatttaatgtaacattattttagggaatgaatttcgtaatacaaactaaaacatcatgattcaatatatgcaaataatctgtcatgctcctcatttttaaaacagaatacattgtacttttactttatctgctttggaggattttgtaagaataatggtagtccatgaggatttaaaacagtgagcaagatagatgtggatcctgcccatatagacaggatgaccagataatttatcatccaaactgggaaacaaaagagaacaaatgggatgtgattagtaaattgcactgggacaatatgcaaaacataaccattccagaatgaatgatcacctcacttaaagaacttattgtctagggaagggttacaggtagaaatgaaactagggcagtagaccccccaccccaacaagtaattatatagagtgctgattatgctgtgagtggggatctataggtgctattggatcatataggagagtaattaactgtgacctgggaggatcagggagggcttcccagaggaggtgacatctgaaacctgcaggatgaataggggttaaccaggcaaaaaggaggggtagaaagttctaaacagtgaagatggcagttactggtaccctgaggggagagaacaattgagtgttgatgagtatgtctgtatgactgtaaccagaagaagaaggatcaagtggtaaaacacaaggctggtagtgttggaaggggtactaatttaagaagtttgactttatctcaacagctttaagtagggcagtgagacgatcaagtgggccaagagctattgcctgtattcatttgatcatcatgtatccagttatcttggctagaactggatcttcacatctctcagcacgtggagctaggcaatgtttccccacccattggaaagaattcagaaagggtcatatctgacagactagtgggttacccatggaaggtagctgggtagaaggagtgccaaggaaaaaaaaatcaccctaagttatgcagaaggcatgcaggtgcacacacagcttggcctcagggatggagtgttgggaggtgatggtgcttcaagcatatggctgtgcgtctacactttggaccctcatccctctctgcttggacccccacagtacttatgaaagctggaagggagtgttctggtaaaacaagcaaattatatgcctgggtgttgaaagcaacttcccagagaaaatttcctccaagagtggtggggtttagcacctagagaaagatgagcgctgattggaaaattgaaagctgggggccagatgctccaagaggacagtagtggagaggccactgtctcaggccccaggaggcctccaacgtcatggattcctcagcatgcctgtggtccagctttgtctgagcagagcacagaccatcccagacctggaggtagtgtggtctgcaggcccgggacagcttctgagccacagtagcatggaagagactggcaaagggctgccataacaaagtaccacagactgggtgacttgaacaacacaaatttattttctcacaattctggaggctacaagtctgagatcaaggtgttaacagggttggtttcttctgaggcctctctctttggcttacagttgctgccttctccctgtgtcctcacgcggtctttcatttgtatttgcatgtgttttaatctcttcttagaaggatgccaatcattttgaattagagcccacccagtaaccttttaactttgattacctctttaaagcccaaatctccaacacagtcacatactgaggtattggaagcttcaagacatgaattgtggggggacacaattcagctcacatcagggcctccttgggagacactagcatgcggtggttgcaggttctgatccttggcctttggtttctatggatcaggaaggcctaggagcatttgaatcatcttcagaacaatgccaagtgtcttatggtcctatttttcacttccagtgacagaggtattaccttacatagtctgtgtgcatcttagattattggaaacttcctttgtactgttggtctttggtctctttagcacttcagggtatgactgtgtcctagaatagttcccttttttactgttaggtgtggttaagggtatgggctctgttggatttgaagcctgatttcactatttattacttgtgtgtctttcagtaaattccttgacctcattatgccttattatccagatccatacagaataggggtagtaaataagctagggagaagttagcactgtgctgcacacttattacatgtttaattaaggttttatcatcttcatcattatcatcattgtcatcaccatcgtttccttttaacacgacactgagaaaggcctgcactgccactcacatgatgacctgtgcaggaagaggaggactagcattttccctattcttactgaacaattctcgtttaccgtacttttcctggtcatcttcccataacttgtctttcccatctagaagcccaaaacccctttacctttgattatcctaagatcgtatgtaaggccaagttctaaccactcctttgagttactcataactaggggctcccacatgtatttatgttgaacatgttaataaacttctgtttgtttttctctttaaaaattataaggtattattggagtattacactaaaacattatcaaacaaatatgtgataatagcatgaataaaccagtgttggcaaaaagagtcaaattctgtaaaatattttgaagggatttattctgagccaaatatgagtgagggcccctgacacagccctcaggagatcctgagaacatgtgcccaaggtgttcaggatacagtttggttttatacattttagggagacataaggcatcagtcaatcatgtaagatgtacattggtttggtccagaagggtatgacagctggaagcgggggcttctgggtcataggtagattcaaagattttctgattggcatttggttgaaagagtttaattattgtctaaagacctagaatcaacagaaaggaatgtctgggttaaggtaaggggttgtggagaccaatgttctcattatacagaagtaatccccaggtagaggcttcggaaagaatagattgtaagtcagttgtctcctggatcaggaaaaaaatgaaggacaaggaaggggattctcttcagaatgtagattttccccacaagagtgagctttggaggactatttcaagacatagcaaagaagacatatttggggttaaaatattttgatttccttctttatctgccatgtgatattatgccagagtcaggttggaaagtcagccacattatatagggttaaataaaaccccttggatgagattttttggtttgtagggcatgactccccagaccccttagataggaatttgggcagtagaagaaaaaggtcagagttgagttcttcaccagtctcttatatgttggtaggattggtatgcatccacataattaaggtagcttaatttttggtatcttatgtttattgattatattaaactaacttaccttgtctggtccttctttctttgtatgtcatcaagacctataggacacttacttttttcctaccccttttgttactggctgggctcgttctgcctgtatgcagcaagctaatcactgtggtgacagtttttgcaaaaaagaaaagactttattcacaaggctgcaatgtgcagggccagggaaataaatctcagatctacctctctgaaaatagggcttggaggtatgtatgtgatagaaagtggggtggtctaaagtatagggaaagatgattggtgagtcggaaaggtgaggtaattagggcttctgcacaagggtaattgagctgtatggttcttcataggatatatgtgcagaaaatggtggcactagcataatgtgataatggagtttttggctctctgatatcaaaaaggtccctcttcaggcagctgttgcaggcccaacctgtgcaaccaacttgtgaagttgaaggtctcaactggcttgaactagacaaaagctgccccctagtttctgaaaaataactataagcaccgttactaccgtgacccatagtcagagacgttacccataaggtaactagtgggagtttagttatgtatttttcggtcatataacttgccagtggcagttttaagatcaactagaagtaagtaattaaaagctagccagctagtttggaaggcttaatcatgtttcacttgctcactattatggtttaataagatatttattttgtctgtgtaaatatattttcaggtttgacttcaaaaaaacccaagtgagactctagcaactttgaaacattttaataaaaataaagactattaagaggttagaccccatcaatcctatgtaccagattatatttgaaaagagacttaccagaaatggagaacgttccactaatgaatatttcctaagggtgaggatggtaaataatttcaattatgtgaaaaaattgctgtattttaagaaatttttgctgtgtttctgggggttaatgcccagcttcctctggagagcttggagacgggggtctgagtcttcaccagctgtaaagttgtcttgagaacagtccttgaaggattgctgctatacacattcttggtattaaaaacactagtatttggcatatgaactacattagcaaaaagtgaaacaaaagaaaaaattcacagagatacctgtcactggagcaaatcactacatgattcatatttgtattctataataaaagaagacacacaatgatgtttactgagaccctgtgatgtgtcagcctttgcactaggtacactacatacactatacagccccctgtgataaggtggtattatctgtatttttagaaaatgaagaaactgagtcttgggaaaggtaagaaactaccctagcctagctgcatattgatatgtgcaaacagcttcattttgtaaaatgtgtgttttatttttgtttgcaagctggatttatttggttgtatttttcatcacaaagactgaaatttgtggtactagtcttttgggggtcattactcactttgagaagttactacagtagctgaacttttacactgttaaatgaaaaccactatgcctgttgtaggggagggggaaaaatcttttttcctctatcttagatttttcagcagggcctccatatgttagaccaccaaagacagattagcaagagaaaaacaaacagaaatttatttccatgttcatcacagatacatgtgggggcacccagtgatgactaacccaaaggagtggttagaacttggccttatatacgatcctaggattatcaaaggaaaaggggtttggggcttctggatgggaaagacaagttacagaaagatgactgggaaaagtactgtaaacaagaattgttgagtaaggtttgttgtgcagattgaagtcagtaccttctccattgataagagttaggagtcctcctcttcctgttccaggagaggaagagaacttcatttacaaaaagaaattatgaaaatgttctttataaatgtaaattttctttacaaaaggaaaacggtaccctgtgtttagagctactcctgcatctgctggttctcaatggcttttaggtcaaaatgatccctgtgctgaggaggcatattttggggtggctattctggtaccctccctgccttgcttttttatagtagttatgcaatagaggcaaatcccttcctccttcccgggttcattaagctgaactgagaggctgatggatacttaaaattttaacatgttttattaactatttttatacattccttgtctttaaatgttcagtaaaatcaataaattctctgttcaccaaaataatattgtcattattcagtggttgaccacaaagctcctgaggtcatgcccaaggacagggcctacttgaaaaagagctcagaggagcctgactagggtttggtctggaagagaatctttgtcatgccaatggctcagaagattgtagatgatcacagttgaaagagatctcaaaggtgatcactcttaagtgacagaaaaagagccacctcatttgcttccagccccacatagcactcccttggggtttgtgataaatgcagttctatctcttgagagtgtgtgagcagccctaaatgctggctacctggagagcaactctggccttttttcatattgctctgcttcctaatgctccactcagctggctcagctctgattatttctggattctgaggggaactgcaggagactggcctggatttccctgggctgtaggggaaaacagccttgggttaatccatgtgcgaggcatgggaaaaagtgcaaggaggtgggaagagggagaagaagtgtctgcctggagcttacaagtagccatgttgttcactctatttatggtgagagaaactttttataaaaacaaatatatggtcgggcgcagtggctcatgcctgtaatggcagcgctttggcacgcccagatgggtggatcacaaggtcaggagatcgagaccatcctggctaacacggtgaaaccccgtctctacttaaaatacaaaaaattagcagggcgtgttggccggcgcctgtagtcccagctactcaggaggctgaggcaggagaatggcgtgaacccgggaggcggagcttgcagtgagccgagatcgccccactgcagtccagcctgggcgacagagcgaaaccctgtctcaacagaaaaacaaaacaaaaacaaaaacaaatgtgtttgctaacaaattttaattcaatatatacattttaatcaagtatataaatatatggaggatatagggaataataaatagtaaataatatgtagtaaaaatagtaaatataacaaaccttttccagtggtgattaatccttaactcattttaactcaccttttgaaaaaaataatttcaacttttattttggatttagcatgtacatgtgtaagtttgttacatgggtatattgcatgatgctgaggtttgggatacggatgatcccatcacccaggtaacgagcaatggagttttttagcccatgcccccagtccccttctagttgtccccaatgtttgtgtttcctatctttatgcctagggatactcaatgcttaactcacttagaagtgagaagaacatgtgttatttgtttttctgttcctgcattaattcgttttgcataatggcctgcagttgcatccatattgctgcaaaggacaagattttcttcttttttacagctattaatacatagtattccatggtatatatgaaccatattttttaaattcagtctaccactggtgggcacctagttaattcatgtttaaaatggtgtccattcccctaagctttgtagtatatagcggattatgattcaacaattttagaaaacacctgatttagtgagttggtctccaaacgataaatgtctgtaaaagagaatttcatctatcttattatttttaatgatcatgtttgaaatgaagcatatcaagttagacttattagttagatgccatttaatttgagattattttaactttaggatttttgctctccattcagttgttgggagtgttttaaaaacactggactttcagaaagattaaggtgttacaactccctatagtaatcaatattctttgcagttttaaagctcaagtgtccatgcctgttggagtttgtgttaggctacaaaagatgagtttataacctagattctgaaaggacactgtagcaacattaggttgctaagcaagtcccttggctacttaaacaacgtgccttgaattattctgactgcccatgctgctcagtcataatggagcaattaaaaaatgacactcacttttaggtttgtccagacttaagttagaaataaatggaagtagagacatactatttttaataattaaaaaaagaaaataagaaataaaaatatagttgtgtgaaaaatgttcaaagcaactcaacaacctaatgttcaataaaatggagtacttaaccaactatgatatactatatgaagtatgcagtcataccaattgagggtttgtacacaatataacaaatattatatttcactcagattgtaaatcatagctctctcttttatacaaatcatcagaaataggcacagcttaacatattcctttcataagcactttcctcctgttattgctttccaaaataaaattgagacagaaggaagcctatttagcttatccagattgtaattaatttagccacttgggtgtattagaaaatgggagctagaccctctactgagggttgtaaagtgtagtcatggaccaggacccagactattcaaataatttatttttctagtcagagttactccagtgattaaaaacaaagacacgggatgggggcagggactaaatgaataaatgtgcttgaatagccaaggagcaatttcaagcctgacaactgcatcctgttatatatttcaatcatgcaatattgaagcccctataagaatccatttttcatttcctactgatttttattctctctctatgttattttttccacctacttttcagaaatctgctcttgaatggaaaattatatttctgtagacacttagccatgaggtacttgattttaatttaattccactaatcatatttggaaggaaaataaaatctctataaatgacaagtcaactagtatttgtggtttagatcattgtgtctttattttatccaatcttaatttctttcctttggccattccatctcttgttttaatttttacttcaacacttaattactattgttgattctcaaacatattttacttcctagtccttgaagcttcaataatgtgaaaacacttaaaaatatccagaacaattacttgtttgttaaaggagcattgtgtcagaacgttttatgtggacagtaaagctctccaagctgtctccctggaattcagaaactttagcatcaggaagacccagagtgtgcttttctgcatttagctcaatgcacccttttctcttgtctttttattcagctggaatgcttgctgattcctctgcacacttctaaggctgagaacctgaggaacccagctggaaaatgccgtctgaacgctgcctcaggtatgccctgtaggatatgtcctcacatgccgtagtgagccctgaaataagtgcattgcacgttctaggatcaagcacaaagcaggggcttaatgcatatttgaaggaatcatcaaactagtcagagcttttgtgaatttactgtggtggcacaaggactaactgctgtgacctacttatttgtcaaacctaaatatgtttcctgattctttgaatgatactattttttaatctttttttcttatttaggatgctaacttccctcaaacatgaggtatgctagtataaaggtatatcacataaaaaaggaatcaaaaaactatacatatatatgtgtgtgtgtatatatatatatagatgtgtatatatagagagatgtgtatatatatatagagagagagatagggatagagaatgagagagagagagagagagagggagagccctctctaaggcaatcactttggggagtacaatgcttattctcaaaatgctcacaacatttccttttaataattcatttatttaatagatattaattaagccaaacactctgcttggtgctgaggacccagctatgaataaaacagataaggttccttccctcttaaaatgtatattctatggcgaaaacagacattaaacaaataagcacaccagtaacgacacaaaaataattgtgaaagtgctctgaaggaaaagtacaggatagatagagcaagaaaatgccttcctgagaaaggctgtatacctgagatttgaaggggggcatgccctgaggcaggaaggagcttggcacattccagaaactgaggggcagccaatgagaaaatgcatggcattcatttgaatagtctcactggaggtaaatctgcatcatcctctgagggaacagtcaaaatatcttcagagcaaagaataagagagatgacaaacctggggaatacatttttcttaagaattgggtgtctgttaagtaatgagaccagcttctttccatgactctgaagctattagaggtgatttgttccagaaatgtgttgagaactggtgacattgctgtagcaggtgtaacgcctctgcactccctatgtgagtctgttgctctcaatcagtgattctcaatggtggatggttttgccaccagtgtacgttgtgcaatatctgacaatgtttttggatgtcacggggattgtggatacatttggcatctactgggtagaggccaggaatcattttaaacatcttgcaatgcatagggcagccccctacagcaaaaaacaaaaaacaaaaaacaaaaacaaaaacaaaaaaaaaaacatctagcccaaaatgtcaataatactgaggctgagaaaccctgctctagacctggcatccaaccaatacagcacatggagaccatggtgtctgtctgtcaccacctcagccaagttatttatttctggctaccaggatcagtgtgcatacttaaaataattttttacttttaagtctgccatcccgttcttattaatcaactgtcttccacagtgcagtaatctctatgatgttctctccttctctgcttcaacccagagccctcccttccccacctctcagactctcccactgtgccatgtggaagtgtcacaacacaaccacatgctctgctgtatcatctccttgtcctgaaaagctctgtttgcctccgacttcattgagacccatcctcctctgaggaccatttcccttgtagccctctcaaagtagtggcattattatttcctcacatcccatgtatttcaaggatgggtagagagagtgtcatcctcctagggcatggttttgcttctagaccattactccacaaattgattgtttgagaaagccacagccacaaaaacaacaaagacatgctcttctgaagatgatgccctttatctctctcctcttcctaactgtagtcggggtcattgtcctttattcactgagcatttcggcacttggcttgcagtcttcctcctcatcacaaaccccttactacacccccagggccctcatgtcagcctggaggatatgtctgcttcatggtccttggaccctcaatctgcttatctccaaagaccatctccctgcactcagccactcagtttcatggccacacctcagaccttgttatccttagtaattgctctgtttctgaaatcacgctatcagccattttactcttaccacagcctcctctcctttttcaaaatatggttgtactttgacctcattgtaatgtctcattttctggccctgctactttctaccaacccatccagtctttcctttcctcattttccttcttaagcagtttagattctatcactgttgctaaacccttaagttctctcatttcctgtatttttgatgcatttgcttgagaaaaccccaatccagatgaaccgatctattcatatttccatgcctacgttgtctagtggagactagttccacaaaaatcttcagattcaacaagccaaaaagtgcccagagttttagtatgtgattctggtccactgattccctgccactcaagaggcaatcctttcccacaactaggccaaaacctgcctctgtgcttcaaacttatctttcatatcttctcagcaacctttgagtgttgcttgtttctcagccatgttcttgagatacagctgtgttgtcaccttctctatgcagatgagtctcagatttacatttctagcaaagactcctttctgagttccagatccaggaatcaaactacatatttgacatttgtgcttggatgtcttaaagacaactcaaacttaacatgtcccaaaccaaattcatcatcattctcttctacaattctgattctctttcatttgtttcctgttctggaaatatcaagttgtataagccagaaatataggtgtcttctggaaatcttcctcccactcacctccatatgtaatctaacaccaagacctgtagattttcccactaaatagcttttaatcccattcacctttctgaaacttcatctgagtgctccttgggctccaaggcccaactccatcattcagctgaaccacagccacagtccaggtctgctctagtctggcccagtctcccctactgctcttggtactacagcttgaatgaccttttctgtgacttcccattgcccttaggataacctggcccagaattcctgcacaagtgggctcaggcctctgctgctcgggccttacctgcaccgtgttctcctttgtccctagctgttaactttctgtagacactctataagggccatgctccctcctgccacaggatcgtagcatttgctgttctcctgcctggaaaaccttctctttcacttttaaaagattaacttgttctcatccttcagccagcagctcaagtattatttctttagggaggccagattatttgattaatgtgtaactgccctactacactgaatgttccatgagggctgctaccacatatggtttgctcaccattttatccccagtacccagcacaacacctggcacaggcttaataaatatttgtggggtaaatgaatgagggaaggaaggaaacaaaactattcattcataattaagttcctttctacagagttttcattatttaataattgtctaagcatactgtatcttctttgcttattactatgaccattgctattagttgatcaagttcattttaaagtgtttataaattataaagtgttctatagaaatgaaattattttattatagggtcttttaatatcctgctaccttaaatataatttttaaaatattaatgtctttaattttcatgaaaagattttgactacataatttaagtgatttaagatgctcacttgatagttcaccaatagactgaattgagataattatgcataattattactgttagatttttttttgtccagcctttttctttcttgtgtaaagtagcctagttaagaaatgagaatctttatcccacttagttgtttttaatatgtaagtatgtaacaccttattggtagtcttacttaaaaactactgcatattttttatatatccaggttgtaggtaaacactgacatagaaattgacttgaattttaaaatttgaaatgcagatgtttaaaaccatatagctgttttcggaatttacaactttaaaactgacagaacttagtcaaaattctttccatgaacatcaaaccctataggatttctgtgaccaaaaatgtgaactctgtgacctcagagcagcaatttgcactaaagcagtgattcagtctgagtagggaatatgatataatgaacatcgttctctgcatttgatttattagtttttgtgatcaattccagaatgaaagttaaaggcttaaagttatgaataatcctctttcctgagacctcgtttatttatttccccattactagatactgacatatggctgatcaaatggttgctccctggcattactaaaaggtcatcttactgttcagggagtctggggctttccattgttgcatgagggcctatgtggggtcctgtgaaatacagggacagcagttcgcacaggcagcctgacgggggttgcctaaagccgttacagtgttcaggtggaaaaaaacagagggacatatatccctgggaactcatagagtatccaatagaaccataatgagaagcatatctataatttaaaatttcaggtagctatattaaaaagggtaaaaaaaaattttttttctgttgttgagacagagtttcactcttgttgcccaggctggagtgcagtggcgtgatctcggctcactgcaacctctgcttcccgggttcaagtaattctcctgccttagcctcctgagtagctgggatacaggcatgcgccaccacacctggctaatttttgtatttttagtagagacggggtttcaccatgttggccaggctggtcttgaactcctgacctcagatgatccgcccactttggcctcccaaagtgctggtattacaggtgtgagtcatgatgcccagccctaaaaaaggtaaaattaattttaacaatatattttatttaacccaacataccctaaatattataatttaaacatgtaatcagtacagaaatattgagctattttgctttcttttattcatattgtctttgacattcattgtgcattttatatgtatggtacatctcaatttggactggccatatttcaagtgctcagtgaccatgtgtggttagtgtctactgtataggtgtatccctacaatagagtattactattgtattgatacaacacaatacaatagagtgttactatggtattaatatagcatatactcttttgtattgatgcagttctagggcatccctcagagaaagaggttgcattggggaagccaggacactgtctgcactcactgatgaattttgaggtggcaacatggcttctgtgggagaccttttccagttttaggatgacactcaaatctgtgtttccttgagaaatatggttcttgctttcagtcttttttccagaaatttagaagttttaggatatacttttccttcctttatttctcaaaaaattgagggacattgctctaagttgagaggcttagtttgctaatttgatatatgttctagatgctgagggagctgtttgcaagcatgtgtctgctccccattttaatttagacatagtgcattacagtcttcgatttatctcctccctggtttatgactattgacttggtgaagtgggcgtgctcccttccagctatgttctgtggccacgtgtgccttaacatttagagggttgagatgttttacaaatttacatccaagagttgagtgggaagttactttcagaatacaataatgatttgttgattaagaggcctttatttcttgccaaatgttggagtatttgtttctgcttttaaggatccctaacatattggttccaaaatatttgggatcttgtgccaactgttgtcttaaatatttagcttgttgttttcttgaagcttgaattttcaagcccagctgaatgatcctgtgaaattgtgcagcatcactattgtttaaaagctgaggcttttattctttgccaaatttcagtttacagctgctctgtttctggtaagatttattcactctcaagagacatataaaatgcaaataccgattcagtcttaataataaggacaggaattgtggcactatatttggaaaactttttaaggcaattatcttaatatattcttcggttccactacaaatgaaattttgaaatacatttatttaacatttaaggtgatataaaagtggagaaagtaagttgtgaaagtttcaaatatattttctaaggttataatgattagaatctattttccatcccaaaactttcagtcacagtatgaagataaatgtttttgaagaaaaatttcaaacatttcttactgctgtgtcatgttgttctgttcatgtatattattctaaaaggctgattttgagattcattatacataatataaagttaatagggacttacatggttttttccccttaagcatagatttttgagatctttacagattgcctttttttttttagacagagtctcgctctgttgcccaggctggagtgcagtggcatgatctcagcttactgcaacctccacctactgggttcaagcaattctcctgcctcagcctcctgagtcgctgggattaaggtgcgcgccaccatgcctggctaatttttgtatttttagtacagatggggtttcaccatattggccaggctggtcttgaactcctgacctcaagtgatccacctgcctcagcctgccaaagtactgggattacaggcatgagccaccgtacctgacttcttctctttttttttcctttaagcaggaggaggaattacattgttatattcttggtgataggttctcaaaataccggatcttggaccttcagtttttctatctgtaaaatagagataataatagtacctgcctcatggtgttgttgtgcagattacatgaactagtcattgtaaatcactgagaatagttcatgggacacggtaagcactatgtgtttctcaaatatattaaaaagtcatccttttaggaaagatttttcaaagactatcctaaagctttacttggctgatacaatgtttctattactattccatttcttgatttgagatgctaattaattgagtgatgctaattaatctccattctagactttgcatagaaacttgcaaaaaattatttatgcttctgaatgtggtttttaattactgattttaaagtctgcctatagcttgagctactagatgaatattcagtgacagtaaccatttcaaaactcactgctacatttcaactgaaaataatcctcccaccttcccacaggaacttcctatatcatcaccgtctgtcaagttttttctttccatatttctgacattctgatgcttcccagtcaaaactgtccaataaagcttaatgactgccttctggcatttcacaggaagtatttggttaattttaagatggtgatttgtacctaactgtaatttaccagccaactggcaccacaggctgagcagagccctgccaaataaacccaccatgcaaactaggctggtggcaactctggctcccctgagaaactctttcacattcagagggaggggttggatacaggaattaccaacatgggagagacacagcttaatcatcccaacggtatttttactcagctttgagatggatctgctggccagaatcagggcttgatggctcttgctttcactctgggagtaacctattcctggcagatcacctgtcttagtccaataccagttctgagattttagagcactgtatagattcccgttgatataagctggaaatgtccatagctgtctgtaaagtgaaagtttgcattttgtgtttatggcattacttctgtattattgtagaatgatctagagcttcacctaggacttttgaaaggacataaggataaatgttttaggttggggtagagagtgaaggggtaagtttcacaatgtgtgaggttagcaatctcacaaagtagaacaaaaagaaaattatatagtcattcataaatccagtataatgatcacacatagaaactaaatgctgataatagataaattttactttcagctttaaatttgttttcatttacaatgcattccttttgatgttcttatggtgcacaatttccgaagtttaataataagcttctctggtttaattgccttttacatggaatggtcatttgcagccctttttgtcctaacatttgctcagttttcttgtatgtgttaacagagtcttgtgtcctgtgggagacatggtaaggtacaaaggtggggaaggaatcagggaattagagagaggggacagagtgggaagggtcacacacacatatacacatgcccagatgcacatccagaggaagttttgcactcagagatgttcacacactgaagggacgggacccagaaacagaggcttgcaggtccagacacctgggtcagtatgcagccacagatgaacacacacaaacacaaatgcagaaagagatgcaccagtaaaagagagaaagaccctgcagggagggaagcagagagaataagaaaaagggagaacaagagaatggtggagagaaagaaaatgagggaacagatggtcacactcatagagtgcactggaacccgtgttgcctcagtcgatgttcaaggaatgagagagcagctggcccacagggctgggaaaaggaaaaatgttgacttgattgctctcctttgtagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggtaagtcagcattgtttgtttctcgtaaaatattgataaagagaggatgacaatgtttcccaaactgtcactaaaccaggagccaattaggtggtacccccagagctgaatggtgggggcctttgttctttcctgggtagaatgcttcctggggccccattgggtcctctctgggcagggcacctggatgtccctccaatgtagaacagacctcccttggcatctgagccaaggagtgcttggcactttaccaccatgggaaaatgtggcactgtagtgcttcatgtgggggtgcagactggagtgagaggatgcttctggattcaggatcaaagaccaagctataagacaatttgttaaaatttaaaagtctttaagtatatgtattgtttcggatatatatatatatttttgttttgttttgttttgtttgtttttgagacaaagtctcgctctttcacccaggctggagtgccaatggcgcaatcttggctcactgcaacctctgcttcctgggttcaagtgattctcctgccttagcctcctgagtagctgggattacagggacatgccaccacacctggctaatttttgtagttttagtagagacggggtctcaccaagttggccaggttggtctcgaactcctgacctcaagtaatctgcccgcctcggcctcccaaagtgctgggattacagacacacaccaccgcggccagcctatatatactcttaatgctttctaattatttgctccaaggacagagattcataggcctaatggaccttcatggtcagtacatgcatgcggctaatgaagacacatcttgtttaccagagctttggggttgatttccaacagcaaattacatgtggtaataagattgctgtttttcttgaagatgaaagtacataatatagtgatagctgattaaatgccacttattagcacttcttgtgattcacatggtgagcaaaggattttatatgcatatctcatttgatcctcacaacaacccattgtgcacatatatatacatattattaaaatgaccattttgcatatatggaaacaataacaaagactaagtaatttgcactaactcaggatcagtaagaagtcacacagttcctaaatggcagatctggaatcgaaatctatgtttgactcttaacgagtgtgatagtctgcttcatatatggacataaaatagcaaacctggacaattattagccagaatgttttgaaacattaatttctaaatatacattatttcaatgcctatttaattttcttttcaatgttttttcagttaacaagtgactaatacttttggaacataatggtatgaatctccatataaatgggaatataaacaatttaattgtgttgtgttgtttttttaatttcccccagtaaagcctaaatgttacagacaccaacttaggcccatgagcaatttgttgattggtttgaatatttctaataatactgttggttttgttatttaagagacaatatcaactgcacttaattgccaagtagcagtcacagagatttttcaaagatgccaaatcatagaagacagccttttttaaaaagtgtattaaatgtgatgaaactgagtaatgtagaagataaagaggtaattacttgaaatgtctgtttctgaaataaaaagtagggatttaattctaaactacaaagatgatacagagtatctgtaaagtggccttttagttccattaatataattatacatttcacacaccctcactcacattgtcaggtattcttctttcagaaaggtcatattattcagaggggcttttggatcagcaaaacacttcagattgtatgcagattatggaataggaattttgtcttttaatggaccgtaatatagccttcttggtgttaacttctctctacttaggtttcagcatttcagtattggatttttttttgaacttttattttaggttcaagggtacatctgcaggtttgttatgtcagtaaattatgtttcatgagggtttggtgtacagattatttcatcacccaggtaataagcataatactcaatagctagtttttcaattttctcccttcccccaacctccaccattaagtaggccccagtgtctgttgttcccttctttgcatccaagtattctccgtgtttagctctcacttataagtgagaatatgtggtgtttggttttctgttcccatgttagttagcttagaataatggcctccagctccatccatgttgctgcaaaggacatgatctcattcttttttatgactgtgtagtattccacaatatatacataccacattttctttatcctgtctaccactgatggtcatttaagttgattccatgtctttgctattgtgaatagcgctacagtgaacatacacatgcaggtgtctttatggtagaatgatttgtaatactttaggtctatacccagtaatgggattgctgggttaaatggtaatactgttttaagttctttgagaaattgccaaacggctttccacaatgactgaactaatttgcattgccaccagcagtgtatcagcattctcttttctctgcaacctctccatcatctgctatttttttactttttaatcatagtcattctgactggtgtgagatagtatctcattgtggttttgagttgcatttctctaatgattagtaatgttgagcactttttttatatgcttgttggctgcatgtatgtctttttttgaaatgtgtctgttcatgtcttttgccccctttttttatggtgttgtttattttttgcttgctaatttgtttaacttctttatagattctggatagtagatctttgtcagatgcatagtttgcaaaatattttccccattttgtggggtgtgtttgttgatagtttctgttgctgtccataagctctttagtttaattaggtcccatttgtcaatttttggttttgttggaattgcttttggtgtctttgtcatgacatatttgtcaggacctatgtccagaatggtatttcctagattatcttccagggtttttatcattttaggttttacatttaagtctttaatccctcttgagttgatttttgtacctggtgaaagaaaagggtctagtttcaatgtttgacatatggctagccagttatttcagcatcacttattgaatttggtcttttcccattgcttgttttcattgactttgtcaaagatcagatggttgtaggtgtgcagctttatttctgggctctctattctgttccatttgtctatgtgcctgtttttatactggtatcatgctgttttggttattgtagccttgtagtatagtttgaacttgggtaatgtgacttcaaactatactacaaacaatactacagctttgttctttttgcttaggattgctttggctatttgggctcttttatggttccatatgaattttagaataggttttttctaattctgtgaaaaacatcattggtagtttgataggaataacattgaatgtgtacattgctttaggcagtatggccattttcacgacattgattcttcctatccatgagcatgaaatatttttccacttgttggtatcatcgctaatttcaatgagaagtgttttgtaattctctttgtagagctcttttacctctccggttggctgtcttcctaggtattttattctttttgtgactattgtgaatgaaattgcaatcttgatttggctctcagcttggatgttgttggtgtatagaaatgctactgatattcgtacattgattttgtatcctgaaactttgctgaagttgtttatcagatttaggagatatggggcagagactatgtggagagttctaagtatggaatcacatcatctgcaaacagggatagtttgattcctctcctcctatttggatgccttttatttctctctgtttcctgatcactctggctaggacttccagtactatgttgaataggagtgctgagggtagccattcttgtcatgttctagttctcaaagagaatgctccagcttttacctattcagtatgatgttggtgtgggtttgtcatagatggctcttgttagtttgaggcatagtcatataatgcctagttttttgagggcttttaacatgaagggaagttgatttttatcaaaagccttttctaaatctattgagatgatcatgtggtttttgtttttggttttctttatgtgatgaatcacatttatttatttgcatatagtgaaccaaccttatatttcaagtataaagcctacttgattgtggtggattagctttttgatgtgcttctggatttgatttgctagtattttgttgtggatttttacatttatgttcatcaaggatactggcctgaattttctttttttgttgtgtctctgccaggttttggtatcaggatgatacttgtcccatagaaagacatagagaagagtttttcttccttagtttgtaaaagtagttttagtaggaattgtaccagctcttttttatatatctggtagaagtcagctgtgaatccatttggtcctgggcatgttcaggttaataggtatattagtccgttctcatgctgctaataaagacatacctgagactgggtaatttataaaggaaagagatttaattgactcacagttctacagggctggggagacctcaataaacttacaatcatggcagaaggggaagcaaacatgtcattcttcacatggtggcagcaagaagtgcagagcaaagtggtggggcgggggggcaggcgggggaaaagcccctcataaaacccttagatctcatgagaactcactcactatcacaggaacagcatggaggtaactgcccccataattcaattacctcccaccaggtccctcccaggacacatggtgattatgaaagctacagttcaaaatgagatttgggtggggataaagccaaaccatatcagtaggcttcttcttactgattcaattttggaacttcttattggtctgtacagggattcaaattttttcctggttcaatttgggaggttgtatgtttccatgaatttatccatttctactaaattatatcttgtgcacatagaggtttgtagtctttgaggttttttttgtatttctgtgaagttggaagtaatattccctttttcatttctgattgcatttatttggattttctgtctttcttttattagtctagtttgctgtctatttatcttatttattcttttgaagaacaaactcctagttccattgatcttttatatgatttttagaatctcaatttccttcagttcagcattgattttggttatttctggtcttttgttagctttgtgattggtttgctcttgtttctctagtttttctaggtgtgatgttagattgttaacgtgacatctttctaactttttgatatgggcatttagtactgtaaactcctctcttaacactgctttagctttgtctcagagatgctcatgtgttgtatctttgttctcattatttttaaataattttttgacttctaccttaatttcattgtttacccgaaaatcattcaggagcaagttgtttatttccatgtgtttgtgtagttttgagtgattttcctagtattgatttctatttttattacactttggtctgagagtgtgatcggtataatgtcagttttttttaatttgctgaggattgttttatggctaattgagtcatcaatttcagagtatgtgccatgtgcatatgataaaaatatatattctgttgtttttggatgaggagttctgtagatatctgttaggcccattcagtcaagtgttgagttcaggtcctgaatatcttggttagttctctgcctcaatgatctatctaatagtatcagtgaggtgttgaagtctcccagtattattatgtggttatttaagtctctttataggtccccaagaattctgtttattaatctgggtgctcctgtgttgcgtgaatatatgtttagtatagttatgtctttttgttgaattgaccctttaccattaggtaatgcccttctttgtcttcttttattggtgttgccttaaagtctgttttgtctgaaattagaagagcaaccctgcttttttccattttctgtttgcttggtagatttttctttatccctttacattgagcctttgggggtcattgcatgtgagatgggtctcttgaagacagcacatcattgggtctttcctttatcaaacttgccactctctgccttttaattggggcatttagttcatttgcattggaggttaatattgacatgtgtggttctccttgaagaggtccttcacatcccttgtaagttggattcctaggtattttattctctttgaagcaattgtgaatgggagttcactcatgatttggttctctgtttgtctgttactggtgcataagaatgcttgtgatttttgcacattgattttgtatcctgagatgctgctgaagttgcttatcagcttaaggagattttgggctgagacgatggggttttctagatatacaatcatgtcatctgcaaacagggacaatttgacttcctctttttctaattgactaccctttatttccttctcctgcctgattgccctggccacaacttccaacactatgttcaataggagtggtgagagagggcatccctgtcttgtgccagttttcaagggaatgcttccagtttttgcccattcagtatgatattggccgtgggtttgtgatagatagctcttattgttttgagatacgtcccatcaatacctaatttgttgagagtttttagcatgaagcgttgttgaattttctcaaaggtcttttctgcatctattgagataatcatgtggtttttgtcattggttctgtttatatgctggattatgtttattgatttgcatatgttgaactagccttgcatcccagggatgaagcccacttgatcatggtggataagcttcttgatgtgctgctggatttggattgccagtattttattgaggatttttgaattgatgttcatcaaggatattggtctaaaattctctttttttgttgtgtctctgccaggctttggtatcaggatgatgctggcctcataaaacgagttagggaggattccctctttttctattgattggaatagttttagaaggaatggtaccagctcctccatatacctctggtagaattcagctgtgaattcatctggtgctggactttatttggttggtaagctattaattgttgcctcaatttcagagcctgttaattggtctattcagagattcaacttcttcctgatttagtcttgggagggtgtatgtgtcggggaatttatccatttcttctagattttctagtttatttgcatagaggtgtttatagtgttctctgatggtagtttgtatttctgtgggatcggtggtgatatccctttatcattttctgttgcgtctatttcattcttcttcttttcttctttattagtcttgctagcggtctatcaattttgttgatcttttcaagaaaccacctcctggattcattgattttttgaagggttctttgtgtctctatttccttcagttctgctctgatcttacttatttcttgccttctgctagcttttgaatgtgtttgctcttgcttctctagttcttttaatggtgatgttagggtgtcaattttagatctctcctgctttctcttgtgggcatttagtggtataaatttccctctacacactgctttgaatgcgtcccagagatcctgatatgttgtgtctttgttctcattggtttcaaagcacatctttatttctgccttcatttcgttatatgcccagtagtcattcaggagcaggttgttcagtttccatgtagttgagcagtttcgagtcagtttcttaatcctgagttctagtttgattgcactgtggtctcagagacagtttgttataatttctgttcttttacatttgctgaggagtgctttacttccaactaagtggtcaattttggaataagtgcagtgtggcactgagaagaatgtatattctgttgatttggggtggagagttctgtagatgtctattaggtccgcttggtgcagagctgagttcaattcctggatatccttgttaactgtctcattgatctgtctaatgttgatagtgggatgttagagtctcccattattattgtgtgggagtctaagtctctttataggtctctaaggacttgctttatgaatctgggtgctcctgtattgggtgcatatatatttaggatagttagctcttcttgttgcattgatccctttaccattaagtaatggccttgtctcttttgatctttgttggtttaaagtctgttttatcagagactaggattgcaacccctgcctttttttgttttctatttgcttggtggatcttcctccatccttttattttgagcctatgtgtgtctctgcacgtgagatgggtttcctgaatacagtacagtgatgggtcttgactctttatccaatttgccagtctgtgtcttttaattggagcatttagcccatttacatttaaggttaatattgttatgtgtgaatttgatcctgtcattatgatcttagctggttattttgctcgttagttgatgcagtttcttcctagccttgatggtctttacaatttggcatgtttttgcagtggctggtaccaattgttcctttccattttagtgcttccttcaggagctcttgtagggcaggcctggtggtgacaaaatctctcagtatttgcttgtctgtaacagattttatttctccttcacttatgaagcttagtttggctggatatgaaattctgggttgaaaattcttttctttaagaatgttgaatattggcccccactctcttctggcttgtagagtttctgccaagagatcagctgttagtctgatgggcttccctttgtgggtaacctggtctttctctctggctgcccttatcattttttccttcatttcagctttggtgaatctgacaattatgtgtcttggagttgctcttctcgaggagtatctttgtggcattctctgtatttcctgaatgtgaatgttggcctgccttgctaggttggggaagttctcctagatcatatcctgcagagtgttttccaacttggttccattctcttcgtcactttcaagtataccaatcagacgtagatttggtcttttcatatagtcccatatttcttggaggctttgttcatttctttttattcttttttctctaaacttctcttcttgcttcatttcattcatttcatcttccatcactgataccctttcttccagttgatcgaatcagctactgaggcttgtgcatttgtcacgtagttctcgtgccttggttttcagttccatcaggtcctttaaggacttctctagaattggttattctagttagccattcatctaattttttttcaaggtttttaacttctttgccatgggtacgaacttcctcctttagctcagagtagtttgattgtctgaagccttcttgtctcaactcgtcaaagtcattctccgtccagctttgttccattgctggtgaggagctgtgtcctttggaggaggagaggtgctctgatttttagagtttccagcttctctgctctgttttttccctatctttgtggatttatctacctttggtctttgatgatggtgacgtacagatggggttttggtgtggatgtcttttctgtttgttagttttccttctaacagtcaggaccctcagctgcaggtcttttggagtttgttggaggtccactccagaccctgtttgcctgggtatcaccagtggaggctgcagaacagcagatattggtgaacagcagatgttgctgccggatcgttcctctggaatttttgtctcagaggagtatccggccgtgtgaggtgtcagtctgcccctaatggggggggcctcccagttaggctactcaggggtcagggacccacttgaggaggcagtctgtccgttcttagatgtccaactgcatgctgggagaaccactactctcgtcaaggctgtcagacagggacatttaagtctgcaaaggattctgctgccttttgtttggctgtgccctgcccccagaggtggagtctacagaggcaggcaggcctccttgagctgtggtgggctccacccaattcgagcttcctggctgctttgtttacctactcaagccttggcaatggcgggcgcccctcccccagcctggctgctgccttgcagttggatctcccactgctgtgctagcaatgagcgaggcttcgtgggtgtaggaccctccaagcaatgcacgggatataatctcctggtgtgccatttgctaagaccgttggaaaagcacagtattagggtgggagtgacccgattttccaggtgccatctgtcacccctttctttgactaggaatgggaattccctgaccccttgcacttcctgggtgagacgatgcctcgccctgcttcagctcatgcttggtgcactgcatccactgtcctgcacccacttcctgacactccccagtgagatgaacccagtacctcagttggaaatgcagaaatcacctgtcttctgcatcgctcacgctgggagctgtagactggagctgttcctatgcggccatcttggctccaccccccagtagtttgtatttctatgggatcagtggtgatatcccctttatcattttttattgcatctatttcattcttctctcttttcttctttattagtcttgctagcggtctatcaattttgttgatcttttcaaaaaaccagctcctggattcattgattttttgaagggttttttgagtctctatttccttcagttctgctctgatcttacttatttcttgccttctgctagcttttgaatgtgtttgctcttgcttctctagttcttttaattgtgatgttagggtgtcaattttagatctctcctgctttctcttgtgggcatttagtggtataaatttccctctacacactgctttgaatgtgtcccagagattctggtatgttgtgtctttgttctcgttggcaaaccactgctcaatgaaataaaagaggatacaaacaaatggaagaacattccatgcttatgggtaggaagaatcaatatcatgaaaatggccatactgcctgaagtaatttatagattcaatgccatccccatcaagctaccaatgactttcttcacagaattggaaaaaactactttaaagttcatatggaaccaaaacagagcctgcattgccaaaacaatcctaagccaaaagaacaaagctggaggcatcacgctacctgacttcaaactatactgcaaggctacagtaaccaaaacagcaaggtactggtaccaaaacagagatatagaccaatggaacagaacagagccctcagaaataatgcggcatatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggatgaaagacttacatgttagacctaaaaccataaaaaccctagaagaaaacttaggcaataccattcaggacataggcatgggcaaggacttcatgtctaaaacaccaaaagcaatggcaacaaaagccaaaatagacaaatgggatctaattaaactaaagagcttctgcacagcaaaagaaactaccatcagagtgaacaggcaacctacagaatgggagaaaatttgtgcaatctactcatctgataaagggctaatatccagaatctacaatgaactcaaacaaatctacaagaaaaaaacaaacaaccccatccacaagtgggtgaaggatatgaacagacacttctcaaaagaagacatttatgcagccaaaagacacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaatgggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagatacatgcacacgtatgtttattgcagcactattcacaatagcaaagacttggaaccaacccaaatgtccaacaatgatagactggattaagcaaatgtggcacatatacaccatggaatactatgcaaccataaaaaaggatgagttcatgtcctttgtagggacatggatgaagatggaaaccatcattctcagcaaactgttgcaaggacaaaaaaccaaacaccgcatgttctcactcacaggtgggaattgaacaatgagaacacatggagacaggaaggggaacatcacacactggggcctgttgtggggttgggggagggaggagggatagcattaggagatatacctaatgttaaatgagaagttaatgggtgcagcacaccagcatggcacatgtatacatatgtaacaaacctgcacgttgtgcacatgtaccctaaaatttaaagtataataaaaaaaatattgacatgtgtggattttcctttcattgtgttgttagctggttattatgcagacttgattgtgtggttgctttattgtatcagtggcctatatacataagtgtttttgtggtagctggtaatgatgtttcatttccatatttagcactcccttaagtgcctatgttaagccaggtctgttggtaatgaattcccttagcatttgcttgtctgaaaaggattttatttctccttcacttatgaagctgagtttggctggatatgaatttcttggatggaatttttttctttaagaatgctgaatataggccccaatctcttcaggcttgtagggtttcttttgaaaggcatgctgttagcttgatgggtttctgtttgtatatgtgatttgccctttatctctagctgcctttaatatttttttctttcatgtgagccttggagaatctgacaactgtgcgtcttggggatggtcgtcttgtatagtatcttgcagaaattctctacatctcctgaatttgaatgttcacctctctaatgaaacttgggaaatttttctggataatatcctcaaatatgttttccaagttgctttttctccccccctctcttccagggataccaatttgtcttacctgtggtctctttacataatccaatatttcttggaggatttactcattttttaaacttttggctgactgaattagttcagaaaccagccttcaagctctgagattctctcctcagcttggtctattctgctgttaaaaaaaagtgcgattattattatgaaattcttgtactgtttgtcagctctatcagatcagtttgtttctttcttataatggccatttcatctttcagctcttatataattttattgtaatccttggattccttggattgggtttcaactttctcctgaattgtgatgatcttcattctcatccatattctgaattctctgtctgtcatttcagccatttcagcctggttaagaacacttgctggggaactagtgcagttgtttggagaaaaagacactctggctttttgacttgccagagtttttgtactagttctttcttatctctgtgtgctgatgttcctttcacagttacaatttgagtacattcagttgcctcttttctggatgttttcaaagggctgaggctttgtgcaggatctttatttgcagctgatttcttgtccttgtttttatgggggtgggggttatgttagcaagtatttttggtgttgaagtttgggctgtgatccagtaaatggtgcttaagtataatggtaagttcttgctcaaccacgtggctcctctgtatttcctctcgatttcagctgtgctccctcttagtgctctgaaagtgtagtttcttctcccagtcaatttctggctgcagatcttggattggcactcccagggtgcacactgcagctctggggtgagctcaggctttgtgtgtcctctccaacttggaggcagcagagggagggaccttggcagtggctgtagcagagagccattcacttgtctcttggggctccagcccagagaaatacggagctgctaccagttggtgtgattggcccagagttgggcagctgtgttatgggcccaagctggggtgggggcggggcttgcttggtgatgagcagggagcattggaggctcataggtgagctagactggcctcttctctttaagatggctgtggtttctggaggtgtaggtaaagcacttagggtctttgttccttccttagtccaagggcagcaagggaagtaccactgcagtggcagtggcagaggggctttcggttttgtctaggagctccaccacagagaatcacagacccgttgctaatgggaatgtttaatcggggcttgtggtgactgcactactggccctgcttggtgaagcgcagggggtcaaggcctcatggggaggagagactgggctcctctccttatggcggttttggtgctgggagtgcaggtgaagccctcaggttctttgttccttccccaatgcaagggcagcaagggcaggaccagtgcactggcggtggcagagggtctgttggttgcctctgggagcccctcccagggaaacttagagccactagcagtggaaatgctcagctgggggtggggtgtctgctctgcaattccagctgaagggtccttcctggggaagaatacagggtgggagctcacagagaagagacattgggtttctctccgtatggtggctgggtgtgctagggatgtcagcatagcaaccaggccctttgttccttccccaatgcagtaagggtggtacccatcgcagctgtaatggcagaggggctatgggttgtctctggggatttcctccccaaagaaacacagagctgccaccaactgacatgttcaggccagggcagggcggttgtgctaggcgcccaggtggagagatcctgcccattgaggggtagcagggtggggacctgtgtggaaaactggccgcttttctgtaaggcagctctgccttagtgcctgatcactgcgttccttcccaagccggagagccacaggagcgagggcttcagagcagcaaaagtagtagcttgcctgttacctccgggagatcccttccaagaaagtgcagagctgctaccgcggagagccctagcagggagtggccaaggtcgcagatctagaggccctgcccagtgaggagtagcaggggcgggggacggcattgaaaacaggccgcttttccgggtaaggtggctgcgctgtgctgggggtctatgatagtccctaatcactgtgctccctccccagcctgagggcagcaagagcgagggcttccgagcggcagaaatggcggcctgcctgcgacccgagagctcaggcagggctgcgatggccgcagtagagtcccaggccagtgggccatgtctggcgaggtgcagtggaggtgaggcgtgcactccatctgctgctcagccctgtggatttgcccccatcctggtgggcctgtgcgggagcctgacctctcttgttgccagagatgcagctgccggtgtccggtaccaggggatccatggctcccgggacccagggttgcaaaggtccatggcagaagtgtgggtccccagggactctcactgactcactcaccgtttcctggctgtggggggcctcccctggctcttcgcctctccccggtgggcagttgtcctgtctcactcttctcacttctgtgtggattgtattgcttccttgatgaaagtgtccacttggataatccagttgaagagctaatgtttactcactactctcttctctctctgagagcaatgcgcactagctgcttctagtcagccatcttggctggaatcccggttttgaatttcattttgggaaatgatttgatttcgcacatttgtgtatgtgtgagagagagaggggagagcgtatcaatacgtgcgcgcatgtgagtgcaagagaccatttcacttgttggcatttaacggtgtttgctgctactcccagtttctcaactcttccaccacaatgcccctcatactctaataggttatgcacaaagagtgcctcctttgtaatacctatattataaagcctctggagaaacttcattatttgcattttgcaggtgtgggaactaaattacgatatgtttaaataatttgcccagggactgccagatataaagtagaagagctgattttcacacatctgtctccctcagtaccaagttgtgccgtttccacttaagctgtgtgctctgctggattcatgtgcatttccttcagtctcataagctgcttgtaagatgaaaattcactgacttgtgcactgattgttcagatggagaaagccgaataaagttggagcagttggcacttaactgttatctgggcagtgctaagtgctggagttttggtatttaagagacataggctgagccctatggagcttgtaatatagataccatactggaagtaattttttccttatactcagtattttctgttagcttttgctgcataacaaagtacccgaaaacctagaggctgaattgttctggtctgtcagctcagctgatctctactggatttgcttttgcatcagtggttaatcaaagggttgattggaggctagtgatctaagttggccttgttgacatggctggtgattggtaggctgttggttggggtggtaagggaagctgggccatgtatttagaaactagcctaggcattttcacgtggcaactaaatcctaagaacacaagaggaccagcctcaaggcacaagtgcttctcaagcttctgtttgggtcttgtttgctaatgtcccccctgctggccgagcaagtcagatggccaagtccagaatcatcagaatcattttaagagggtgtacaaaagggcatagacacaagtaggggaacattttgttgccattgttgcacccttctcctgtcaggaactatcaaaattctgagatttttaccctacttgcaagctaactagttaggctaccacactgttatagatgctggtagaagacataagactcctaatcagaaacaaaggagtttatcctcataatggcagtagtaatcaagtctcagcatttttgcacctcttttctgagccccaattcccacaggatgacatgaagagggccagcttgtgagtgagttgtgttatgggagaatatcattgaggttagggaaccggagtcttttataatgagtagcaaacatgtctaccctttgctctggagagagacattattattctggacagtaagcatgctaccctttgctctacatagagatactgtatcttccaggattgtaaacaaacctaccccttgctctggagggagatactactctgtcttccaaggctgtttgctatagaaacatccttgaaaagaaagttcagaacaaaaaacagttgtctcattcacaatatatgccaaaatgcaagaaactcatggagaattgtctcccaacagtcacatgccctaaactagaatatttgttttccttgtgtcttatactctatcaaactgaaacatctggaaagagtatcctgtcttagtaatttgtgcctctcacaatactcataatgttgcctcatgtttcataaaggctcaataaatatttattaagggaatgaagaaatgttttctaatattttatagttccatttatatttcaattcttaatatccggaaaataaaactatacaaattatttatgttttttttccttttagtgtgatatgttcaagttaattaagtactttggtataaactagatttttgtgctctgtactctgatatttggcagtttattttgaagctcaagtaattgttgttctgattcagggaaggtgggactgcaagagtaagaaggccgaagctttgatggatcttttcctttatattggtctgtgagttaatatcagcttttcttgtttaaaatatgattaatgaatgattagttgcgtgcaaagtactatgagttcctgtgatcatcaccattttaaaagaaagtgaaaaaacacatttttcagccagataataatgctttaaaaaataacaaaaatgttaggcttaatttaagcagtgtgagcacagcatagcattagccagatgctgtaacagtcagaccaggacttctttcatcaaagtgcaaagtagttgtggaaagaagaaagggatgagcttatgagtcagatttgagtttgaatctagcagcagggacctaatctgtctgttctgttcaccattgtttcccacactacctggcaaatagtaggcactattttaataaatgtttgtggggttactcatcttcttcactatccattctatgaacatagccaaatcccgttacttctgtgaacctatgttttttcatctatacattgataatcaccaagcatagttctctggatgggttgatacagagacttaagtgagatatggtatataaagctccaagcatagtacctgacactcaataaatgtgagctgtttcacttcttggactaacttgaaattcctggtcatgttctgcctaggtgttacggtgaaggaagttcagttaattgttaggctcagctactgcaggttcactcactttttgatgggtcagaataactttttaatttcatcctttcccaacttttcatttcctgactctgtcaccaccttccctcttgcttagagcattccagtagccatttaacttttctcctcctctggctgttctttttcaaaccattgtgcagatgactccatgactaactttcccttcctgctaaggtattcctgagcccctcacttcctgcctaccaggctccaggagtggcttcacactgtctcatcatcattcaccctcccctttgttcccttgtctgtttatccagtgttgtagccacactattctccaaacacattctttccacctcagggcctttgcacttctcagctttgctagtgaccattctttccacctgtaacttcctgttcagctcttagtctaccctgtccatcttccaaggtttctcacaaccaacaaatatgatgtctctcatgaagccctatcctgatcaccctctgccaccgcgttaagttcatatgtaaggttccccttttttgaaatcttaatactttcagcttgtcaccttccaggaattaaagattatgtactatgtgtggcagcccccttaccagtaacatctcagagagattgtgaccaactaaacactagtgaagtccaccaaactactgttgaacactattaagtgaggaagtattgaaacagagatagcaagagaaatgaggggcctcgagtggtggggacaagtcagcctcttctccctgcttccttggaagcccctctgacagtgggtacacataagttacagggcccagcgtgggcagccctgggctgcgggccactctgtaggttctggaagctgttgtctaacatttgctatctccagcttaaatctccatgaacgcctacagtttctggccagggaaacagatgtcttgactgtctaacataacttcgtatatgtgttggtaaagtgattcaaatatgacattttggaaaattaaatatttgagcatctttttccgttagaggctgggcgtgctcctgcctatgtaatttttagaattgagaaaagggcataaatcccatgattaaaacaacaacaacaacaacaatctgtgtttcatgtattttataatcctactttctagttgctatttgattaaaattacataaaagactataaatgagtataatatgtaattagaaataaataggtttttaaaaattcaataaataagtatttgttacatacctaccattttctagacactgaatgaattcgtagtctggcaggagttagaaacaagtgaccaaatgactgcaatataatgtaattggtataccagttttggcgtggtattttgggctctaaccttatttttatcccttttcctctcttcaacattctcaagcaataacaataataactaattaatattaaataataattaattgagcacttactgttctcaggcaactattctaaatgttttatgtgtatcaaactcatttaatcctctagagaaacttgtaagatgggtattactgtcatctctattttaaaaataaagaacaggaagcccaaattttaataattcacattaggggcatgaaaagtggttaagtaagagctgatgatggcctgaagtaagcaaggagcagatggctggagagaagagggtaagtttgaggaatgggttgggaggtaggtaaacaggacattgtgatggatggcgatggggaggaaagacaagagtgagtgtggttgagggtcagggagcatgggagcaaagggatgttcatgctgaccaaaggcttgaggtctggagagtgttgggaaaagagcaggcacaagacatttggaaagaagctgtaccattgagcaagcaaatgaggaaggctatgtgtatgaagatgtctgtcctccttgaggctggagccagtgtcttttcctttctgatgtttgtaccctagaacccacagtgcctggcccacatagaccatcttcattctccctgttgctatctgattggaatagtttcttgctgtgtcatgtgggtgggccctcccaaacccctctccagaatttatcccctaaaacacccacatatgtatgcattggttaagacattagtttgtcttatttcctcagaaagtgtcctataaagacttgaaggtggccaggcatggtggctcgtaaatgtaatcccagccctttggaaggcccaatggggagaattgcctgagctcaggagtttgagaccagcttggacagcatagtgagaccctgtctctataaaaaaaaattagctgggtgtagtggcatgcacctgcagtctcagtttcttgagaggcttagcaggaggatcgcttgagcccaggtggaggctgtagtgagccatgattacaccattgcacaggagtgcacaaaatacatgaacagtcatgccaacaacaacaaaaaaaaccatacaagagatcctcctgcttaagcctctcaagtagctgagactacaaaacatacaaacaaccatacaaaccataaaaaacgtacaaaccaaccaaccaaaaacagcttgaaggtaacagtactgctgattttaaaatatgtaaatggaatcaatgttggattcatgttgtttcctatttggttgctttgtagactcttcattaccatttctgcttctcagaaatcacatgtagtgacacgtggtgtttattacataaaggataaatggcagcataacattgacagtaatttttgcttccagcccccaagactgtagccttctgccttattcctagcctgctcctcaacctccattgagtctgtaaacctccagtatacttccagtaaattatccttttgcttaaaaactaaaattaaaaataaatatactttgtaaactgtcaaatactatatgaatattaaaagccttttagtagtcagtttcagtctttcattcagtcatccacgccacagctttcttctgggcacatactaagcagtccctgggctcgatgctgtaattagaatctgctcgtttgatctgcaggaatattgtcacattctgattaaaacagttctcaaaaattaaattttaacttggaacaacatacactaaatctctttttcagaaaaaaaattaataaaaataatagtaaaataaccccaagtcctttaatacatatagtgattatttttagtttagcttttttatggttactgtaagcatataaatatttactactgtcctaaatagcaaagcattaccctgcagttgtctaattggtgcatgaatgtcactaaaattaaatatcatgatgttcaatattttccttagtcaattttacactatcctgccctgtgattaattactttgcttgaggccaagcaagtactactgagtcctgtgataagtggatgtttatgccaaaaacaacagcattgctaattcttgcatatttgcacatgttaagttcttttctttctctgccacctgtatttcatgtgttgatcacagaggcaccagagtatcattcttacagtatttgaattatgcattacatggtaaactgatcgttattttccatcaaatgaatactttggcttacacttaattttataaaatctgtttatagaaatcattaataactagaacaacgttagttagaaattgaagaatatggctaaagaatttattaccttggaagatattatgaagatcctaagaagaaaaaaaatttaaggaggcatctaataggcagattaacaaggctgtggggaagtgatacaaatgtatattgctttcaaaaagtatatttcccttgggcatggatactcatgcctgtaatctcaacactttaggaggctgaggcagaaggatcatttgagcccaggagttcaagaccagcctatgcgacatagggacaccccatctctacaaaaaattagaaaattagctgggcatggtcacacgtgcctgtagtcctcgctccttgggaggctaaggtgggagggtcatttgagcctgggaagtcgaggctgcagtgaggcatgattgtgccacagcactccagcctgattgacagagtaagactctgtctcaacaacaacaacaacaaagagttaatttccgtttttgtttgaattttgatatcaaaaacatcaataaaataatttatttccagattgtactcatctgttttcaccatatttgatggaattttgaagtgaacaattcctgacagtataaaaaggtaaaaatccaggtattaggaccattttttccctgctattttctttttctgatgacaactttatttttctctgtgaagctataatttgcctctgatatttttattttaaatgtttttcaaactttgaattttaattttttagattctagttagtattaatattttatcttatttgatatttttattacagtagctattggtacttcctgaataaatgtgcttctttattatggttcttaatgtggtaagaacagataaaccacatgcacgtaattcaccattatctcaatttcatagacatttaccgagcgtctactacatgcaaaaaagtttgtgccggatgttgcaagggctcctaaaacatcaccactacagcttctgcatagagatgattgttgacacttcaggaatagagactacatggggagggaaagagagcaggaaaagaatgtctgtgatcagaacctaaaggatgcttttacttgggtggtagaaaaagaatgcaaagatggccaatgggacaaagaaggaaaagtcaaagataaaaacataagcaaagtgtacattttaatcaaagccagaaaaggaaagggtttcaggaggttgacatattctgcagaagactgaggaggactcaggaaaattcaacaaagtggtactattagagagttgggaaaggaaggctaactctaagggtgttatataaaactattaattgatgctactcaaagtgtggtccatggataagtgccagtctgcaaagtgcctgttaactatgcatgctgatgagctacaggatgtaaatgaactacattgttacacactgtgtcagttcaatgggcattttttgacaggaagtctttcttgaggaagcatgtagtaagttcatttgtgtgctggtaaccggatttctgatcttgtcccagatgtttaaggagcagttcacagacagactactttgaggagcactgatagaaatacaatacaatgtagacaaacatgatttcatttttagataaaatttatgatttccttgtgaggtaataaatatgattataatttctattgaaaatacttgtgccattttctagacatcaaataaaacttgcaagaatgggtatctttctaataattcctgtcactattactttggggtacattttaatttttattctaattactcaaaaacattctctaaaaaatactgcacataatttccaaaatgtgaagcaacgaagatgttactcagtaggtgaataggtaaactatgctatattcataaaatggaatattagtctgtaataaaaagaaatgagctatcaagccatgaaaatgcatgggtgaaacttgaatttatattacaaagtgaatgaagccagtctaaaaagactatctattctatgaatccaactatatgacattctggaaaaggcaaaactatggagacaataaaaggtcagtgtttggcagagacttgagagaaggagggataatagatggagcacaggggatttttaaagcagtgaaactattctatatgatactgtaatggtagatacaaataatcatacatttataaaaacccatagaatatacaacaccaggagtgaaccctaacgtaaactttggatttggtgaataatgatgtgtaaatgttggttcagcaattttaccatactggtggggcatgttgatggagtaggctgtgcttgtggagggggaaggagctatgtggaactctctatactttctactcagttttactggtgaacctaaaactggtctaaaacatacattttattaattaaatttttaaattaaaaaaattttgtaggtacctcacaactgtctcataattgttttattgttttcgagaaaggtggccttccaatgaaggttttgtgttttgttttggtttgtttttttgtttgtttgtttgtttgagacagggtctttatcactcagactgaagtgcagtggcacaatcatggctcaccaaagcctcaatctcccagacctgagtgatcctcacacctcagcctcacgagtagttgagaccacaggcatgtgccaccacacttggctaatttttcttatatttttgtagagacagggtctccctatattgcccaatactgaactattaggttgtaaaaacaaaatgtattcctttgaagaacagataatagtcatggtctattaggtcttagtgtcaaagttgagtgattctaagataatgaaagcagatatttttagatggagagtagcactctgaagatgatctgcctggctcttttgttaaaggttgttgccgttcatctagacgtatgtatatgcctaagaagagcgttatactgatgctgttacaaaagagagaaatcagacactgattgagtgtgagttctccaaagaaacataactaagaggaatagatagatagatagataactctactgtaaagaactggcttacatgattatggaacctgagaagtccttggatctacagttggtaagctggaaacccaggagagctggttgtatgcttctagtccaagtctgaaggcctgaactaggagaggtgttggtgtaagttccagtctgagtataagtccaaaggtaggataagaacaatgttcctgctcaaagacagcccggcagagagaaggaattcttttttcacttagccttttattctctccaggtcttcaaccagttggatgaagcccactcacattagagaaagcaatttgctttactcattctaccaattccttgacttgcttctgggaatccctagttgactaataattttactttaaaatatttcaagaaaaaagcataatttaaaaatataacgaatatagcttaagagcaaaaacaaatatttttcaaactctatgaagaacccatatttttgtttatttattattttttgcacttttagggtcagggtacatgtgcaggtttgttatataggtaaattgtgcgtcataggagtttggtgtacagattatttcattactcaggtcctaagcgtagtacgctataggtgtatttttatcctcaccctcctccaaccctccactctcaagtaggccccactgtctattgttcccttctttgtgtccatgtgtactcagtgtttagctcccacttataagtgagatcacgcagtatttggttttctgttcctgcgttagttcacttacagtagtgacctccagctccatccatgtttctgcaaaggacatgatttctttcatttttatggttacacaaaaaagaatagtacatatgtagtacatattccatggtgaatatgtactacatttcctttatttagtctactgttaatgggcatttaggttgatttcatgtctttgctatcgtaaataatgctgcactgaacatgcatgtgtctttatggtagaaaatatatatattcctatattcctttgggtatgtacccaataatgtgattgcgggtcaaatggtagttctaagttctttgagaaatcgccaaagttctgtccacaatggctaaactaatttacattcctaccagcagtgtataagtattcccttttctctgtaaccttgccagcatctgttattttctgactttttaataatagccattctgactggtataagatggtacctcatcatggttttgatttccatttctcaaatgattaatgatgatgaacattttttcatatgcttgttagcagtatgtatgtcttcttttagaaagtgtctgttcatgtccttttcccactttttaatggggttatttgttttttgcttgttaatttaagttccctatagattctggatagtagacctttgttggatatatagtttataaaaattttctcccattctctatagtgcctgtttactctgttgatagtttcttttgctatgcagaagctatttagtttaattagtcatttataaatttttggttttgttgcaattgctttcggcatctttgtcatgaaatgtctgccagggcctatgtctgaaatggtatttcctagattatcttccaggatttttagagttttaggttttgcatttagctttaatccatcttgagttgattttttgtatatactgtaaggaaggggtctagtttcaaagttctgcatatggctagctagttataccagcaccattgattgaatagggagtctttttcccattgcttgtttttgttgactttaacaaagatcagatggttgtaggtatgtggctttatttctggttctctattctgttccgttggtctatgtctctgcttttgtaccaatatcatgctgttttggttactgtagtctggtagtatagtttgaagttagttaatgtgaggcttcctgctttgttcttttttctttaagtattcaagctctcttttggttctgtatgaattttaaaatagttatttctaattctgtgaagaatgctattggttgttttataggaatagcactgaatttatatgttgctttgggaagtatggccatttaacaatattgattcttcctattcatgagtatggaatgtttttccatttgtttgtattatctctgatttctttgagcagtgttttgtaaatcttgtagagatctttcacctccctggttggttatattccaggtattttattctttttatggccatcgtgaatgtgactgagttcttgatttggctttcagcttggacgttgttggtgtatagaaatgctactgatttttgtacactgattttgtattctgaagctttgctgaggttgtttatcagatgtcagaacttttgggcagaggctatgtgaggttttctaagtatatagtcacatcatcagcaaacagggatagtttgattcctgtcttcctatttggatgcctttcatttctttctatttcctgattgttctggctaggacttccagtgctgtgttgaataggagtggtgagagtgggcattcttgtcttgttcccgttctcaaggggaatgcttccagcgtttgcctatttagtatgtttgctgagggtttgttgtagatggctgttattattttgggatatgttccttcagtgcctagtttattgagttttttttaacatgaagggatatttaattttatcaaaagccttttctgcatctattaggagaatcataaggttttggttttagttttgtttatgtgatgagtcacaataattgatttgcatatggtgaaccaaccttgcttcccaaggaaaaagcctatttgatcgtagtgcattagctttttgatgtgctgctgggtctggtttattagtattttgttgtggatttttgcatctatgttcatcaaggctattggcctgaagttttctttcttttttttttgttatgggtctgctaggttttggtatcaggatgatgctgctctcatagaatgatttagggaagagtacatcctccccaatgtttttgaatagttttagtgggaatggtatcagcacttttttgtacacctggtagaatttgactgtgaatctgtctggtcctgggctttttctggttggtaggctttttattactgatttaattttggaactcattttgtctgttcaggatttcaatttcttcctggttcagtcttggaagattgtatgtttctaggaatttattcatttcctctaggttttctagtttttgtgcctagaggtgttcataatagtctctgagggtattttgcatatctgtggggtcagtggtaatgtctcctttgtcatttctgtttgtgtttttttagatcttctctctttttttctttattaatctaggtagtggtctatctctcttatttattctttcaaaaagcaaacttctgaatttgttgaacttttgtatggtttttcacatctcaatttcattcgattcagctctgattttggttatttcttgtcttctgctagctttgggagttggttgctgttcttttcctatttcttctaggtgtgatgttaggttgttaatttgagatatttctaactttttgatgtgggcatttattactataaacattcttcttcagtctgctttagctgtgtcccagagattctggcatgtggtgaattgattctcattagtttcaaataatttcttgatttatgccttaatttcactgtttacccaagtcattctgtaacagattgtttaatttccatataattgtgtggttttgagagattttcttagtattaatgtcttttctatcagactgtgctctgagaatgtggttggtatattttcagttttttattttttttaattttctgaggattgttttctggctaaatgtgtgcttgattttagagtatgtggtatgtgcagaagagaagaatgtatagtatgtacagaagagaagaatgtatatgctcttgttttggggcatcaagttcagtagatgtctgttagttccatttggtcaagtgctgagtataggtcctgaatatctttgttagttttttccctcaatgatctaatactatcagtggagtgtttaagcctctcattattattgttcagttatctaggtctcttcataggtctgtaagaacttgctttatgaagctgggtgcccttctattaggtgcatacatatttaggatagttaggtcttttcattgagtgagtccttcaccattaggtaatgctcttctttgtctttttaaattgttgttgttgatttatagtcttttttgcctgatactagaatagaaagctctgctcttttctgttttctgtttgcttggcagatttttctccatttctttactttgagcctatcggggttattgcatgtgagatgggcctcttgaagcgagcatacagttgggtcttgcttctttatccaagttgacattctgtgccttttatttgggcatttatactgtttacatttaaggttaatattgatatgtgtgggtttgatcctgtcatcgtgttgttagctggttactatgcagacttgattgtgtagttgctctatatacttaaatgtgtttttgtggtgaccagtaatggtctttgtttccatggttagcactcttttaaggacttcttgtaaggcagatcttgtggtaatgaattcctgtaccatttgcttgtctgaaaaggatcttatttctcctttgcttatgaaacttagtttggttaggtatgacattctttgttggattttttttctttaagaatgctgaatataggcccccaaactcttctgcttatagggtttctggtgaaaggtccactgttagcttgatggtgatctctttttaggtgaccaaccccttctctctagatgcttttaagagtttttctttcatatctaccttatggaatctgaggactatgtgtcttggggatggtcatctcatatagtgtctcacaggggttctccacatttcccaaattttagtgttggcctctttagcaaggttggggaaattttcatgaaagatatctttaaatatgttttctaagttgcttgtttttttctctctctcttttagggatgctaatgaattgtagatttggtctctttacattatcccatatttcttggaggttttgctcattcttttttactcatttttatttatttttgtctgactgaaatattttggagaggtagtcttcgagttctgagactctttctttggcttcatcatttctgccgttagtacttaggattgtattatgtaatccttaaagtgagcttttcagctttaccagatcatttcttaaagtggccatttcatcttttcgctcctgtttcattttattgtacttcttatatctcttggattgggttttgattttctcttgaatatggatgatctttgttcctatccatattttgaattctatgtgtcatttgagccatttcagcctggttaagaaccattgctgacaaactagcgtggctggttgaaggtaggaagaccctctggttttctgagttgccacagttcttgcactggttctttctcatgtgtatgggctgatgtttcttcagtcttcaggttgctgtcctttggatgaggttttttgctttttcatctttgatacccttgggagtttgattgtgctataaggtaggtacagtcaactggcctcatttgtggaagattttatgaggccaaggctcagctcagcactcctggactatgtgctctaactctggggggctggcagtggggccctagctttgttctctggcccctaaaggttaggaacctgctgcactggaggggccaaagtgttcccagtctgctgtccacaacaccccgatgagggctgcccactaaattacttcatcaaggtgttggcagtggaatttgtgctcgcttgcacatgccagcgattgcagcaatgctcagtgtgtatgtgaattgcctgggatgtgggaccagtggaagcagggcagtggcattcctgctgcacctcctcatgcaggtggttgtggtggtggtgacatgacagggtcagggcactgtggtaacaggttgtctggcatttgtgccagtggtggtggtatggggttgggtgtcagggtgtgctagcaccagcagagggaggttgtggtgggggaagaccgtggcagccctgtgtgtttcagccggttccagtgcactggaactctctgacagtcaggtgcagtctgccagcaaaggagctatggtaaagttttccaggaagcaccctgtttgggcatctgaggctgcactgcaagtgggtgcaaccagtctggagccctaggagaggccagaagacagggtagtgctcagatcagactagccccatctcacaaggaagaccaccctgctgtgtccaggtatgacagtcacccctaggctaatgtctcctagaggagcgtaggtgtccctggctgtgctccattgcagccactcccatgccaaaccctctgagctgtgcactggctggagtcctgctcctgccacctctcctggcagctctccctgccagggtaagtgtttgtggaggtcatggggtctcctgctgataggattctggagatccaaggtgagagcaggccataccttggctgttcatctcactccttccccaggagacgctggagcccaggaatgagtccctttgctcagcagccctgtgcagggttcctagcatcctttccctccagcctggcctctatgtcttccttccatccactcattgccttctctccaaagatctgctcagagagtatttcattcttccctatgtccctgtctcttgatgggagatgttcctcctggctgtgcttagccggccgtcttggctccccagccgcatttttataggataattaattagaagggcagtatagttttagactgagaccagtctaatttataacatctctgttcacatactttctggctgtgtatatccttgggcaagtggctttatatcattaagttttatattcttctccaattgtaaaagcaggtgagttgtcacttaatggggctaatgtagaaattaaataagataaatgtcagttgcaaaccaagggtctgaaacatactagatgttaaactgatggtttactagtattggtgatggtatctagttttcaagcacaatagagtggaattttggtttataaaccaaaattctgttaagaaacagtatttttaaggctattcagcagagacaatttttaccaatttcatctatattttaaatttaaatgtttcttttattttgaaataatttttcgcaaggctttgcttttcaaatgtaaatgtttaatcttttaaacacattggctctctgggcacctaaaactctcttcactatcgacactttaggatttactggccatgctgttgcttctgttttaatttgcaatagagcacttgtataaatgtactttgaaatgtttggaaagttgtgtatggactggaaaaatgcatgcgagatgttcctttgctttgtatattgtgaaagggaggatttgtacatgctttgttgttgttgttacatacgctagtttactgttttgaacataatttgtttactactttgaattccctatttgatggaagtgaaatgtgatcttgctggacagtagaaggaaagactgcctgtatttcatgctcatacctactaaagcatcagactgtttcatatttaagagcagtttaaaaagcacgtgagggtcttcttaatcttaattctagtgtcttaaaaaatgtatgtggagattatatgtttttgagacactataattaaggtcaagaagggaggtaatttgcattccccttgaaaaagctttgataccagctctggggactgaggggcattgtcagtgagagggccccacacagaggcttctatgtctccagcctgcagcctggagaactatgaagacttctgtttagcctcacacagaggaaggcagaataaacaaactgaaatggcccaaacaagctactgggtttttccctagacttagggtaaggaaaaggatcaggcactgatttgacaaaaaaaaaaaaaaaaaaaaaaaagtgagcatacagaaaaatatttataggacactctatgccatgctcctggttcactgcagattatcaatcagtggaaagtgatagaagcaatggaagcatcagcagaatgggtatagaggtaagacagcagttgcagcagcagtggtgcttggctctggtagggctggtggagcagggttgctgtattagaagagtcaggacttgttcatatgtctgtctctccctctcccccagatcatagctgaatacccagccctggactttgcagataataagtgtagcaaatattttttaaaacatttatcagcatcatttaaattattacaaaagtttataaattgaatcctatatagtgcattgttccccttaactatttctgattatatatcatcttgttattttagatattgaagaatttatccctcatgtttcctcaattttgtgtgtgtatgagtgaggaaccacaaaagtgttttcctaaaaaaatacttgctaatattctgctgtgtgttgtattttggtcctaatgttgaaaaacaaatatcctcaaatgacctcaaatcttgctacctagggaaggaaatagtggcttttgggaaatcaagaacttttgaatataaaaaagtacctagaagaataaaaggcacattcctttatgtatcttattaggctttctttttttcctaagtagtaaaacaatcattagtttcactgagtattttggacagcatattagaaatttgaagtaccaagtttactattctttactggagattgtccagcagaggaaagcaaataccagtggatgtgtggaagcattttctgatctttaacacgtacacctgctatacctaacagcctgctcagaagaaggttctatttctagatggtaaatgagagcttcccagtggaccattattttatcatgagtggtagtgggaggagggacagcgtttggacatgagggaattatcatgtatgccatcatatcattgctaggtcatttatctcttgtctagccaagttcacgttaaattctactaggttagcacttgaggtcatttaacaaaactgctgtttattaagaatgggagacatgttcttctttgaatcctgcaagaggtggttgctgaaaataataggaaccatatcttcatattttaggcaaaagtcacttttaagaagctttgtgataaatcacctagagaagccagtgaattatgccctaatggttggaatgagacaagttttctaatagtgatgacaattattaattactaatcacaagtatgtgtgtggtgggagtgaatctcaaagctataataaaaggaaatttgtgcctttttgcataatgaatgagaaaagtctctttaaaagagcaaagaaaactattaaattataaaattgttgaatttcttgtcacaacctttagaaactctataaactcatctaaaaccccaattcactgtagtgtgaaaaatagatacatattcagagtgatcatttatcttgaattaaaattaagcatccgagtcattacaaacttatctcctgcttatggacatgctgacataaaagtatttaaaacttctgagtagaaaaggatattaatgatgcaaggataggccagaaaatgaatacacttcttactaaggaaataatgattgttattcaagctgcaaaacctaaacatggaaaggaaggtaaactggcgtttattaaaaatctttctttatttgtttgctaacctcagtcctagttgtattcacatttgttactttgtttaatccccccaataatccttaaatgtagatattacaacaactttacagatgatgaattaaagtttgctaaacattgaattaatttgtaatcaatcacgtaactgctgaatgctagagtctaaaccctagcctaggcaaacatgcctccaaaccccctccattttccattataccaagctgtgtggaactgagtactccctgttcatgtctgccattagctattgagcattatggtaggcaaaataatagaccccctggccaaagatgtccatgtcctaatttctggagcctgtaataatgaagtgatggaccttgaggtggcaatactatcctggattatgtagctggacccaatgtaaccacaaagtcctaaagatagaagaaagagtcagcagagtcacagtcagaggagtcaggacagaagcagaggttggagtgatgtgattgttggctttgaaggaggagaccatgaaacaagtgacttctgtaagctggaaaagacaaggaaacaagttcttcctaaagcctccagaaggaatacagccctgctgacaccttgattttagcccagtgagacgcattttgggcttttgacttccagaactataaaatagatttgtgttgttttaaaccacgaagtttgtggtactatcacagtagcaaggaaactaatacaggcatcttaacagttgctagctgcagtgaatttttcataatttttgtgaattttcagatgtggctttgcttactatcatttctgtaatcctggtctcatagtgccacctgaaaatgttgagaaacgtaattcagtcataggtttcagatttgaagagcaattaaactatatatgagggttctcatataagaagtaattgggttcctttatttcaaagcagaatatcaaaagagagtcagaaggatttgacatgtttgatgtagaaaactttattattattgttattgttttggttgtggttatttttcactgcaccttcctcagcactctaagtccaaaagagccctttttcaaaatttcatctttttcttgttaataatagagatctctgtgcctctaaatggtgtttggtcagtgagttttgtaatcttaaatggcagaaatgtcatgacatgtaattttgtgagaaaaggatacttacccctcctagcctttacataagtgaaatatagtaaatgctcttaaaataattgtacattttcttgtgagaaataacattccttgtactttatgagaaaaatatgtgtaaagttgcacatcatagaagatgcagattttaatatccagtgtatttcagcagtttggtatcagaaaagtgcactgagctagtgttaaataactttttattagaatgtcctctctattgttaagttgccacattatatgaggaaactcacttcagtttttgtgccttggtttcgttgttgtaaaatggagagaatggtacctgttttgttattccatttaaaaaatcacttgatataatataagtggcagtgcttagaaaggaataaaaatagttacaccaatgctaggtggtgtttttgtttttactaagaaagtccctgaagtcaccctgctctccccaccacatacatacacagacacacacatacacacatgtacacgtgtcaggtctaacaatgaaatacccagttaaggcattttgattccatgaaaggataaaataacatttagtaaacagcctaagtattaattaaaaagttattcaatcttttgatataagttccacaaataccttcaatcagaatttatattaatttttcagtgttcccagagctgaaatgattatcacctactaaggcaaaggaagaaaacagcgtattatgggagtcaagccaactttgcaacttgctgtgacttattatattgggttatttcccctgttgccacaaacaatatttgtcaaaagggataaatgctcattttataaatttgttgtcctaaagtttaaactgaaaaattaacataagtgcagtggtctctgaagtaggggtttgtgcacccctgagggtgcaggggaaggaaattttctctctgtatatgtttcttttttggccgggcgccgtggctcacgcttgtaaccccaccactttgggaggccgtggcgggcggatcacgaggtcaggagatcaagaccacggtgaaaccccgtctctactaaaaatacaaaaaattagccgggcgttgtggtgggcgcctgtagtcgcagctactcggagaggctgaggcaggagaatggcgtgaacccgggaggcggagcttgcagtgagccgaaatcgcgccactgcactccaacctgggtgacagagcgagactccgtctcaaaaaaaaaaaaaaaagtttcttttttcgtatctgtaaattattatttgcaactttatttctgctttgggtttgttttatagtatatataacaaattggtatatagtatgtctatataatttataatttataaatatgtaaatattagggctactactcaacagtatggtgatggtgtttgcacagtgaaaaaatgtttcaagaatactacaatagtgaaacagtacacagaatttaaatatgacttcataggcactactactgaagtttagagaaaaagaattcattgacccatttgacaaattctgattgtctactataagccagataatctgcattttgtcactgtccatgcaacagttctctgaggcaggtatcttcattttgtgttcatgaaaactgaggcttagggaagtaaagtaacccagctaaggtcatgtaactcataaaggatgcagccaagtctcaaatccttatctgttggacttcaaaggtcaaattcccaaccccattctcacctgcctcctactctgctgaatagcttagtatgagagcaaaggttgtgatatggttaggctctgtgtccccacccaaatctcatctcgaattttaatccccataatccccatttgtcaggggaaggacctggtgggaggtgattgaatcatggcggtggtttcccccatggtgttctcattgtagtgagggagttctcaggagatctgatggttttatatggggctctttttccttcactccctttttctctcccctgctgccttctgaagaaggtccttgcttgccccttgccttctgccatgattgtaagtttcctgaggcctccctagccatgtgcaactgtgagtcaattaaacctcctttctttataaatcacccagtcttgggtatttattgcagtgtgagaatggaccagtacaggaaattgatactgcagagagtagggtactgctataaagatacttgaaaatatggaagcaactttggataacaggcagaggttggaacagtttggagggctcagaagaagacaggaagatgtgggaaagtttgaagctccctagagacttgttgaatggactttaccaaaatgctgatatgatgtagacagtgaagtccaggctaaggtggtctcagatggaaatgaggaacttcttgggaactggagcaaaggtcactattgctatgctttagcaaagagactgtcggcattttgcccctgccctagagacctgtggaactctgaatgtgagagagatgatgtgaaattggaacctatgtttaaaagggaaggagagcataaaagtttggaaaatttgcagcctgatgatgcaatagaaaaggaaaacccattttctggggagacgttcaagctgcctgcagaaatttgcataagtaacaaggagcagaatgttaattgccaagaccatggggaaaatgtccccagggcatgtcagagatcttggtggcagcccctcccatcagaggcatggaggcctaggaggaaaatatggtttcatgggtcggcccgtcactatgtgcagccttgggacttggtcccctgcatctcagccatggctaaaagggaccaaggtacagctcagaccattgcttcagagggcacaagctccaagccttggaggcttccatgtgatgttggggctgtgggtgcacagaagtcaagaattgagtcttgggaacctcctcctagatttagaggatgtatggaaatacctgcatgtccaggcagaaatttgctgcagggttggagccctcatggagaacctctgctagggcaatgcagaagggaaatgtggggtcggagcccccacacagagtccccactggggcactgcctagtggagctgtgagaagagggccaccatcctccagaccccagaatggcagctccactgacagcttgcactgtgtgcctcggaaagctgaagacattcaatgcaagcccatgaaagcagagagggggactgtaccctgcgaagccacaggggtggctgcccaaggctatgggagcccacctcttgcatcagtgtgccttagatgtgagacatggcgtcaaaggagatcattttggaactttaaggtttaatgactgccttgttggatttcagacttgcatggaactgtagctcctttattttggccaatttctcacttttggaacgagtgtatttacccaatgcttgtacacccattttatctaggaagtaactaacttgcttttgattttacaggcttataggtggaagggactttccttgtcttagatgagactttggatttggacttttgagttaatgttggattgagttaagactttgggggattgttggaagggaatgattgtgttttgaagtgtgaggacgagatttgggaggggccaggggcagaattatatggtttgggctgtgtccccagccaaatctcatctcgaattgcaatccccataatcctgggagggacctggtgtgagatggttggatcctgcggttggtttaccccatgatgttctcatgataatgagtgagttctcacaagaactgatggttttataagaggccctatccccttcactctcttctgtctcctgctgccatgtgaagaagtccttgcttcccctttgccttccaccattattgtaagtttcctgaagcctccccagccatgtggaactgtgagtcaattaaacctcttcctttataaattacccagtctcaggtatttctttatagcagtgtgaaaatggactaaatacaggttggaaatgttaactggtttttaaagtcagtatgactggaatttggtgagtaaattagcatgacgttttatagatgttaatttcaaaaagaaaaaagaaaaaaaatcctggacacatctggatgagttatcccatgccatgtccttgagatttaggagattaataagcagagccaagctggtgcatctaaaagatttgacttgaactcagagacagatagcatagctaatttcagctggaagcttcttaatctccagggttcttacccaatgttttggctaccatagggaatgccctcatcattgggagagttgctgcccttctctaactatagtttgaggtttgctggtagcattccattctggagagggactgatggaacagataatgccaaatacagaacaaaggtgaggagtcaggcaagggttaggtggaaaaaaggatggaagacagagaaataaatggtaccatgcaaaggagccagggtcttctaatcttgaagttgtgatagacaagccagactattctggaaattatagaaacaagagtgtggcagagatggccagccaatttaggtttctcttttggggatatggcttggaaattcttctcagccagtgacttcactttccagtcccacttgtatctaggtggggccatatgactagcccttgccaggagggtatgactagaaggacacaatggttatgaaacagaggtacctgttccacagtctctctttctcatctacaagccagatggaatggcagcagaggacctagaggaatgcagagccccgtgatggaaggaacctgggccccaagtgatcatgtggatgatggcttaactaggaatacacacactatgctgtgtcatgagtgagtgaagtcactgggaatttgggttttatctattataaaactgcctaagattttaatgccacattaccttagttaatacaaaatcattaacagactcaacaagtggatgaaactaggacagtgtggaaactagttattgatgcagtcaaaaagagtacagtaagtataattaatattgaatcgaaacttttttcaatgctacatacttctaaggagaaaaaaagaaacagagaaagcatggaatgtaaaaacacaacagaagatgacagatattagaccaaatattttagtaatcacaaaatatgtgaactgatcaaaggcatctgttgaaagatacaaactaagatttattaaaaatatcaatttggccaggcacggacaccaaggcaggcggatcgcctgaggtcagtagtttgagaccagcctggccaacatggtgaaaccctgtctctacttaaaaaaaaaaaaaaaaaattatctgggcgtgttggcgcactcctgtgatcccagctgctcaggaggctgaggcaggagaataggagaatcgcctgaaccagggaggcagaggttgcagcgagccgagatcacaccactgtgctccagcctggacgacagagcaagactcagtctcaaaaaaaaaaaaaaatcaatccaagtatatttattaataaagaaatgtacctcagaaaaaatattagtcagatgctaacaaaaacatatgtgtaacaatattaatatgctataaagtagaattcaagatgaacagaattggaagggagaaaaagtagaaattctatgctggccaaagtaacaatctatcagatgacagttatgaacctatattcacttaacaaaccttcaaaatatgttaggaaaatgatagaatcataaggagaaattaacaaattctcaatcagttggagatttttaacattcttctctctgaaactgacagatcatatagatttttttaaatgtagacggaagatatggatagtacacattctcagcacacatgaaacaattacaaaaatgatagttaagtaggttgttctgatcaagtacataattggacataaaggactcattaaaatcagaaatctgtaacaaaattgataatctagcctcctcctatcatatacttgcaattgtaaaaaatactcttaaaagtctatgagataaaaggaaaacaaatatagaaattacaaaatatttaaaactgaataccagaaaaaagcagcgttcttaatatggacttgaagaagtatagttatagcctttttgcaatttgcgttccttgggaagtagactctgagacagagattagtgtgaagagcccttggacccaataactgcagaagggaggtaaagaaggcaggaaggagaagttggtcttcaatgcaagcccaacgacagcctcagtggactccacagggaacacaggagctaaaatgtttttcagagttggccagtgtgattaggacttatattcttgcaaagattagtcactggatgtgggccaccccggtaaggtgtgggacttcgggtgaagcactcacagtagctgagtcaatccctgaaaaggctggcaggtgaagtcggtctgcccacagttctctcagcagctaggaatgaagaattcttcattaaagagggatctgagtggcacatcagtgtcctctccaaaccttggtgcatttatttaaaaataggagacatccaaaataagagctatgctttcaaccgtaataaaataattggaagtaaataagcataaaagcagacattcatgaaacagcaaaaaaatttttatactattttctttttttgagacggagtctccctctgtcgccaggctggagtgcagtggcgcgatcttggctcactgcaatctctgcctcccgggttcaagccattctcctacctcagcctcccaagtagctggaactacaggcgcccatcaccactcccggcgaattttttttttttttttttgagacagagtcttgctctgtcgcccaggctagagtgcagcaatcttggctcactgcaacctctgcctcctgggttcaagcaattctcctgcctcagcctgccaagtaactgggattataggtgccagccaccgtgccaggctgatttttgtatttttagtagagacagggtttcaccgtgttggccaggctggtctcaaactcctgacctcatgatccacccgcttcggcctcccaaagtgctgggattacaggcgtgagccactgcacccagcctatactattttttaaaaatacaaattatttagataaactttgaccaaattattcaagaatttcaaaaaaagaaatacaatataaaaaatgaaaaaaggtgttatctagagatgaaaataatgattaccagaaatactatagaaactctatgccaataaacttcaaaatcttggtaacaagtttatagaaaaatgtaattatcaaaagtgggcctattttgttgacaaaataagcacacattttgtcagaaaggcaatgggcctagatttttttcctactagtactatcaactctttacttaatagctgattcctatattacataaacctgttctaaagtccagaagaagatggaaagccacacacctcattttataagactagcataatgagaaccatatctcaatatagatacaaaaattataaataaaatacagccaagttcaataatcagtttccagtcctcattttcctcaacgcatcagcatctcagtcacttcctatttcttccttgaaacattttcttcacttgactttgttccacattctccaggttttcctcccacttgctggctgccccttctgaaccttccttgctagtttttcccaatctccccagcttcttaaaattacaggactgacccaggttcagtccttccaccttgctgtctctattagcttccatggtgatctcacaggatctcacacatacatgtattcctatatgatgatgtattatatagggtagtatatatgtattcctatatgataatgtattagagtcctccagagaagcagaaccaataggttgtatatatagagaaaaaaagatttattataaggagttggctcatacgattatggaggctgacaagtcccaagatctgcatttggcaagctggagacccaggggagccaatagtgttgggttttttattttaacttttactttaggtttaggggcacatgtgcaggtttattacgtgggtaaattgtgtgtcactgatgtttgctgtatgaatgaccacatcaccatgtagtgaggatagtacccaacaggtagtttttcaacaatggtgtagttttactgtcagcctgaaagcctgagacccaggagagccgatgatgtagtttctgttggaaagctggcaggcgtgagacccagaaagggctgatgtttcagttcaagcctgaagatggcatgtcctagcatgaagacagtcagtagagggaatcccctctttttcagtcttttgattctattcaggctttcaattgactagatgagtcccatctacattaaggaggacaatctgctttattcagtctactgattaacatgttaatttcatccagaaacaccttcacagacatactagagtaatgttttaccaaatatctaaacacctgtggcaagtcaaattggcacatgaaattaaccaccagagatgatgactgacaaatttatatttccgaattggacttcccctaaaattgtgaaatcatatatccaacagcctgcttatcatctctagttggatgtttaagaggcatcacaaatccaatgtgtcctaaatcaaacttccagttttctcccacaaaactgcttattgcacagttttttcaatttcaattaatggcaactgtccagttaatgcaggccgcaattatctgtgtcatccttgactctattttcttgcatccagactgctggcaggtccccatagctggaccttcaaaacatatccagactccagccacttctagtactaccaccctggtctaaactaccattatgttttgcctggagttttgcagtatcctcctagtctgttttccttcttcaatccttgatgctttggagtctgtttcaatactgcagccccagtgaacccactgaaaacacaaattggattgtcatttctgctcaaaccctatgacggtttctactcttatgcagaataacagccagagtctttaagggtacatgattctacatcatctgtcatccctcctacaactctcaacctccgtccattccagtcacactgcccttcttgctattccctcagacaggcacctgagaatctttgcacagctgtttcctctgcctggattactcctctagatagctacatgacttccttccttgccctctgcaggtctttgctcaaatactgtattaccttctcagaaaggaggactctaattttacctgtgataacacctaattttttttttttttttgagatggagtttcactcttgttgcccaggctggagtgcagtggtgcgatctcaactcactgcaatctccgtctcccaggttcaagcgattctcctgcctcagctttccaagtagctgggattacaggcgcctgccaccacacctggctaatttttgtatttttagtagagatggggtttcatcatgttggccaggctggtctcgaactcctgacctcaggtgatccattggcctcagcctcccaaagtgctgggattataggcatgagccatggcgcccagccctgatcacctaatttttaaagaagacttgtattagttcattttcatactgctataaagaaatacctgagactgggtaatttataaaggaaagagttttaattgacttacagttccacatggctggggaggcctcaggaaacttacaatcatggcataaggcgaagaggaggcaagcactttcttcacaaggtggtaggagcgagaagagagcaggggaaactgccacttataaaaccatcagatatcatgagaactcactgactgtcatgagaacatcatgggggaaaccgtctccacaatccaatcacctcccaccaggtctctcccttgacatgtggggattatgaggattacaatttgagatgagatttaagtggggacagagatccaaaccatatcaactatattcatatattactaaatacatataatttagaaattgtaaagacaaaaaagccacaatttaggttttttaaaacatttgaaggcataggactggttagcaaaagatctttcccctctggggttttggatcatattttttcagcattgacaatctataaactataagctgacaatctataaactgaatttatagatacacttgtaaatataaaactgatcagtgtaacttctttcaatttcacaagtaaaactgattttctttaaaactaaatatatattttttgtttttatccttacagaagctgctgtgggggtgggaaacacaagggtcactgtctctgttttctttctacacatgacagtatggcattactgatgctgagattcatttaaaatccagggcaacaaggattgtacccattccttaacgtagaatttcttgaattcttagtggatgcatactgctgaaatggagatttaattgtaagtcccaaagacttgtcacccagcaggcttttcactgttttctcagatccagctggcctagttctacatggatagtatcacctgaagccactagagaactaggggccaggaaaatccttggctaactaattgggaacctaatgtggtaactgtggtctctcttctcttcaacttgtaactctctggagatattagaatctggttcagaagagagtcctgaaaagctgcaataggctcttcttgtcttgtcctaaagcaattgtgacttttgaaaaatgtgtgaaaaaatatagtccaaggagctgtagaaattgacaaaaaatcatccagagatgaaaatgtgcttaatttgtcacctaaatcatattatactgttgtctgtgagtagaagttggcattgtccactttgtgtctgatgattaatcatttaggtagtatctgttaggaagaggactcaagaaatagcttctaattttagtcagaaaaagtagcactattaatagcggccttgacattctgcaaagccaaattaagcagtcaacctggcattttataaacgggctgttacagagcctcacatctggtagatattcgataagcattaattgcctggctgactatgagcagccacatagctgctgtaatagagtctgcacatggtggtgggataaggctgattctgatgtactgtgggacaggaccttgtgaacatgaagaagtatgtgggtttttgttgttgctttttttttttttcaaattaaatgacttcataatttccttttgaaactgagcacatttcattaaaaatggatttccttttgtcaattcaaggtaagttaccaggtaacagtgatattggtcaaatgttacctcttttttaaatagaaagctgagagccttctaaagagccatcatcatattcttctttaaaattatttgaatcaatgccagagaaattgttaacatttcagtcattcatttaattttcattatcgcgtttataattagttcattgtcttcattatagtgaatggatggataatggtgaagtctggtctacattttattcttttatttaaactgattcacatctagtaaatgtaagtattatgaagctagaaaaatagttttaaagtaataataatagctaacattttttatcatttacactgtgacagtcattgtgctaagcccctttatatgtatttgtttcaaatatatattgaaatatcactttatttttctgccatatcttttctatgcttttaagattataacttttatgctgttttatttaaagtaaaatttgcattcatgcttatttgatctcaggtatacggtcaacctcagcttcatccaaaagaagaccacatgtttaaaggataataaagctgatggaatttttaaactcttaaaaattagtgttgagcgaaggcagatgttttacaaaagaggagaagacatctgatcctgtgagcctgatgaattggtataaagaattattggaatctgtagaaatgccatgattctgtttatcgtctttgtaaaaatctgatttggaacgaattgtccatagagtgggatgatccagctgcttgttgaatcggttgcttttcattagcccatctgatgttgactgcattctgggcttgcatgcctgaactcctgaaagattgaattatcagtatgcttctcactcagagagctgtgactctaatgagagattttcatatcaaatcattcatatcactttataatcacaatacaagtattagatgctttctgatcctgctacaattatgggaattagctaacttcatgtgaaattccagtaatagatatgaatgcatttctcaggtaggcaatgaatattcatccttctgaggtcaactgtggtttgaagaagtggaggagaggaggtctgtaagtctaaacacagcctgattctgtttgtctttctttgaattgaagggcctaccagtttcccagtttatctggcagtctttccaacttgagagggaggcacctgagtaggcacagaagaatggtggtgaaggcatgggttcaagtcccgactctccctcttaccagctttatcgccttgaaccgtttgcttaatttcactgggtctcattttctcatgtttaaaatgaggtaatagtagtacctgacttcacagagttgtgaaaataaaactttaattcaagtaggactctgacacagggcctgccacatggtaaaagctgggtaaacatgagttgctattgtcattgttctcattatcacaccagagctatagggaggccctagaagaaaaaactatttatctttcttttaatgatggagcaaagctcatttcacccaagagaaaatgaagatcaagatgggtaatatgtaaaatataattatataaattttgagaaataaatacattatatatatataaatgttcataggattaaaagaagtccatctaattattttttaaaaggtgtttgaaagcttgtggatgattcctaaacccttttgtttccccatttttataagatgtagagactttgtgttagcctgcatggacaaagcatcaaatgtgtttgcagaaaaagtgagcttgatgggaggattgcttgagcccaggagttcgaggttgcagtgagctatgatcatgtcactgtaccctagcctgggtgacaaagtaagaccctgtctcaaaaaaaaaaaaattaactcgaacatttgggaagacttgaactcttcatattcattgagctgacctgttcttagattaggaaggtgccagggaaatggttgcttagcaactaatggggttaaatgaaacagtctgttagctgggctcttgccctgtctgtgtgcatgcctaataaaggagatggtctccagtgggtattgcttgactcacagctgtcaaacaaaagtgatgaataaaatgcaagatcgaagggagggtccacacctggactgggcatctatatttatggtcatataccttcctttatgttagatgttgaagaaaaagttattaagagaggacattaaaaataagagagggactgttgaaattgagggttaaaattttaagagcgatcattagtttacattgagttttaagagactaagataataagtgataactgaggaaattccacactattatcttcaacattcttctaaaaaattctctatagaaaagggataacagggctgggcgtagtggcttacacctgtattcccagcactttgggaggccgaggcaggtggatcatgaggtcaggaattcgagaccagcccggccaatgtggtgaaaccctgtctctactaaaaatacaaaaaccagctgggcgtggtggcgtgcacctgtagtcccagctactcgggaggctgaggcaggagaatcacttgaaccgaggaggcagaggttgcagtgagccgagattgcgccactgcactccagcctgggcaacagagggagattccctctcaaaaaaaaaaaaaaagaaaaagaaaagggataacagatcttatggatgacattgtgaattctaggacagaaattgtgtgttttagtacttgtctgctcctggtccctatttatacccatgacagacattatgactagatcctgaccactctcacttgagctggatgtggcttacagccctcaacggggctgcaggaagccattaccaatatcagattgggcaggtaagaaacttccatgtcattctttatgacaaattgaaacttgttaaaaacttctactttttgaattccataggaatattctgaatgatttgtgtcaaaagcagctttgaggtagccacatgaaattcgtcttaaggaaaattgataagaaggaaatggaccagagaaaatcaaccaaaataattgggggaaaagggagacagtgtgaaagattttcctgaaagttcttaccactgccaccattcacaagcttaggatgatttactctttcaaagaccatgtccttgaatccactttctttcttttgaaataccttttattttctgtatagtaaacactcccacccctccaaatctagggatcagtcctcccatgctgggatttggactcaggccttctgcccagcctacaaaacttcgagcattggcttcaagcactaacattttatgactccgagaattcagattagatactatttccagtaggagactctagagctgttactgtatatatttgaaaggctattaagcagaaaagagagtgaactcattgaccttctcctatgaccaaggggagaaagctatcaagagggtgattggaagtcaatattttgaaggttttactaatatttctccagcaagggacagcctgtcatgaaaaatattaggtgtctcatcacttcaagtattcaagtatgcaaggagtgctgcaaggcggggaggactgactaccccagctgtgcttctcaaacatttatgtgcatgtggttcacctggggctttcgttaaaactcagctttcccatctagtaagtgtcgggtaggagccgagattctatatttcttacaagttccttggcaataccaatgctgctattccagggaccacaccttaagtagggaagggccagtgatctctaaagtgttaacattccaaaattctatttgcagaagagaggctagagtttagtcttgcttcttacacacacccagcacagctttgaaaaccacacaggagtctcttctggtcttagagaattctccctgaattcctatcatattttcctcagtaaagaatccccctctctgtctcctcagttgcttcacttctttctgcaggctttcaaccttttctgatatcactgttctctaaataaatttccttttttcatattttctctgatccatgcagactctaatcacaactgctcagtcattccttcgtgcaagccccaaattctgtcttaggacagctgtcaaaattcaggaaatctaggttatgtctcagttggggtgtccttagaagtttgtgaagagcaggattgtgccattggctgccatatgcgagagatcaaacagcctcttcaattaattcgattcattcaataatggtttagcaaatgtattcaataagaaagcgtaaaagtgccatccctaaacatctgaaagaggcaaatttgtgatagataaaacaatggacttctttgtatggtgggtaggaatgtattgtgatcccacgttcaggggatacaattagaaagtaacagaactaccagaggaataaggagaaccatagggatctgagagggcaacccaaggctgaagtcaaatgtgtggatgccactttccagaagacagaaagactggcaaggacaaattttgtgagttacccaactgcatggtgagcagcagtttctggccttcacaattaccataactttggctaagaaacaacttgatttgtgtcctttttttattccaccctttcctctcccagaagacccaggtcgttgaaacatggccacattcaagaggaggagaattctaaacagacaggataaaccataatgatgcttgttttgaagagctcattatcactgtatagttaatttaggaagcaactgtgccaagagcaaagctgtgaaatgcagctagatcctttaaataaacaagctacatatttgaagattttagaaaaaaaacaatatgtaacataatttttagcatataagatggatctttatgtggttaaggtgagggaaaattggtattttacagatattaatttgtgttgcctaattatatttacagtaatataattttactgttttagtttgtcttgtgatattttattctctgacagtattattatactatgggaggaaaaattaaaacaattgtaaagaggaaagaaaaccaccaaccaaacatcctcactctttcataccatttagctctccaggtggattgggttatttttttcatttgcaagataaaggaggtaaatagtccaatttaactgtgattgggaccctcctctccctaatggaagggaatggactattgcagttaattgaatggtctcattaactgagatttactacccattctatatgtgaggtgtaaccaaaatgtaataaaggctaataaccattaacactaaattgagcaaaatgtaatctttgttgattcagaagttagttcaaatctctgtaatgcctcatggccattgtaaacatcattaattatgtaacagtgggcatatagaagatgtaagatgtaatggatctactgtaatcattgcgagttgctcttttcaatgacttccttaaacatgtctttttactttcatttaactctgtttaatgcttataaaatgtaagggttgaatgtacctccaaacaattcagttatttcacctgtaagattatttgtattcttgataaaatgggagtcgcagtggttttgcctgtgttcagagtaactccaaagctgcacatagtttgccaggtaaaaagatcatattttaccagatgctttaaaaagtctatcatctgccattttacttatctatgaagatgtagtagaatttttgtcagttttgtgtcgtaaggtaccaccctaaaatgtagctgtaactaatcttgtgtctgcatgacaagtaacatgactcaagaaaacgtcacatactgtgattttaggactcaatttgcatcacttctgtgtgaaataaagagggaataacacaccataaatccacacctccctctgtggtaggcacttaaagtggattatatactcacaaactaggttttcaattagaaaggtttgttgttggtggcagcacattatcagccacaaatgagctgtgatgactgtaaatctcagcctggccgaggctctcccaaagacaaaatcttgtgaaccaagcatgagtctgtgcaatgctttcatatttctaagcagaactttatcccatgctttggcagaatgttgtgacttgatagagaacattgacatatgttcttttttttctaaatgtctagctttgaactcacttgtgtttctcaaatgtttagcttacagtagatgctctttctctttagttacgattttacattttggtatctaaaacaccttacatgcagaacatttctgttacatagaatgaattctttttgtttatgacactgtagggtggtaggacatcatctgcagatgagttttgaagatgatattggttgattcattcattttctgtatttattgcatgtatgcactcctagaatctgggagcaccacagtgagaaaaggagatatggcacctgccttcatggagcctgcactctaccttttcaagatgttatatgcttaaaaatattactgctggtctcatcacctcttttgctgccaaggagactttgaccttcctcctggtttctagcaggtctctggacattgtttcactagtttggatagactaggcaactggtgtttcactgtaccaaatggccaagttcttccttatcaccaagtggtatccaatgaggctcttcctaattgagatatcttttaaatgtattatacccaagacattgaccttgatataatagttccccttttttaatctttagattagttctagtttttaaaaattataagcattaagtttttaacattttttttttttgagatagagtctcactcttttgcccaagctggagtgcagtggtgtgatcatggctcactgcagcctcaaactcatggggtcaagtgatcctcctgcctcaccgtcttgagtagctgggactgcaggtgcagaccaccatgctcagctaatttttttttattgtttgtagagatagggtcttcctatgttgcccagcctggtctcaaactcctggcctcaagtgaacttctagcctcagcctcccaaagtggtgggattatagtcatgacccacggtgcctggcaatgttaactttctaaaacagtatgatgtgatgtcaaagtggaagttctgtatttatagaagtggtggtgatgatttttataatggggtcattccataaagtagaagtctaggagtatgttgcaaaagtaaagtcctgaagccagagatagggatttagagtgagactgtcatttggaaactatttgaaatgaatggatttagtcagcagttgagtggagggtgctgtttctcagctctcgtttcaattggagtcaaagggagacatgggacagtaagaccatcaacctggattatagcgacagtttctatataacatttactatgtgccacatattatgcctaacattaagcataattgtatttaaacctataacaaccctgtgaagttggtattattcccattttacagataaagagcctgaggctcagagaaggtaacaaattagccaaagtttcaagataaattgcccacatgactagtagtttatagaaccagatgtatcttcctgcatagttctgaacattaaaaataaagtttttaaaagggagttgtttgaaatacataagtaatacatgttcattgcagtgatccaaaagatacttacgtaaacaggataaaattaagtctcttttttccctctacaatcgtactctataatatagcaattatagatgcatttaattgtattgatataaaatgattaccaatatggtgttcctttattgctcatacaaacgtgcaaatatagatatacattatttaaggaattgtgttttcctcccaactctactaactctctgatgaggatccctattctatgccagtgttatcctgattacttttgaaagaccctagaaatgtcgatttttaaaactcctttggcagcctattttgtttttttaacctttgttctcaggaagtttttccatttcattaacccagatcattcttctgcagtttaagctattttgagtcctgctgtatatacgggattggtggcaagcaggccgtcagcacatcaggggcaattacaacttggaagatctgaaaaaagaacttggttggtgtggggaatgttaaaaacttaaccactcatgtaataaaaagcagacactgaaaacaactgaaatttctttcaggttctttcaaggagttcagaagcaaattcaacattttataaactaaaggtttttatttaactgtgatctgttttttaattttggaatttcgggtaatcttctgcaaatgcataaacaaaatctacttaactctaaaggcaatttcctgttagcttttttttttttttatctatagccacacttgatttaaaaaaacaacaacagaaactggtgcttctcctaacatatcaatccttttagccagggaatacataaaagaaacttcactacattttattgttaccacaaaatataaattttactaagagcttgccatatgtcaggcactgttcactttgtatgtatacttaatagaccgcagtatagtgtcaacataacttttatatgtactgggaaaccaaaacatatgtctgactcactgtattatgatatttgctttattaagttggtctgaaactaaacccaccatatgcctatataagtgagatcattcaatatttgtctttctgtgtctagtttatttcacttagcataatgtcgtccaagttcatccatattgttgcaaatggcaggattttcttcttttttaaggctaaataatgttcgtatgtgtgtgtatgtctcacattttctttatccattcatccgttgagggacattaagattgtttccgtattgtggctattgtaaataatgctgtaataaccatgggagtgtggctatcactttaagatactaatttcattttctttgcatacatacccagaagtgagattgttagatcataagctagttctttttaaattttttttagtaccctctctactgtttcccataatggctgtaccaatttacattacaaccaacaataaacaaggattcccttttctctacaacctcaccaacacttatcttctgtctttttggtaataattattctaacgggtgtgaggagacccctcattgtggtttttacttgcttttccctgatgattagtgatgttgagcatctttttatatacctgttgcccatttgtatgccttctttggaaaaatgtctattcagatcctgtgaccattttaaaattcagttatttaattatttatttattttgctattgaattttgagttccttaaatattttggatattaaccctttatcagatatatggcttgcaaatatttttcccattctgtgggttgccattttaatctgttgaatgtttcctttggtatgcataaggttttagtttgatgcaagcccacttatttttgcttttgttgccagtagtttggtgtcttatccaaaaaattattgcttagaccaatgtcaaggagcttttcccctacattttcttctgtattgtttcaagtcttacatttaagtcattaatacatttaagttaatttttgcatatgatgtgagataagggttcaattctattctttggcatgcggatgtcaagtttttcctgcaccgtatattgaaaagcctgtcctttccctattgtgtgttcttggcaccctgtcaaagatcagtttaccatagatgcatggatttatttctgggatattctgtttgttggtctatatatctgtttttatgacagtactatactgttttgattactgtagctttgtaatatattttgaaatcaggaagtgtgatgcctccagcatgttctttttgtttaagatttctttggctattcagggtcttttgtggtttcatttgattttagcatttttttttctatttctataaagaatgccacttgaattttgataggggttgtgttgaatgtatagatcattttgggtagtatgaacattttaacacatttttttcaatccatggacatggatgtctttccattttatctgtgtctttgatttccttcaccaatgttttataattttcagttaacaagtctgttacttctttgattacatgtatgcctaagtattttctttgttattgtaaatgggatggttttcttaaatttctttttgatgactttcctgtttgtgtacacaaataccacagatttttgtatgttaattttgcaccaaaaaactttgttaaactcatttattagttctaacattgttttttggttgaatcttcagggtttcctacgtatataatcatgttatctgtggaggtaatttcactttttcctctcccatttggatgctttttatttctttttcttgtttaattgctctgggtaggacttccagtactaagttgaataaaagcggtctctcgtcttctcttgccatcttcctttgttatctgattatttttgtagtatttgccttgattcttctctatttatcttttgtatatctattataagtttttttctgtgtggttacctcaaggctggcataaaatgtcttgtagttacaatggtctattttaagttcataacaacttaactgcacacagaaattccacacttttaccacctcccccaaactttgtgtttttgtagtcagagtttaattctttttatattgtgtatccatcaacaaattttggtcttttatcttttaaatgttggggtaaaagtaacttacacaccaccattacagtgttacattattatatatttgtctgtatatttaattttgccagtgagatttatgttttcttatgctttcacgttactgtttagcatgtttttgttttcaatttgaagaacccccttagccattttgtgtaaaataggtctaggagtgacaaactctctcagtttttgtttccctgggaaagactttctctttcatttatttttaaaggatagttttgccagatattgtatacttggcagtttttttctttcagtattttgaatgtgtcgtcccactctcttctggcctgcaacatttctactaaaaaaaaatccactgatgtcttatggaggtggttcccttatacatgacaagtcacttttcttttgcttctttcaaaattctctgtctttaacttttgaaatttaattataatgtatcctggtgcagatctctttgtattcaacttatttaggattctttggggttaatcaatctggatgtccacttccttccctgatttagaatgtttttggtaattattccttttcaataatctttcttctcctttctatttctcttctctttattaagctttcataatctatatcggtttacttgatattgttccataaaatccataggctttctttactcctttttattcttttttcttttttgtcctctgactggataattttaaacgaccagtattcaagtttactaattctttcctctgcttgatcgagtctggtattgaagttctctgtcgcatttttttatttcatttattgtgttcttcagcttcagaatttgtttgcttcatttttgtggtttacatttctctaactttccctttcatttatgtattacataaaatttacatttctctaactttcccttttgtttatgtattactttcctgatattattgagttgtctatatgtgttcaatgataatttcttaaaacaataattttgtcaggcaattcataggtccccatttctttgggatcattactggaaattatcatattcctttagtggtgttatgtttccctgacatttcatgttccttgtagccttgcattggtgtctgagcatttgaaggagcagttacatctttcagatattacagactggctttggtggggaagactttcacctgagatgtgatgatacctgaggtgtgatgatgggtggggtgtgtggtggttcttaaataatcacctgaggtgtgatgatgggtgggctgtgtggtagttctgggtccagtgcaagttgtgaggaatgtgcaggggcactggttttggggattgtgtgacactgtcatggtgcatgggggtgccaggtcctggtgcaggtgtaagacaagtgacatcacacccaggtgtgggctcatgtgaagccgtaccgggtgcagggtgccagagtggccccctccagctccaggggatgcaaggcatgggctccaggcatctctgtcagctgggatttgtgttggtaaagactggggatctttagcagcaaagactgtaggaatcctcctgctcttttcccctatggggggatatagtggtcaaggcaatttctgttggcactaagctgtactatgtggaacatcctcagttctaaaaaatgttcaatttttaaaatttatgataaagtaaatttctgaaagttaagtacattatgaatgttagctttttaatatatcaaatataattgaatatattatatgttaaatactcccaatagctttaagatattttgaatattattttattttttcaaattgtatttaaaatatattttagaaaatttcttaaatggcaagagagcaataatttagtgtttctaacagtgaaaggtttaactataaattaagctctcaaaaataatccttttcattatgaaaacataaaactctctaatgcagtgagatggaaatgaagatctctacaaggaataatgggtcatcagtttatattgtccatcttatacatattaatttaaaatgtatagacttgtgaggataaaaaaataacatttgttaaaataaaatcctattagttcaatagtacaaagaatataaaatacctaggaatcaatttaaccaaagaagtaaaatatctatacaaggaaaactataaaacactgatgaaagaagatgatgccaaaaaaagggaaagatactccgtattcatggataggaataattaatgctgctaaaataacaatactatccaaagtagtttacagattcaatgcaatccatatcaaattttcaatgacattcttcacagaaatagaaaaaaatcttaaatataaatggaaccacaaaaaccccaaataaccaaagccaccctgagcaaaaagaacaaagacattacactatcagatatcacaatgtactacaaagctatagtaactaaattagcctggtactggcataaaaacagacacatagatcaatggaatagaatagggaacccaaatataagtccacacatttacagacaactcatctttgcaaaggtgccaagaacatacaatggggaaaggccagtctttttaatacatggtgttgggaaaattgcataactatatgcagaagaatgaaactacacccttatctctcaccatacacaaaaatcagatccaaatgtattaaagacttaaatctaaggccccaactatgaaataactagaagacaatattggggaaatgctccaggacattggactgggcaaaggctttttgggattaagaccccaaaaacacaggcaactaaagcaaaaatagacaaatggaatttcatcaagctaaaaagcttctacacagcaaaggaaacaatcaacaaagtgtagagcaaacccacagaatggggacaaatatttgtaaactaccatctgacaagggattgataaccagaatatataagaaactcaaacagttcactagcaaaaaaaaaaaatccaatttaaaaatgggcaaaaatagatatttcttaaaagaagatatacagatgtccaatagatatatttaaaaaaatgctgaaggtcactgagcatcagaagatgcaaatcaaaactacactgaaatacctcaccccagttaaaatggcttttatcaaaaagagaggcaataacagattctggcaatgatatggagaaaggggaaccctagtacactgttgacgggaataaattagtacagccactatggagaatggtatggaggttcctcaagaaactaaaaatgtagctagcatatgactcagcaattttactactgagtatatattcaaaagaagggaaatcagtatatatataaatatatctatatatctatatatatctccaaaggaaaggaaatcagtatatctgcactcccatgtttattgtagcactgttcacaatagtcaaaatttagaattgggctgggtgcagtagctcacacctgtaatcccagcactccagcactttgggaggctgaggcaggtggatcacttgaggtcaggagttcgagaccagcatggccaacatggtgaaaccccgctctactaaaaatacaaaaattagctgggtatggtggcacgtgcctgtagccccagctactcaggaggctgaggaaggagaattgcttggacccaggaggcggaggttgcagtgagctgagatcatgccactgcactccagcctgggtggcagagcaagactctgtctcaaaaaaaaaaaaaaaagaaaaaaagaaaaagaaaatggaattaactaagtgctcatcagtgaatgaatggacaaagaaaatgtggtatatatacccaaagaaatattatttagccataaaaaaatgaaatcctgtcatttgcagcaatgtggatggaattagaggtcattatgttaagtgaactaagcctagcacaaaaagacaaatattgttaagttgtcactcatatgtgagagctaaaaaaagtgaatctcatgaagacatagagtagattggtggttaccctacccagtaggctgggaagggtcgtagggagggggaggatgatggggatattgaataatgagtgcaaatatacagtttaatagaagaaataagagctagtgttagatcagtagagtgactatagtttacagtaatctattgtacacttgaaaatagctagaagacagccgggcgcagtggttcacgcctgtaatcccagcactttgggaggctgaggcaggcggatcacaaggtcaggagttcaagaccagcctggccaatatggtgaaaccccatctctactaaaaatacaaaaattagccaggagtggtggcgggcacctatagtcccagctactcgggaagctgaggtaggagaatcacttgaacctgggaggcaaaggttgcagtgagctgagattgtgccactgcactccagcctgggtgacagagtaagactccatctcaaaaaacaaacaaacaaacaaacaaacaaaaaacaaagaaagaaaagaaaatcgctcgaagagaataatttgaatgttttaagcataaagaaaagatattttaaggtgatagatatctcaaatacactgatttggcaattaaaaattaagactatattaaattatcatatgtacccctgaaatatgtacattccttaggcattgataaaatttaaataaataaataaaattgctaaaagatgaatattgatacattggcaaaagtaaaaaaaaaatcacatttttcaaattaaaaaaattcagcatgaactaaataccacatagcatagtgaggtttttttggttttgttttttatgactataaagttagctaaactgcagaatctcagggaacagttcccacaaaacttctctcattatcagtaaacaaaattgaattctctttatatttcttaagtcaaagattaaaggtgcacaaattagcatggggttgtattttttttttccttttaaaatgcatttgttttaatttgtcaagtttttgtctttttaatttcaaattttcatttgacatactgatttgcagtaaattggccatttggagaattggttgggggcaaattcacttgcactgaatagctgagtggttctcaaattcaagtgggcatgagagtcacctggagggcctattacagcacagattgctgggccctgcttggagtatcagtttcagtaaatctgcattggggccctgagagtctgtactcagacacgttcccaggtgatcctgatgtcgctggtccaagggctacactttgagaacaactgaaacggagtgtgtgatacatggctttgtatccccacccgaatctcatcttaaattgtaatccccatagtccctataatccccacatgtcaagggagagaccagatggagggtaattggatcatgggggcgatttcccccatgctgttctcatgatagtgagtgagttctcacaagatctgatggttttataaagggctcttccccttccctcggcacttctcctttctgctgccttgtgaaaaaggtgccttgcttcgccttcaccttcgccttcgccttccaccattattgtaagtttcctgaggcctccccagtcattctgaactgtgagtcaattaaacctctttcctttataagtcacctagtctcaggcagttctttatagcatatgaaaatgaactaatacaatggcagatgagaggaactagctgtttcattggactgaggcagaaaaaagcagagaagtcagaagatgaaggcttttcatgtcctattgggcaggatgtttggcattgctgcatataacttggtagcaatgagaatccaggaccaagagaaagcgttcggtgggcctaaatactatcacctcaaaatgagactgtgtattacatatagaagtactgtatatggtgaggaatgccatcctgtgtgtgttgttattgcaactgttcagacatcaaaatgatttgcagtggtttgtgtgaatgacactttctagaagcatttcaaaaatcaaaatcaattattaatttgtaaaacttttttttcccctagtctctctagaattttgtcttgctcccttgctgtcaaagtctcataactgtctttctccctttcctcacctcaggcaatgttcagtctttgtatggtggaaagtggagctgatgaggttaatttgcacggtgtgaccagccttggcttaaagcaggctctggagtttgcatacacaggacaggtatggtattaaatgtgatctgtaaagtttaacatttcaactacatctaaccaaaggagattatccttgaggtatgagatttagttattgttcttgttactcattttgatgttaaaaataagattcacatcctcttaattttatgactaaagttatggaaaggtaagtaaagcaatttgattttttaatatgatccagtgaacatagtattttaaatttaactcagtgcttgctggtgtaattttttgaatatcttaaagaactatcgtaagggaaagagtttgcaagataatggattctcattgttatcactgaagctcggtgactcaatcatggctttattgccttaaaaacaagacaaaaaatttagatccccaaaaatttatgtccaacgtcttggtaccatgtcctccacatatctcagagtcagaattgaaggcatttagattagtagattgtgatggtttgaaatcctaatacattaatgaccaaagttgttataggatttataggacatcagaggatatccatttacatttgagaactactcaaataaatcaattcaaatacagactggatgtttagctccccttttataaattgttgttctttaacaacatttcatccaacgtggatttagtatcttctatgctaaaatgaaagtgtcttctcttgagatgctcacatcctagtaagagaaagacaggcaaatacatgattaaaatcctcactggtattggagttataacagaagcagaatacaaaacagagtgggagaaggatgcatgtggtcaggtgtggctatcagtacacaattttacagatagggtggtatttgtgtcttgaagaatgtgtgggagctcatttttctactgaattttatttttgtttaattttattcttaattagcaaataataattgtatatacttatgtgatgtaaatgtgatgttctgatatatgtttacaatgtggaatgattaaatcaggctaattaacaaatttatcacctcacctacctacctattttttttgtggtgaaaacatttaaaatgcactcttctagcaatgttgaactatacaatgcattattatttattatagttaccattctgtgaagtagatcactacagcttattcctgctgtctaactgaaactatataccctttgatcaacatctcccattagtccatccacccctgctacagtttggatgtttgtcctctccaaatctcatgttgaaatttgatccccagtgttggaggtcgggtctgtaggtggatgttggggtcatgttgattgattcttcgtgaaaaggctgatgctctccctcagggtgtgagtgagttctcactgttaattcctgaaaaagctatttattaaaaagaggctggcacctccttcccactctcgtgcttcctctcttactatgtgatcttggcacatgccagctccgcttctcctctgccatgagtggaaacagcctgaaaccctcaccagaagcagatgctggagctatgtttcttgtttagcctgcagaaccataagccaaataaacctctttcttatataagttacccaatgtcaggtattcctttataacaactccaaatggactaagaaaacaccctcccctagcctttggtaaccatcattctacttgctacttctatgagttcaacttttttagattcagcatataagtgagatcatgaagtatttgtctttctgtgccttgcttatttcacttaacataatgtcctcaaagttcatccatgtcattgcaaatgacaggatttatctgcttcttaaagctaaatagcagtatgttgtgtatacataccatcttttctttattcatctgatgatggacaactaggttgcattcatatcttagttactgcgaataatgctgcagtgaacatgggtaggcagatgtctctatagcatactaatttcagttcctttggctattacccagaagtggaattgctggttcatatggtaattttatttttacttttttgaagaacctccatactgtttaacataatgggtgtattaatttatattcccactaacagtgcacaaaggtttttctccacaccctcatcaatacttgttatcgattgtcttttttttatagtaggggtgaggcgatatctcaccatagttttaatttgcatttccctgatgactaatgatgatgaattttttttcatatatctgttggccatctgtatgtcttcttttgagaagtgtctattaggtcctttgccagctttttgattgggttatttattttctcatcttcttgtgatggctctagctttgttctttttgcacaagattgctttaactattcgagttctcagttgtattttttttttcttgtctaatttctctggctagaacttccagtactatgttgaatagaagtggtcaaaatgggcatacttgtcttgtttctgatcttaaaggaggagctttcaacttttcaccactaagtataatgttaactctgggcttttcagatatggcctttattgtattgatatacattctttctatgcctaacttgttgagagtttttatcatgataggatgctgaattttgtcaaatgctttttctgaatctattcagatgatcgtatggttgttatctgtcattctgttaatatggtatattgcatttatttattaatatttgcatatgttgaatcatcattgcatcccagggataaatctcccttgatcatagtgaatgattcttttaatcattcactgtgctgttgaatgtagtttgctagtattttcttgaggagttttgcagccatgttcatcatggatattggcctggaattttcttttcttgtagtgtctttgtctggctttggtatcagaataatgctagtctcataaaatgaatttgaaagtattccttctttaattttctgaaagagttttaagagagattgatattctttcttctttaaatgtttggtagaattctgctgtgatgctataaggtcctagatttttctttaatgggagatattttttattaatagtattgatataatctccttacttgctattggtctgttcagattttttattacttttttattcagtcttgctaggttgtatgtttctaggacttcatccatttcttctagattatccaattttttggtgtataattattcatagtagtctcttatggtcctttgtatgtctatgatatctgttgtaatatcttctctttcatttctgattttatttatttgaatcttctcgttttttttcttagtctggctaaagttttgttgattttatcttttcaaataatgaagtttcactttcattaatcttttctattgtctttgtagtctctatttttcactaagttttctttagaggcttattaaaacgtatgatatcatttattctcttttctggagttagtagaatttaagatatgtgtcttagaataattgaggcaactctggcagctagaagaaaatagtaagtataaaggaaataagccattaatcaagtagaaagtataacaggagaaagaaaggtgatggatcacaaattcaagattagcccagccaaatttcaagacttaggaaattaaggcaggccattatcattcacagagttgccaaaatatattcctagtgaagtgagtaaatcatgtattttgtgttttttggtttacagatgtgaagaaagataccatctctaaattctgtcttattatttctctttttatacttgaattacatgcagtcacatctgtatttgcccatctctagagtaagattgaaaacccatagctcttacttcacaggtgtgccatgggatgaaatagtaattttttttttgtaaaactacccaagtaaataatatctgcactcagctgcattagcaactaaatggtttaagcttagaggcaatggtctgtaaagcatgtttgaagtattaggaaactcaagagcacaaattcctgggaaggctgagttaaaatacacatgcaaatatatgtggctgccttattgcttgcttgattgctttgtgatttccttcagaatggctaagttgatgtgtatgtgcgtgtgtgtgtgcacgcatgtgtgcgtgtaattcctgtcacacaaaggatctatgaaatgtgaactgaagtgaagatagcagaaagggagctgactttttgaaggtgaagaaacctacttggaaagcaggaagatatttgcagaagggcagccatatcccattgcccaggagtcatatgccttaggtgcttaaattctacttttatgagaaaaagaaagccaaatgagatgaaaatatatctggtgtaagtgcctttaaaaagaaagaaagaaaagcaagtcctagggccagatctggggttgcaattattctgtccaaacaccagagacttattctgactgtgcatccacagaggcatatgacagtctgtggcatacagcagtaattcatctgttcaaattgtgtgctgagaggacaggaagggggctgacatttcctggagcaccttctgaaaaagccaggggacagcactaggcactttatgcgtgctgtttaaactaatctttaaaacagctctaaggaatgctgtgaccccacttgaaagatgacaggcccagggaaatgcagtgaattgactaagatcattctctcatatattttggcccaattagtcaaaccgagtcctactaatttcaagtctgttgttcgttttttattataatctgtcattaagaaaagattaagttatactttgttatactttgttgaaggaggcagaaaagtgtttgggcatttacagagtccactatcttggtggttttctaaacttggaaactgtgccttttcaagtcagtccatgagggcttagacttgttctccctatgtgatcactctttgccacagagtagaagttgatacctctacagcctttcttgaacaacatccaagaaagtttggttctgaaacatctttaatttgtaataaatctattttccctttgagacatggacacagctgatggcaaaaagaatgaagttgcagtttacttgagattgttgaacagctgctttctcttactatggagtcgacattaacattaagcaaaaaggttggagcataggaatgtgagtgaaagcataattcttcagtttcttaactgttatttagtattagggacattcactgacatgtagtctttatccgtgatatgtatatagatttgtaaaaattcagggttaacatcgagtgtatctgcctatagctatttctaacagttgattatatgtttagtcagttgtaatatgcatagtatgaaatgtacgtattttaagtgtctgaaaattgttgctgtcttggagagaaattggaagtatagagtgggagtgatgaatgaatgcctctaagtgtaacaagatgtgtgcgtgttcctcctacacattgctctaaagtgtagccttcttaaaattggcctacagatttcatccaggaaattttaaagaaaaagcaaattttcctcttaatattaatacatattctgaaaatgcatgcatttcctatcaagtagcaaacagggctgcataagcattcactctgcctttgcactaatgagaaatatgcccttcttctgggcacactgtgtttgggacactgcttgaatagaccttgggatgcagtgcagtcttcatgggtgtccttgcacagccatgcatggaggccattattacagcagaaccaatggtggagggcatagaggccaggctgctcttgctctgcagggcttgttttgggagcaaggttggaagcaaatggtgacataaactgactctgggcagatctgccttagagagaaaaggacaaagtgaatctaagaaaatacaaactccagttacactggtgggcaagagggcccatcctgttactctggcctcccttactctcctcactttgaaactgtggccaagttttttcatgtttcagaccagtcctgagtagaagaggtatgaggaagaaggaagagaaatactctgatggaaatgttgcctgggagatggatcccagtccaaactagacaagaggtcagccacccaggagcaggcaggtgtttttagaaaatcaaaaagcaaaaaccaaaaaacccagcctgacagtgaagagcagaaaacatcaagacccttttataaaaagaagagccctgcttggaaagtagaacttccagcaccaaaggccttgggataagcctttagaaatttgagtaccttaggaccgaaatggaagcaaataggactgcgaaccacaataaagtttattgtttaacactctggctatgatgatgtcaaggaatatacactatatgccaagcactgtgataaataccttacatgtagtggaggaagggttgaaacctagttagcttcctcttaatttccggagagctctcctccttttctgtcccttggagactgatgaagaggttccagaaacccagtggagagataaactctgcaccaaatgatagtgacgtttatagtcccctttacaattctccacttccaggcactgctaactctgtcagctgtgaaccaattatgtcatatccgggcttctgaagaaggatgccttgggatctgtgttcccttgcatttctctttattattcagtaactccagcccttggcttctgaaaatcatagaagaacccatctcttgggggatagtcaccctaaatacatttctctgacccagagaatgcttcaatacgatctttacaaggaaatattgtatcaccattactgttcttattttgaagccttttggcaatcaagaaaactatcatactctgttaagggaaaaattactttaaaaatattcattcagtcagaggtctcaccatagtaactttgtttttttgattgtcatttggttccctaataagttcacatgactttttttatatagccctgataatgcaaacactgtgcattacattttgatgatcattgaaactgtattccccacagcagaatacttttctcgggagacctgagcatcaggccaggcagcagagtgacaggaatcttaattggatctgctttctcatggaccatcccttcaggggtagaagtatccatttatatggagaaagtctctgtcggatttacttataaatataacccaattgagctaaatagtagcacatggagcaaacatgggagaaaatttttaaaatgtttctctcaggagtagtgttaagactattcagtggtttaaatattttagcttcccaatcctttctttagctggcagtacctacctggcaagtaaaaggccctgaggcacctccactgtgccttgcactctggagggtacacagtgaaatccacattttaaggaagaatatagcatcccttccttacctgctggggctatattccaagaccccagtggatgcctgaaacctcagataagtaccaaaccctatatatactatgtttttttcctatccatacacacctgtcataaaatttagtttataaattaggcacaataagattaacaacaattactaacaataaagtagaacaattataacaatacaccagcatcacttctcttgtaccttggggccattattaagtaaaataaacacaagcactgagatactgccacagtggtctgataacccagagggctactaggttactaacaggcagagagcatctacaatgaggatatgctgaacaaaggaatgattcatgtcttggtaggacagagtgggatggtgggagattgcatcatgccactcagaatggtgcataatttaaaactcatgaatcgtttatttctagaattttctatttaatgtttttggactgcagtttaccatgggtaactgaaaccgtagaaagcgaaaccgtcgataacggggggcgggggggaactactttattttgaattttgcagaaagtgacatttctccttaccttcttgtcagagctatgccagagtccataactggagtgttgacatggaaagtttgagaagtgtgaaacaaaagaggaagtttgaatttcatcagttacttttttgcttttttagatcttttgaaactagttatttgccttggggtagattttctcttttatcagtgcattattgaaacaaacaagcagattagtctgcttcctgtttgacagtgaagtcataaaatatgaacagctttgttggtcccaagacctgtctctttctcacagagaacagctgattcacagtcaggtcatgtaggagggcctcccacctgtagggcagggccaattctaagtgacagtctttgcttcacgccagtctgttctcctttattaaatttctctgtgctatccagtcagaatgtgctcagagtctagtttgtgctgcaagaatcataaagccattcgttcagcagattcatgtctaaaatgtctctgtgcaaagaagtttaactgtggccacccttctaagatcagctttccaattcagtatgttttgatttttgaaaaatgtattcctgttttcccaaataatttataaatttatgtcttcattttcttgctgtcacttggcagaaatagaatgcgcaaccccccaacccaaaatctgatttggatgttgagactgataatgccacacaccccaacaggatgtgaaaaggtttattcctcacataatgaggctttctggagagagcagggtgactcctaagcaggtgcaaaaatggcttgagagagcatggaggtatggctggctttggcttttattgtggggcaggggcaagggctacccgcaggtagggcttgtgtattttggagagagttttcaggcttttttaaacctttgctcagatgtaaggcaagcaggaaaatagggaaaggtggggcttgaaagccatccggagtgaaataacaaaaataggggcagactctattacattaatctagcattctacttgagtaatagtcacatttcaggcacagacattttcctttggaatattattaaactcagtcacctaatgaaaacacaatgtgggctggacgcagtggctcatgcctgtaatcccagcactttgggaggccgaggtgggcagatcacctgtggtcaggagtttgagaccagcctggccaacatggcaaaaccccatctctactaaaaataaaaaaaatagccaggtgtggcggtggacatctgtaatcccagctactcaggaggctgaggcaggagaaccgcttgaactcgggaagtggaggctgcagtgagccgagatcatgccactgcactccagcctgggcaacaagagcaaaactccatctcaaacaaacaaacaaacaaacaaaaaacacatgtgtttgaacaatattcttacagcatttataatcttttctggcaccaattctgtgctgaggaacccactgtgggctaaggtgcctgaggtcgtatgtacagatcatgcacactgataacactgtgagggtctccagatatcttagataatatagatgacaaggatgagtgtggccccttctgtgttttaaccatatctcccttgtgtaaaaatccattcaaatgagctggatttgttgttctttcctccattctccttccaactctcagcacctcccaccctaccccattgccagtattgggaatagaaaaagaaatatttcctttttgctcttgataatggttttattgtcataggtggggcaataaacagtctttctctgacattctccaaagtagaaatggcgagtatccagtaactccaaacagtagatcaaccctcctagttaactcagtgggttttgcacttctgtgcacctgtttcttctgaatgtttcaacagaaagttccattgctacatatttcataatccatggtgtgcatctgagatttttactttgccatggtgggtaaacagcacagaaatcattacaactttgttccttcttgatcatgtgaatttctgagtgttgactgcactcagaatcatttcctaaagaaatttcgatccttcctttaggtgctccctcaaatcatcttagtggagggaagttaatcatttatatagtggggagtcttggttagttccttaaatttcataagaagatatcagcctattgatggatttttaaagcacatgaactttttctcttattgagaaaaaaagaacaattgtgctccagccttatcctgttttctggacaactcttactagaagttcatttaggagaaattttacacataaaggatccccagaagatatgcagtctattcatctggcttggtggttctcaacctcaactgtcagtccttaatataaaaaggccacctttactatcctaaaatgaaattcctagacaatataacatacttacacaaattactctaagcaccaatagaatttcctaaccatatgtaaaagaacaaacgaaagaagtttgtgtttaaaatcctttatatttcagtgtgtacatgctggggtacaacccttccaaaagacataatgaagtagtctcctgtctgcccccatagggagaatcaccatgattgggacagcagatgcacatgcagatgcagactggtgaatgaatgttgtactgtcaactcagataccacaaggacagatcccaggtggcatgtgacatgattttccaaaataatgaacaactcttggtattatacaattctaaacaaaacaaagtaacagtcttctctttgtttttatgggcgtagcattcctggaaaagccaatgtattctgacacagaacatcaaagaatgtgtttatatgtaaaacagagttaggttcggggcttcaatctgtgtaaacaaatgtttcacttctttgcacacccagcagggcattccggcgtgcaggctgtaggtcagtcctcatggttggtgaccgccctgtgtgttgcctggcatctagcctcccagccactgcccaataaaggccaatattgcccaccctcctgggaggaccagaaatatccccgcaaatttccgaatttccctgagaaggtagtattgactcgattgagaaggacttcttaaatattttaaattttatacctagatcaagccagaaaaccagaaaactggatgtctgggtcttaaataatctctttattaaccttcactttttatgcaatgttctataatataaacttctgatggtattattagaagtattatcaagcaaatcattcaataaccctcttaatgtctgctgggaaatttccattacatctcagggtctggagaatctagaaatctccttagtattttcaccttttaatcttgcattaggttacatttctttttcagttttgatgctaggaagcatagagccacattgtgacccacttataatagttatgaggatggatacacacacacacacacacacgcacacacattctctcctgacctcatattgtttcctcttttctcttgctttgagttatttttattcttaatatttaaatgcttgtattgatgcctcagatcctttttgaaatgaggcagagaagataataagtaactagactgaataaaaagatttgagacctctttctgaacatttttggaatcccagagggatcttaatgttagttgtaggcatgaatgctacagcccattagctctgcctatgaaaatgaagtgcctccaaattcccagcttgctccataaataaatcattccacacatttcccaaatttttttcctccttgtttcagcactaaatataaggatactgcaaattctataaaaagaaattactttatctttgaaaatgaaaaaacacaacccaaatttttataaaattattaataagactaaaagtaaaaaaatattttcacttcaaattctcacttacttacatgttatatgttatctttctgctttcttcggatgcccattttcttcagatgcccatatgtctatgtgattttataaagattttgtgattgtaatttacttcaacttcttttctggaattaggtaagatataagtacatttgttttttttaatttatatactatgcatttatatgcatagtatataataaatgtattaaataaatttattgtgtactatgccttttatttatatactatgcatttttatttatatactatgcattcatacatagatattttgtagtctgtgcatatactacacatacactacaaaatacatagactacacataatgtatgcatagactacaaaacatcttattttctttcttttctttcacttttccttaaatattcataataaggaattcttttttccttaaaatagaattcttgagccctctgctggaagtattcagtatttgtatgaagcagcagtatatgggagttttacaattctaacttaagttttttaaaaagaaagcaacatgatagcaaaaatatatggtcaaattgtaattaatatcaggataaataatttgctaaacagtacttttaagatgatttatattggaagttatattccatttgagtaaaataatgatgagaacattcaaatgaaggcataatttgaatgtattgaatactctaagttaacttgtgaatattttatttttgtatacttcataaaaaccatccatttacattttattctcaaatttagattcattaattcagcaaatacttaatgaacacctactatatgctaaggacttactagttgttagggatgcactgatgagaaaatgtacattggtgctttctcacagtaggtcaaactgtgattggaaatgccagatcaacacaccattgcatttttaagaaatggattagcagggatctgaattatttgcatatataacatagaaaaatacctgagtatgtttgatgcttcaaaagttgcactaattcaggtaggagaatggataattgagttgtagttctttgtcaaggactgcctgaaaaataagacagtaatttgcattatactttgcaggaagaaaataataggcatttattctatagtaattgaatagacagatatagcaccttaaaaactaatgatagccattcatctctatgtatcatgtatctgtcaaagtaggaacaacttggcacagcccaaagaatacagcctgtactcccggctattcgggaggttgaggtggaagaattgcttgaacccgggaggcagaggatgcattgggctgatatcgtgccactgcgccccagcctgggcaacagagtgagatcctgtctaaaaaaaatataagagaggataaaaattgattccagcttgtggcatctttggagaattatttgttgaatccaactgtaagaatcaattctgctggttggcactggagaaagtcactgttttcacttcaaatccatgaccccaaatctcagacagatacccaatgccaggcaatgttaatctgtttccctagtaaatttgctttcctcctcttcttgatgagtttctcaccctctctcttctctttttagagacattcccctcactaacctacctccagtacacatatcataaggaaaagtcaccgtccattgagaaaatagaaacagaaaggaagatcttcatcatcttaccatcaaattctcaaccctccctgtttctgaacttattctgggtatatccctcttttacagtgggaggggtatccctgaactgtcagagactaatctcccccacgtagggtccagatccactccctccgactctgtccaatatcactcctgttatcctgctgctgtctcttctgccatcagtttctcctctactgcattctattgctcacctttaagaatccttttcttgccaggtgtggtggctcatgcctgtaatcccagcactttgggaggccaacgcaggtgggttacttgaggccaggaattcaagaccatcctggccaacatggtgaaactctgtctctactaaaaatacaaaaattaaccaggtgtggtgacatgtgcctgtactcccagctagttgagaggttgacgtgaaagaattgcttgaacctgggaggtggaggttgcagtgggccgatatcgtgccactgcaccccagccgaggtaacagactgagaacctgtctaaaaaaaaaaaaaaaaaaaaaaaaaaccccttcttatttctatattcctcttgagctaccacttatttctctgactcttctcacagcagagcttatgaaaagtgttacataaagttatttttcctcactttcactcatttatcactcacttttccactccaagtctggaggcttttatcttcatcattccactaaaactgttcttggcagtcacaaatattgccaaatctaattaaatactgtcatatgtgacctcacagcttcgtgcagcatagccagcctcccttttctttttttttctttttttttctttttttttttttttttgagatgaagtctcgctctgtcacccaggctggagtgcagtggcacgatctcggctcactggaagctccgcttcccgggttcacgccattctcctgcctcagcctccctagtagctgggactacaggcgcccgccaccacgcccggctaattttttgtatttttagtagagtcggggtttcaccatgttagccaggatggtcttgatctcctgacctcgtgatcctcccgccttggcctcccaaagtgctgggattacaaacgtgagccaccaggcccggcccaccagcctgcctattctctcttggcctttgtaacactgctcactgtgggcttttattctgtgccaccaccagccttcccgtcactcctttccaggtggctttgcttgctcctccccactctgtaggcttcaaatccttcctgcttcagaaccctcctgtttaatccaactagcttccttggtgatgtcatccagacccaagttatttggtattgacaaataacttgctattatcttatgctattgactcccagcccctacctatactctagaccaaggatcagcaaactttttttgtgaggagccaaaaataattcagtaaataattcaggccatataaagtttctgtcacagctgggtgcagtgggtcacgaccatagtctcagcactttgggaggccaaagcagaaagatcgtttgagccccggagctcgacaccaggctgggcaacatagcaagaccctgtctctattttaaaaagtaaataaagtttatttcgcaactactcaacttagctgttgtagcatgaaaactgccagagacaaatatgtaaatgaataagcatagctatgttataataaaactctatttatacttaaatttgaatttcatataattttcatgtatcacaacatattattcatcttttgggtttgggggactgttttaaaaagttaaaactatttttagaaattaataccccaaaaattaaacaggcgtaaatctaacaaaatatgtacaaaaaatgcagttttcctatgtgagtatctttttttttttttttttttttttttttttgagacggagtttcgctctgtcgcccaggctggagtgcagtggcgcgatctcgactcactgcaagctccgcctcccgggttcacgccattctcctgcctcagcctcctgtgtagctgggactacaggcacgcgccaccatgcccggctaatttttgtatttttagtagagacggggtttcactgtgttagccaggatggtctcgatctcctgacctcgtgatccgcccgtctcggcctcccaaagtgctgggattacaggcgtgagccaccgcgcccggccgagtatctttttatatgcttatttgccacctgtcttctttggtgaggtatccgctcagatcttttacacccccctcccgcccccatttcaaaaaatcagatggttcatttttttcattgttgagtgttaagatcttgttttttgatattttggataacattcctttagcagatgtatctgttgcaaatattttctcttagcctatggcttgtcttctcaatttcctaatagtgtattttgtggagcagaagtttttaattttaaaaaagtccaagttgtcaattatgtctttcatggaccatgtttttggtgctgtatctaaagagtcattgtcatacccaaagttatctagatcttctcctatgttaccttgtaagagttttctagttttgcattttacatctacatctgtaatccgttttgagtttatttttgtgaaggatttgagagctgtgtccaggttcaatttttgtatgtgagtgtccaattaatctagccccattcttgaaaagactatcttttatccattattattatattatctataatattatctatgctctttcattgaccatatttatgtgagtctgtttctgagctctctgttctgttccattgatctgtttctctcttcttttgccaatgtcacactgtcttgataactgtagttttttttagtcttgaagcgggtattgtcagtcctccaactttgttctccttcaacatcgtgttggctattttgggtcttttgcttcttcatataagctttagaatctgtttgttaatacacaaaaaataactgtgggattttgaataagattacattgaatctataaattgagttgggaagaactgacatcttgacaatatggagtcctttttatccacagacatgggccatctttccatttatttagtttttctttgatttctctcatcagagttttgtagttttcctcatatatatatgtgctaagtcccatggctaatgccctgattgcctaccaatattcatttcctcttttttctttatatagaactctaatttgatttgggactatggtgcatctagccataaaaatttaatttcccaggctcttttacagctatgtgtagccacccagccaatgagatgtaaatggaagtctctgtaacagtgtttgtaagaaatctattgtttttctgataaacaatgccagactcagctggcaaatgttttttgttctttgacctctcctttctttctgctttgaatgtagacataatgcctggtggtatggcagccaatttgagaccatgaaaccacagcctgagatttgccaagcaggaaaatacaaggaggctggttgccactctaagtggcctaatccaaatgttattggaaaagtaacccttatatttgtttaagctgctttgttacatatagacacacacaattgtaatgatacacaagcattcttttggtccttaaaacagtttttgaggtagacatcattattttcactgtacaaataagaacactgaggcacctggagttgagctgttctcccaagttgattctgtcagcaagtgtaggagccaggatttgaaagcagacagcgtgacctagaacacatgggcttattagttcaccagatgtctgtggagacccaggatgaggtaggggtggggagagatcttgccaagctttgtataaggagtggatttagagttggatcttgaaatgagtaggattttgacatatggaaattaaaggaatgaggaggacattgaagatggagaacaaggtattgcctgagtgtggagactagtagattactggctttagcaaagggaccagaaggtcataaaactggagaaaagtttttaacagcaggttggggctacatggtgaggttttccaaatacaagcctcaaaagtttgaattctctgattcatagagaactactgaattctagccagtattgctcagatggagcacttcaacaggcatatttatgaacatttcccaatatgatcacaacatttagaaactggaattcatgtgttttattatccttacctgaactatgtttttctttcttaaaaataaacttcagatgtcagatatagatgtgcagtgcatgagtcaatttagaaaattcttttcctttaaatggctgccaccttgtggataaaaagtccttagtgcagtggttttgaaactaaaactagattggtagaaatttctcatagctagatagatcttgtgtttcatgttccatctgtgagaattctgtcataaataactttatgcaaaacattttatgtgtgttgaatatatgatcatttaacagctatttatgctgttgtatccagttcatttgatgattataaattcaagattctgataatttgccattctgtaatactatacaggaaaaaaaaaataccaaagaaacaaactataaagaagggaggaaatgtaatcatttattctcataaatggtattagaccactctaatttgcagttgtacaagcgcttgttttgcttgcaaaagcgtgttgttcatgtgcacacatggtatgtgtgtttactaaagaccttagttgtctgattttaacatgctcaaatccttcagtccactgtacacatagaccaagaagcaggtaattaaaaaatctccttatgcaagaaatgaagaagatagctttgaagatctgaagatacaaaattttctgaagatgccaactcacttgatcacaggcaggagaaaaaaaaaggtcacactgagacttaccatggctgttaaagacagtccctaccagccaccaatccaagaggctaggtataagggagagggaaaataaagagaaaaagaagacagaattgagagagtggacatctgatgatccaggaggatgagctgaagaaggaggggcagggatgccctggggactgtggggtgtccctactcccaccgctcagtcccagctccaccctcccagagcccccatgtgaggtgtgggcactgactgaggtggcccacgtcatcatgctctatacagaatctcacctcaggtcccattctcctcctctttcaccggattctggccccatattctgcctggagaccaggagtcccagtcttattgcagtttagagggtcttcattggagatcatgcaaattctcctgtctgctaccaaccctgcttggattggtgaccagaggacatgttggcacacagtattcaagagtgcctcctaccaggagggtgattgggccacctcatgactgaattctgacataatttctcctaccaggtacccatccccttctcctgcacttgtgggttttacactattactttgtcacaccattctgtgtcaccctaaatacagccactggtcggttcttatccccaccaaaatgagtgtagagtttcagcatttggaatgggaatcagtcgtggccctctccttattcatatgaccttgcctgctacaaattgcaggagatgttcctgggccagacccaagtaatgagatgtgatcatctcattacttggtgaggtgagactagaggtgacctctctgctagcactgtccaacatccctcattcgagaacagccccttgtgttccaccacctggaggtcaggcggggaaagaatcctctatacaggtggttctgtgaacaagaaacattcatgcccccacctaagtttgctcctggttgcatcaaaacctgtttgcaaatctggagaagccccagctctacaggtgagctccacccaagcaggtgagcgtcactgggggtagaggcaatgcccaacctagtttggcttcttttagggtttcctttccccccacttcccccagcccgccccatcccgcccctggattctggaccacttggctttatgtatctagcattttcttgatctcttgttattaagacattttgtcttgtccactgtttatgcctctagctgtgatatgctcctccagactgatgagtgactggatgtgtcaggccactcacattagctcctattcccaccctgtgtgctttcagatcttggggaacatctcttccttcctgcaggtggtccttgagtcacccttcttcctatctgtcctggtttgagtgtcagactacatgttgatgggtatgtttctgaaatacctaaatataatgcttggcagaagttaaatgcagctgtcttagttgttctccataaacctgtgtgtttgagatccctttttttctgcagaggttgttcttttggccagtccttcgaggcaggtgacagataaattcaccacactgtaaatcatgaggagacttgacctttgatttcattgctggccaaacacaaattccctggaaaaatatattcgaacagtcagtcaccaaagagcaacaaagctgaatcaaaagcctctggtacagtgaggtttgcaaacactggttctgtttccataagtgagaacagctgtcctggtagggtttctttctccaaccctttaagagcacttagagattttctgtgctaaagcatattttagaaaaacttatgttataatgagtggaaggaaaaaactacaaaacaaaaaataaaaaaagacaaaaacaatcgccgtatgggtttttcatgtgcaggcttctggaagtcagcctgctggacatgtaacacatgctatggaatattcatcttgtctctctgtgatcactgtctttgtgtttgctattagtgagccttggaggttatcataaataccagttgtgtgaaatgagcgcaactgacaggatttaaaggctaaaccaacctttctaatccatctattccccattctcctccttaggccatgcctcttctgcaagactatacaacatccttgctcctctgatgggagctgcactaatttcgtgaatgtcagtcaaagcctccttccttgaggagttggcgaaagacgggtttctctttctgactagatggaaaaggagatataaagatttttcagaataagatgagtgttggtatttttgccacatgtgcttaactttttcacttctttactttgccacttagaaatatagagtccttttttctttcttataaaattagttaaaattgattctgaataaaaaacatgtgtagagatcaattaattcattagcattttaattaagtaacttcatgaatattgagcaacagctatgtgtgctgaacattgttctaagtgctggggatacaaaatagactaagtccctgctctcctgaaacttatactgagcagagaaaaattagcaaataggcaaaaagatatataatgtgaggtggtaagcactatggtgaagaataaaacaaagttaggagctagggaatgatggctgttcaggggtgggttactgttctacataggatggtcagggaaggtatctcaggtaagacgttatctgaagtatatgagggagtggcccaggcagagcaaacaactagttgtaaacaccaaggtgctcagcatattcaataactttttaggttatagtggagactttttggattttattttcatggagatggaaagtcttcagaaagttctgaataaaaacagtgacatgatttcatttgtggttttaaagaaccagtctggttgatattattaaaacagatagtgtgagtggacaaaggagaaagcagtgcaactagctaggaggtgattacagttaagtttaggaagaggaatggactggactaaagcagtgattatcgaagtcatgagcagtgattgaattccgaaactattttgaagatagaaccagcaggactggctgatggattcgatataaggcctaaggaaaacaagagtcaagaatgaccctgaggttttcaaacctaccatccagtagaaagagaacctatagtgatgcaggaacaagaggggagaattgcaggcagaaggggttgggatcaagcacacaagtggactgttggggagagcaaaaggtactgatacagatgtaggtagataggttggtagatttggtggtaagaggttttcaaagatcatgaagtgaaaatccagtggcagagaaggagttggaggcttgagaaaggagcgtgctgaagtagtagagtggaggggtgaattgactagtgcctccctgtgcatcagagccactcaggacacttgttaaaaacactagttgcctcaccctgaaacttactgattcagtatgtctgggaggctcccaagagtttgcagtttaataagttcctaggtgatgccaatgctgctggtccagagaccagattcaggaagcactgggctggggaaatgggttagaatggagggctggggcatcactaaaggcctccttgcacctggcagtaattcatgtgaattttgtcaacatggtcgtgtgccttttttccagccctgatcagctgctcaagagctggcagcagtaggtagataattggacttaacaaagtgaaaaattggtatcaccaggatacttgggaggcattacctctatgtgatgtctttgtattctgaaaatgctagttgaacctcctttattttaaatagaaaggataagagaatctgagactgagaaagaggaaaatggaagtttgcgtatgaagcttactgttgtaggacttagaagtaaaatggactaatatccacctctggtcttatatggcaaggagaaacatatgcccctttccctaaaatacctgtttctgtggtctactaaagagcaaaattctgaaatatactttgaaaaactaaaactcagttcttttgcattttataagattatatcacaaactgaattttaagagggttatgtttttctttgaaaatgtttatacccttctacaaaaaaataagtggttaagtgcagagcttcacacacacaaatggtatcagcacatgcagtaaagagaaaaattggctgttagagtaagggccacagctcattaatcagaacaggaagagaagaactgacttccataaaaaggaacagtgttaattgaaatagagtacgtaaagcagcaatttaaatatactatggtatatctacatattaagcagcattatatttttaagtgtaactgatagttttatttttgttaacaaacaaaacagattttgctggagccaggtgtgatccaggatgtgctagcagcgggcagtcacctacagctgttggagcttctcaatttatgctcccactatctcatccaggtatgtgagcttgcatcctgctcatacacccttcacattcctttccccacagtcataagctggcccccaacaactggagctgaatgacaggtaaagtgggggtggggtgtgggctgtggtagtagagtttctccaggacacaagctgagaagttcctaggagggcggctgcagctcttgcatccaatcacagaagcaggagtcttcctccactgtcctgcccaccttaggtccccacgaccattgagcagccgatcaactcagtgaccatgcacagggttccctgcaggagccgggggaggtgtcgctaaaaggagtcctagtccgaagcaatattgtctggttatggaaataatcacaaatgcaagaaaagtctaatagtcattgaagatttcagtaacagtatctagtaaatcacaaagtcctatgtaattaattaccatgtgaacttcccaggcagtaaatgccggagaagggatgagtaatgtgcgtattcctccctgatttgctggtcaggaaaggccccatgagaaggagggagagaaaacccccgaacaccaagcactgactgtgtgttcacagttgtttcacattcagtcctcacaataactttgcccatttttatagatctaaaacatcagagactcaaaatatatccaacttgtctgaggcaatatggctggtaggacgttctgattccaaagaccatttcttggttggatgaaaacttcttgttaggtaggagtctgtggggcatcttaggcagacagcatggctatgagtctcttggactttatagagtgttactaactaatttgcaattttaggatcctcccacttcccccactggtgtcaccttcacttgcatttattatagcattaaaaaattaatttgaagaaataataaattcatcacacaatttaattccactatctttgtgcatatgacatgatattagtgagcagaaaagttttgttttcctgcccaattactttattttccttttaaatcactttctgtaattttaaatgtatacttttatcattgacttctgttacctcttaggtagtttacaaagctctttctcatctagcatcttatttaatcttcccagcaaccctggaaaataggaaccagcacttcccagggagacagtgtgaggaaggtcagccatgttcacctgaggaaaattcaaatacagtttatggaattcttatgattatttgagcacatttaatctaacagtaaatggttaatgatttttttttaccttattttcctttcttttcctctcaatattgttacgtggtataggaaagctatttttaatccctttctgcctgtagcaaatgggaatcatgtagaaaggttataagacttcaaaagtgtgtgtttgacttgtgaaattaaaattacttttatttgacatttctacatcaaatattgcaacttgggctttacgcatcatcacctgattcactttccccatggcagatagtaatcagtgatgcatgctgacacagtttggttagagcgttagttatcatgatgtacattataaatggtgtgtatatgcaggggtgtgtgggtatacctaagcctataattttctgtaagtgagaattccagatgaacattaaaggtccatgggtattttcctctatcccatcagatgggtgatctgttgagatactaagtgacttgtatactttggaatttaacttctgcatttcattattgtgctgaggtaaaagtgtagcatgcatacatgcttgtggaccgttattattcaggcttcttgaatagtggttgaaattttcactgacttttcacaaatgttttcattttgtcatgtaactttactttttctttttatctgtgattattgcaagatgtcaaacttgtagaaggaaattttgactatatgagtatcaaaatcatgtcgacgtagaaaccttccttatttcagcctttaaaaaatatatataccctgcttctctcttaggattataaaaatcacagactgggtcaattcaatctacttttatattttgatatagtctccatagctatatctatttgctgtgttttggtaatattgttcaactgatttttaatttaatgtgggactatttcattgagtatataaaaataatattttattaatgtgaaaaattcccagtgcttaaaatgtacccaggaattgtgccccttcaatcaatgctgatatattctctatctttgtgtggtactttgtcaactaggagtttttgaaaccgctctcttcactaagatgtctggtattgttttgttgttcttaaaatgccattctttctttggtttctctgccagaggagtgaagggcagaccggctcaaatataccattgccctccagtgctcactacaaagcagctccaagggaaaccgttggtggaagctccctgagcctcaccatcctgcagttcctgtgaacatgtaaatggtgctgctgccctcctgaaaaggaaagggatacctggcactgtgtgggctcctttctctttcatttcctctggcaggctgctgagaaaaggaaccccacatggcaggagcagtgctcctctgtgtcaatgaggacagctatttaattagccccctaattagccttctcacaggttctcaaagcatgtgtgtgggaaaaaggaaagctgggcaatgtatttaatgctaattgatgggggggtgcctttctttaggctcccattaatcttgtctataggttacagtaccctcctgagcagtctgcttgtttctagcctcaatctgtggtaacccatggcccccagaccatcactatctttcccaagaaagggaaccacatatattgagggcctatccatgctgagtgttttgcagggactcccatttccactgctaagtcaccccttaacactggtgggtgttgttttctttttacagatggagaaacttaaattcagaactaggatgttgatctggcttgaaaactttcattagctaccctgatcatcattcaggtgcattatttctcccacaaaagtctttagcctcatcttcaaggccaggcctgttcctccctggcttcatctccagccactgtgcctttcctagcctgctttgttctgggccctaaggcagagttttcatattgggacttgccattaggggagaagattcattggtagatatcctcagtggcgggcagagcctctcagtcccctttagattgtaccaaggggtaggaatggggaaaacttcatacagacacacacacacacacacacatacacacaccatcacctctgctgatgcacaatgccataagatcaggaatattggcaactgaattttgtgttacatctcctgcaagtgatgcatcagaagctttgatgaagatgtctcttttttgccgttagctttccaaaaaagaaaaaaaaaagtttatacattttgtatcaccttgcccaagcatattatattgttttattaacaaccattctttatgtgcaccaagtatcattgtctttttaataatatgcaatttaaatgtattgataaacagaaccatcatgtagacttttcaaataaaaccaccaaagtactgaatacgcaactccctttttgataggaatataagtttaatatctattgctagacagcaggtggcagtgtgaatccaccagaattcagtagttaatttaaagcaaaaatcagaaaaaataatgaaaagaaaaattatttattttgctacatattagtcttctgacctaatcagtaaaaaagtcattattcacaccacactgggcaatatgcactgtaatttttaacaaataataggaaactgttaatgtgttcacaggaaatacagttttgtcttgggctgctgtggtcatttatcagcacactttgtgaaatcactcatttgttctaatttgaatgtaaatgactctaaggttttacaaataaggtgacagactcacataaatgtaattgcagggttcatctccctctttttatatatcactcattaggttatgaattaaatacatcgtattaaaccaggggcatgtccaatgatgatattgtaatggcaaattactctatgctattagaggtgtattttttattcatggacattaatttgtcattaagcggcattagtttagcacttttatgtgaaagacgtgacctgcaagaggaggcgtgctgctgggatgtgagaggctgggacgcaagggcgataggtagagcattttatcattgtaagggaaacagagaaggggggggtctgttgcatttgttttgttttctgtttttacagcatgaaagatcatttcctcagattgaaggcattgttctgtttacagcgtgcacatgtggatcatcgagtaaagcaaagcccaaattcttactattcttcactcagaagccaaggaggaacataaagggaacaggagggagaaagggtcctgccctaaatctccttctctgtaactgatgtttactcagcatcccttgtcttcgttaaattttacactaagtgggctacagtgaaaattagttattttctctcttcagttaaggtacaaaggtttaaaaaatgctattctctcactagggagttaaggagaattctgggtgattttgttcctttttttttttttttttgtaccaatggcaatttcagtaagaaactatgtttccactttcaattctgagaagcactagattcttgaaatacctacatcagggctgaaggtatctgagtgctgtttttgcatcattctgcacatggtttaatgtagttggaaaatgtctcaccacctccagttacactgtggggctttcgagcagagggatcacaccttatactgattttatgccttataccctccctcccttcacatcgtgggagttcattatgtactgagggattgaaaggtgcctccattaagtaatttttctctgctttttaaatattaaaatttatgttatagtaggaaaaatatactaccagcctttcattagttttgcccactgaatacatttttttgttaaaaatactttcttcggggattaaatttgacactgaggagctcacatattttacagtattataatagattatcatttttaattaagtaatactacaatgacttataggaggttatctcttctaaacaatgtattattataattttaattattaaattaagagtatcacccaaatacataatatatagtgggtgttctgaagacaataacttctcctcaagattgaggagaagttataactcatgttcatttttcttcaacactgaaccattttttcccacattagagaagacaaatgattgtaccaacatatatatttaatgtactcataatcaaatgcactgagtgctgttccatagttcactagagctgaggcttttgtgtttggagaaagttaaagtacaaagtttggaaaacatattacaagtggtttaatcttttggattatttttaatcagcgaaaatgatcaaaaagggtggaaatgtatcagacctattaaatcatagccaactagtaattatttgttctaatcaagagtatttgctatctggcatgggtaatccagaatatcatatttgccaaataacattcatatttggctttgaaatgcatcataagatctgcagtagccattttagggtcccaattaatttttttcatatgctattatgttggcttttattccctaagcccacactaaaggatgtcaggaagcgacagcccagaggcacactggctggccagggaagtcatttcagcattttaatctgttatatggataatgtaggattgactgtatcttcgtttgtgaggattttaaagaggagaaagattctcctgaaagaatatctcttgaaagagttcactaataatattagtcatttcaaacctaagctaactgttgtcagctgggtgattttaaaatcactttcagtatgcatttttcttcttaaaaatgaagtgtttccaggattttattcatgctagagttcagaatcaataatcaaaacaaacaaacatcaatctcactgagttccattattaatacttggaaattggtggggggtgtgtaaaagaagatctgtgtttcatttgagatatttattctcccacccacccatctgtaaatatttctagtcatggtgaaatgtctctcctctttcctgaagctaaaccacctttctgctccttattccatcagttacgccctgtgtttcctctggttttgatttctcctactttactggcacttttctttcagtttataaataggatcaataaggcaggagacactcttcttcatctctcattaccgcagctgctccttgccctcactacccaactgtacccagtgtcttcactccttacctcctgttcattcttcaggcccattgaactcagtgttctgccttcattactcctcaaaagttcttccaacaaaggtcaccaaagcctccttattgtctgatgcagcaggcctttgtggtatcctaagtgactcctctacagcatttaaacaccgggagctgcattctttcctgctcctctctttctcggggctctctcctattctcctcctactcattttcaatacctttacaagtgttcttccattagctccttgactgtccctcaaagcatgggagctctgcatgggcacccttcccttctgctcactatcactctccttcatgcatctggggagggttactgactccagccctctctcctgagctccagccctgtatgttcagccagcatttcacttgatatgccacatgctgcccaaattcgcctttgcccagtctcacacacctgttcctcctcatcctccctgtctttgttaagggaccatcatctttctagtcactcaaaccttggcataatcttacactctgccaagacctcatgaattccactaaatagtgttggtttagccatttaaatctttctcagatatgctaccttctctttctcctccttgtcattgacgtcattcgggttgggactatttttcctggactgccctgcaataactcagctgcgctccctgcctgtagtctaatgctaatcaacactggacaatctaagttatttgtctggtccacaaaacaatttctttccctaaaatccaagctagctttccatcttttggttgcagaaccatgtcctttctatttcttgtctctataatgtaccctattctgactgtaccccatggacagcttgtcttagctccaggccagctgcctagtctacacttcggcttgggtatttctcaggcacatgacctctctgagtgtgaacccaagccagaaaaccaggagtcatcctagaatctcccatctccttgagccccacatacactgacacagagacctttcagccccacccccttaacttgttaaatctctctcattgtctctctttccactactactgtcttcaatcagatccacattacttattttatggactaaagcaacttcttgctaactgatgaacctgctttccctcttgccccattccagtacagaattccaaaattctgtttgatagattttgaaaagttttcttaatccatgaaaaattctgtttgattgattttttaaaaaaatcacaacctgatcatgtcatatccttgcttaaaattattcattatgatgaatgtggttcacatagtcttcaggatgaggttcactccttttaatttggtacacagggcctgtctttattatgaaatgtgctatctctttggctttttttttttttgacaatttactacccatgtgcaatgcctgttccacagtcattatgaactttgtgcatttccctgtacctaatcctcttcatacgaaacctccttttctgtgaattatttttccctcactttgtcaccttctgaattcctatttaactttcaagtacttggctcacattgtctcctcttccagagttgcctgatcaatctactcagttggaattatatcttcctcctcttctttaattatgggcaatcttctgggaggccatattgtttgtgttaatttacttatctgtctccccaagacataagtttatgtcccaaagttgtgtgatgtcggacaagttacttaacctctttgccccccaactcctcatctgtgaaatacagatatggtatcctatatacagtctaccttttagggatgttgaaggattcaatgagatagtgcatgcaaagtatcttacaaacacagtatcctacatcggtgagtgctctataaaccagagccgatataatgtggtgcttcacctgtgaattcctctattaattccacagttatcctcctacccaatcccctcacccctgtcttccctcatttctggaaatgtcagcaaattttctgcctacttcaaattgacaacctattggacaaatctgttcctgaaattttggggaataatcaccattctgtaaaagatattcttcctcttagccacttctctttgattttgctgaaatgcatacattgttttttagaagccacaaataattaaatgaaccgtcactttctctctgcctctgaaatttgaaaacatcatactgaaattgtactttaataaataataaaataatgctttgacaaaagcaacacaatacatggtattgacactttgtagacagaaaattttgttgtattgtttcccctgccctttctataattaaaacatctttctccatcctggtatacagaatccaagaaacaattggaaaagtctttcatctctagttctagtgcatggtggtacttagaaacacatattgtctgattggattccttctgcatgtaccataagagctccctatgatagaaactttgattataaagttgcatgatatcctatgcttcctgactagggaacataaaaactgtgtatttatttaaaagaaaaaaaatctgaatttttccttactgggagaatgctatccatgtgtctcatttccctccagctgtctttctttcctctggctttccttccagaggaaggaaaggagtgtgaaggggtggagacttctcttcccctcttcctcactgtctatccacaagtatcttttagaccaggctaccaacctttttcctgctgcacatcaaggggcatgtgccacaggccctaggaagtggctgcttgtctgtgtcatggacttggctccagataccctggcctcagtcctgaacattcagtataacgtttgcctacttcagaggcacagttgaaggcctcgggtcacacagtttgtttgctgcaacagtatatttatgcaggacagagtcattcctgtcttcactgaaatgcatactccagagtaatgattcctaaacttgattatgcaaggaatcatctgaatggatggctaaaacagactgcttgggccccactccagagttcctgtttcaggaggtctggggagggcctaagaacctgtattctaacaagttttgagggatgctgatgtctgaactagggagcacagtttgagaactcccgctctagattctgttgccacactgctttttatcaagtacctgactgttaagtcactgatattcagattttgaaagtgtatttgtcacatttagatgaatttgaattgctcctagtaacataaagatattgatgctatgtatgcttcatagcatccaaaagataaaaagcgaaaataatgcaaatctgaaacaaacaaacaaaaaaaccttccaggtctcactcttattcgtaataatgattaagacagtctgtaggtaagtgagggatttaaaaaaaaaaaacaaaaaaactactttattaagttatgattgacatactgagggatgatttaaagtctgcagtactgggctaattttcagcaatctgactttgtgtactagagcaagtagggaaatagatgataatgacttctatactattcttttaaacatttttaaactgattttgcctatcctggttcaaaaagtacagttattgaaattttagttttaaaaccctagttgctcagataaactattttcaattaaaagaaaatatatatatatattaatttcttatatatattccatattcattggcaatctccttacgtgctgagtcaggtttagtgaactttgaaacagcattttgcagcacgtagtgactggggccagaattattagttattgttgacggctatgtttcacttcctccctactagatttccagcttactagagaatttcccaaggaacaatataaaattattcatgagccttgggtattatgcatacaattgattatgaaaatgtactagtaacctaattgtagaattcctctgttacacagcacaaatgtatttaaataggccttgcaagactccaaaaattagagcatgctggagttttccttgtacttttgaattgctgctaatactttgttttcatttaatcaaattgtatcatatacatatgcatatcaatgtttgaatatatcattacatacagttgtccatacatatttacatatttatatacaaaatatgcctatatctctctgtatgtttatacatataaacatatctgagtttgattattttatcatattacaagttatctggcctgcattgtcaatgaattgctcattttttcttctataacaattagactttatcctatcaactctatgacaatgttgagaaaattcacagagcccttcacatgcacaataaacatgataacttctttcctatataactgatcccaaggctattaaaaggtttggattttgtttatttattggtttgtttcaacctgttccaaaggccagaccttaccgcacatccacaccagccccctttatgttgctttctctactcctggagtaccaacctttcctgcagcaccaggttaggtagtcacataataccttgatttataactcagttgtaatcaaaataggaaacaggtggaatcacaactgggtatggtgccttggatattaatggcttggctcagcagtggaatttctaaagccgtatacacttttttgtcttaattatgcattcattaaaagcttttatacccaacagaataaagtaaatattttttgatctccatagtgtgctcccagactgtagatttgcacagcggggtcttgataatctgaataaattgtatttccccaaggagtttatctttcaaataaggtcataaagaaatgcagctcccccatccgtagatttctccatgtgccttttctgctatgagtaatatagagcttgagaaccagagtatattatagtaatacatacttgcttatggtccagtataatgtctctatctgttctccctgcttatctccagtgaagtattttttgagtacaaaagaaatgacagctatggtttttgctgacactcatagaaaaacaatgtccatattagacattcagtgttttcttccctttacccgctcagtgagtatggactatgcaaagctatagtttaagtactgttaacagcatttgtaaaagggagtaatgatagctactgtatgttgagcatctactatgtagaaggtactttatctgcacttttgagaatccttatcacagatctggaatgcagtgtcacttttcgcaatttttagatgagaaaattagacttgaaaagattaaccacttcctgaggccatccagatgggtcagctccaaatcatgtgtttttcctacagctctaaactaaagacgccaccagtgccttgttcccgcagtttaccacccagtgaaggagacagggaaactatgaaattaggaacctaagtaaatatgcacaattaggtgtacttataatatttctaaatcatgaagactaagatggcaatgcacctcatggtgcatacgtatgctaaaagtagcacacagttctgaaaagttcaggaaatagctttttcccatctttttaggttgccatatttatctccagtgtagctaacatttctaggcacgtacctttatttaaatattaaataaatgtattaatatttaataaattatttacattgtaaaatatttaaatatttttagaggagcaggaaaatctatgtttttgccataaactaagaaataaaagcaataaaatttgaaattttaaagatgtggcattttttcttgcctacccactgtatatcaatcaaaacttgctaggtagccactttctgaagacagagaggaagatctaaagaactaaagatactatctgcacctttatgcacagctggagagagaagagtcaaacaaatgatacaaatagcaagtgcaattaaaagtcagaggagggaaagtcctccaagctggagtggcctgcctttccctggagatggaatctgatctgggttgtcccgcagaagggaagggcatttatattacagaacttcccctttctcacaagctttttaaagtctactgaagcaaacgatgtctttaaatctttcacaaataataatcatttgtgacaaaagagtctcaaagttctgcttatggtataaaggaaaattaatgtgaattcatttgataatgtctgatttttttttttggcaaacagtttgcacatttatctttttctgatcatcactaaaaaccaagagaagtaagcttctttttcaacattctggggaaagggggaaaaatctaacatatagaaaacaaggagacccaagattcactgtggaagtcaggcctcatgtatctggcaccacaagagggcattccattttatttcccaattgtatgaaaaacccagtacctagatagcatcgcaagagactttctgaagctcagattaagtacttaagaacacttttctcagttaattgtgggagagctgtttattttgcccaactgttaagttgtatctataaccaagctattatttcctcttttcatgtaaagtcatagatgtgcctcacaactgtttgcttttttttcattcttgatccaacaaatacttctctgttgcaatctatgagaaagacattatgattgacattgtgcagaatacaaaaagcatacgatgcgaaatctactttttactagtttactaggtacatttttaatagtttgaagataagctacatgcatgaatagcttagtgacaagcttatgtgtatgtgataggaaacttgaagtgggaggcattagaattcattcagtgataaagagccttatacttaccgtatcctacttgctacttggtccttataagcagctgatacaatttttaaatttcactttgacttaacattgttaaaaatcaaaccatactgatttttatgtagagtggtttctcaggctgtttggaatagatttgggagtggttttaaaaagagaagttcttgacttacagagccaaggatggcctttcatttagagaaattttcaaattgtgatataaaatcaacattttatataagaacttcatgtatgctactacatcatgggcatagaaccactatgtctcctgcctatctttatctatagtaaagtatcgacatggggtaatttaggtgacatttcgaaggagagttgtctaagtgaagtgcatcaataattggaaatgaaagattataattacattgatgaaacaaagcattgttaaaatagccacatctgttgagtgttattacccggaaaaatctgtaatcctattcaatttggacatcttagagggggaaaacttgggaaatcaaaatgaaattactcttgttttaaccttgagaggagtttattatctttaacccaagtcatagttttctatagtgatagtacatgatgcttatttttctttcacacgtcagtggcattctcagaactagatgagacagcaagagaaataggtgtttttaaggctttgttttgaagggtgcctcatctagttttaagaatgtcaaaacacctatttttaagatgactgcatccactgtagactaactccattatctaccccacaaacagatatcatataattatgcataatgtgtataatttctgtgtcagaggcatgattaaactgcagtgtggatgggcaaggggttattgacaagccagggagccacggcggtagccaaaactaagactatgtttcagaaattcagatgattctcagcttgtatcatcattggcacacaagacacagctcttgagcgtgacatccctaagctaggctgtgggttatgtgtggtaaatatgcagactctaggcataaggctgcatgtttttctctcattcaagaaggtatagtagaatacaagtgagtctgggtggcattatttcataggcttaaatctactctaaattataaacaaagtacttcttgtatgaactttggtcatttattagtagttcctgcataattgagatattgagagacaccgcaaaggccatggccactctgctgcagatgagacccaccaggggacatcaccgaggccaagactcctccttctcttgctgccttcactggcttgggaagggtgggctgaaaggccacaggatcaacactgtcctcaaactgccctccttcctcccattcatgtcctaactgctcgataattgccttgcaaatgtaactacacttgaatataaaccaaaataaaacaatatttgcctttcccatatttttacccctaccgtatttggtagttaatctggggaataaccattgaaggaaccaattagggaaagaggccacacagaaagactgagtttggggaatatataaagtttaaaaattattgaacttgaaaaactggtgtttattccatagctagtgtggtattgaggacacattttatggctcctcttctcttatttaacttgtcattcacactatgagaaacaaatagaaggaataagagaagccaaatagccctaaaccaaaggaaaataaatactatttaaaaatattccctaaagaacaacaatgtatgcaccataattctgaatagaaactaaatttcaagtgagaagcagtgtgacagaaatgaaacctttttagaaaaaaaaaagagtaagattttcttttactcaagagagtttcttgttgctgagctgtaatttccattcaaaaccactaccgctacctggatacttacatttttaagtcacagaatgcaggagagctgagacaatctcgtaattaggaaaaagtatcatttgaaaagatattaaaatcttttgatctaagtagccaattgatagaggaaataattctctgttggactgtaaaagaaatttggggtggattgatttttttgtcacagaagaatgattatattatacttgttcagtaacactttcaactctagtcattattaccaattttcccacgcagaaaacaggatgaccactggctttgcctttgtgtgtacgtgtcagaaggccagaaagagaaagggacaatcaggaaggcctgtgagatatgaaaaatggcctgatttggacaaggttcagaattggataggcatattggaaagacatgggctattctgtttttgcctaattataagtaaacagaaaaagctcatgggtattctttcattaaacacacatgtattaagcatctgctccctactggataccggggacacacaaggcatgagacacaatctttgcttccgagaagcttagatttggtagagggagatagatctgcagttaaagggtgcttgcagtgacaagtgatgtgctagacatatttgcagagggcagagtagaagtacacaggaagaggtggtcaatttgacctgacccagggaagttgaaaagatgatatggtttcttcattcagcaagtgtggcttgaacgtacctggcattgttctaggctctggggatacagtggtgaacaaaccagcagctccttcctcccatggagcttactgggggatcaggggaggagacaagcacattataaacaagtaggcaaataaatgctgaagataattataggtggtgacaagctctaaaacaaataagatggagaaatgtgattgacggtgacatggagaggaagggagatgtgctgtataggatattcagatgaaacaagggaaacacaattcctatcccataggaattttgctcatgctgcttctttggcttggagcatctccctgaaatcccaccatcatcctgttttaaaatgtagattttgttattattgagttatggtgaggccaacagatcaggagacaattaccattgaaaacatgatttgtttctgctccaataagagggcacagaccacacctccaggactgcatagggaagccccagggttggtgaggaggtagaaggagtgaggggggaaaagtggactagagtctttatagtggtatctgcaggaaggaagtgggcaaagcagggttagcaggcttatgattggctagtttgaaagtttccatgggttcacgagtgtaggggctggctctggttgtctggtacttggccctgggatgatggggacagaggactattgcctcctggagtgtagaagccacatagaggaggtgatttagagtatgggctctggattggttagtttgcatatgaaagccgtttgctctctcaaagaattggctagccctgggaggggcagtctattctcagtcagtgaaaccccagatgccagaacatggagaatacagaaataaaatgttgttaatatacatccccatcccaccctttgccaagtgaacaaaggatgctcttccttcaactctcagcatcaaacggcttctcagggaagcctttactaactttccactccaagtcaactccaagttagtcctttattaactccaagtcaaatccctgttatggacactcatagtcctatattctactctttgtagcttttacctcagttatagttttccatgtaattgtaaggttttttgatttatggccttctcttccagtagactatatatcccataaggcctagggcttgcctttttttgcttatctgtgttgccaattcctgctgtagtcctggcacatggtgtgaatgtgtaggttgttgtcatggctagagccaagccagggtggatagggttgctgcaccttaggatgtgaagatcgcagtgccccggtcatggaaggctatacagtgttactgagtttggactttttccccaaagcaaataacttatcagacttatcagtgggttttaaagagatgataaatatggtagattcttgtgaaaagagaggattgagagtttgctgctggaggcaggaatggtaatttaggacactgttgcaagaagtccagacgggatgataaggaacagaacaagaaatactaaagaggaaaaagagacaggactggcgattgactagatgtaagggaggaatgtaggccagcttttgggttcttgatgtgggtgtctagatgtgactgttatctaaaagaggagatacaggagtagatgcaggctatcataaaataagctcagtttaggctgggagcggtggctcacacctgtaatcccagcactttgggaggccgaggcgggcggatcatgaggtgaggaaatcaagaccatcctggctaacacggtgaaaccccgtttccactaaaaatacagaaaattagccgggcatggtggcgggcgcctgtagtcccagctactcgggaggctgaagcaggagaatggcgtgaacccgggaggcggagcttgcactgagccaagatagcaccactgcactccagccttgggcgacagagcaagattccatctcaaaaaaaaaaataaataaataaaaagaaagaaaaaagctcagtttggactttggacatgatgagtttatgactgtgggatatccaagagacagcatcttcttataggcagttgggaaaatgaattcagagcttaggagaaagatgtgggtcagtcatatagatgtggaaggcattaacttgcaattagtttttatcttaattctatggtttttattttggccaccccctctttccctgagttaatggtgtgccttattcaagacttgaatatttaaagagaacacatgcttcattttgacctctttgcatcagtgattaatcatggtttatggatcccaaacaacaatgctcaaatatactttattgttcttgctctcccccgcaacctactgtgtactttccacgtgccaaacttttatggtaagtgcttttcatacattatctttatgccaaccctatgagcttgttgagctcttaaatttgtacttggggaaggctgggtgccgtggctcatgcctgtaatcctagcactttgggaggccaaggtgggcggatcatgaggtcaggagttcaagaccagcctgaccaatatggtgaaaccccatctctactaaaaatccaaaaattagctgggtgcgatggcacgcgcctgtggtcccagctgctcgggaggctgaggcaggagaatcacttgaacttgggaagcagaggttgcagtgagctgagatcgcaccactgcattccagcctgggcgacagagcaagactccgtctcaaaaaaaaaaaaaaattgtacttggggaataacagagattcagtgactgacccgaggccccagccaatggtgtgtcaagctggatttgagccgagtctgcctgcctccaccgcccttgctcttctctgcctgccttggttgcctccaggtgcctgtggtggctgatggtttgtttggtcctaaatgcaactattctcttttttcaacatataaaagacttattttttaaaagtctagaagtatatatacaaaaacattaatagtgattatctctgcatggtgaaattatgaaggatttttgttttccatactttgtatttctgaattttatgaaatgagcatttattactttttataactagaaatggcactctttctataacagcagtaatttttgtttcccatccacagtactattgttgggcatttaatgaagtttattgcttcccaccttcccccatcacgttaatggaaaatttaaaagcagcattattggtgcttattttgcttacacatggtttaaccaaaaggacaaaaagcaatggttttgcttaagactcacaaagcccatctgccccaaaaggaggagtgtgtgctatgttgtcattgccttggggtgagttttctttttccttcagctccccactttatacagttatctgctgaggtgcaaactatgcacctcagtaaggagttcttgatactctcaggtaaccagaaaggggaaaagtaggttgaaaattacttggatttatagagtgaaatggatatctgatagcattatacattcctcaagttattggaaaactattgctcataattatattaataattgtaagttaaaagtgaggggaaagtaggaaatagcccactctcattctacttgacatatgcaaattttctttcaacaactgtactgtatctctgatttttgtgggggtacagtgacaaaggtacagtggaagctgtggctctctggaggcataattgtagagccctggctatgagcttgagactgcaggtaaaatcctcccaaatttgaagcatttctgcagaaactcttcaaaaaggtgggaagaatggaatgtctgaggctgagaaaaaaacaaagaacaattacaaatcatccatcttaggtggattcaatatagaattattcaaacaggagtcttttctgtgagatttcctcatttcctgagaccttgtatataaaactctggattttagttaagacaggatgggttgttttgacttaaagacctacttagtttgaagttttggaaaaagagcggagtcagtctgtcttcaaatagtttatgtcatctaatcatgaatcgccatttacctgcccttacgttatctttagtagagaaaaagctgtaaaatatggtaagggtagaaaaagcaattgccctcattagtaaaatgtctctagaatgttgcaaagtaacatttcagcccttgaaaccagagacccctttcactccttttattaagatgtctttaaatatatgggttttaagaggagtaaaatgaggaaaaattatgaattctagaatagctgttctctatgcagaactttataattgtgatttctttttttttttatactagccctcccatttctcccaccactgtgatgaaaaccttagtgagtcaatctgaatttcttgcctgctctttctcggatttatttctaagagatcttttttcatttttattttttggcacccaggaattaaatagctttaattacttggatctgtacagacttgctgacctctttaacctcactttgttggagaaggcagtgatcgatttcttagtgaaacatctctctgaactcctgaagagccgcccagaagaagttctaacgcttccctattgcctgcttcaggaggtgctgaagagcgaccgcctgacctccctgagtgaagagcagatctggcaggtaagggcgctgtgcacggtcgcttttggcactgaaaaagcatgccgtgattggaagttaaaggactgaggaacaattaccactattttagtggctttggtcctcatggagttgttttagaagtcatgcttccttgatggacaagtgattggagaacactggcccttgaggctcagagccctcagcggactctgccgcttaactcagggaattgcaggggcaatccatgagaccctcactgtggcttcccagaacctaacgtggtcacatctgagtcaagggatgtttttttcctgataaaaattgtttcttaaacaaaatatgacaaaaaaatggattgtaaagtgatatatatgcatatttaagaccaggagaatcagagtaaatttgggcctttgctgtaaacaattcagaaacatttctttgttgcaatagagagcagcttggatctcgaatgaaatgaagctcttcttgcatggcagtggaaaaatctccatccttagttcattctgcattcattgctattttcctaagccctgccttttcgcctgacatagcattcttttcacattgtgtcgctcccttgtctagaggacaggaggatgttttgtggtttgaagttgattattcaattaaatcctcttctgctcatccccagtgactattccttgaaaaatccacttggtgtctttggggaatagtcagagagcctatcttcctcctccatattacagcctgtctatctcactctctgaagcactggctagccattttgttacttgtagggtgccatgcctccaagatttcacaatcatttgaaaaataattatatacagactaccagggaaaatttaaagtcttctattagctgattaaacagtgaatccctggtatcttatcaagtaatatttagagagtattttaattctggccaaaattgtcatataggtagctgttaattattcagtagctaactctactgactgattattttcctgatgcctttctgccttatttcattatttgtgttactttaatcagtaacttccctcttcattattgcttccaccagagggaattaaagagctgcagcgtcctgaaggccttctgggtcccaggctctttgcaaacttattgacagcaggcctgaaagaatggctattatcactgcatgtaccagatgaacaaaatgaggcttctgtgccttactcagagtcacagagcagagccagccttcaaatttaagtctgctaacacctgcccccatgtcttcaatattccacactgtcttgataaagaaaatataaggaccaaaaaaacattaaagaataaattttttgtggctccttgggtatttctggtaatgtttgttcaggcagaggttgaacaggttgacaaggatctgtttttggtagaaatttcaattatctctggctctctcttataaacacaaatcaacagaatttactttggtcaattcaaaatgggaagtagtcaaattttcttcacttcccaagggaaaaagaaagatttggaatgaatcctgcatttaattttttctaactgaattgacatctgaggctaaccatccttgtggcttctatctctttttgtggcgcagttgaaggcactgccagagattgacgtggtaatgtgcagatggctgagtgtcaagaaaattccatactatccacttaagagttatcataattgcctctctaaaggttactaatattataatgtagaattttaaaagctgctttctgctgcaggcaataatttttttaatacctggtcctcaagaaagaattaaaagactcacataaatattatcaatttaggcattcagcaggcaataagaaactgtttttgctttatcttagtaaataagtatttccctcatattcaaccccatagagaaaaatcaaatcagaccgctattttgcctcaagtatagttaagttcatcatttttgctgaggttatgctagtaatgcaatataccatggaagaatctaatattcagcccagagtagagattgggtatgccagaggattagtgtcagggtgctttatagaagtgaaacttgatggacaggctggagacagatctacagaatctcattaaattgctgaattgttcattacggaacgttctcactgtaataaagtgctcattgactttgacaaatccctatcccatgtcttaaagaagaagtgtgaagcaaaaggtgttggggaggagaaaggaaattggcacaaggtaggacaggtaatagaaaactggatggaggggggcgtgctatttgattaatatgtgcaaccagtaacttagatgagagcatggtaaacacacacacacttacgcaggtggctcttctactatgtactgataatgtcatctgggaccatcccatatttggtgaaaggtctaattttcattattcaccagatttcatgcagtctggctctgaagacctgtcataagaaccttcaaattaacctcaccgaaccaactctttttcactttttcctgctgttccttacccaagccctttccttgacaaaatgtgttgtatgcaggccacggtaatcattctgtggatctgtgaacctgtaaaataccccaagatgatgccttggaactgttcttttttttccatctgacctttctaagctttattctgagtctcttctctcacagaagtcttcttggttcctcctagacaaattttcatcccttccatggtctgaaatgacttgatctgttggttaatttcactctatatttagaggtaacatagagagttgttcacatacataccttagatggataaggacatagaagttccctaaaatatattgtttttttaaaatttagttcaattcagctcaacaatttggttttatgtttcaaggccagcaatttatcaggttccagatgaaagacaccaaattgactattgggttcaaagaaaggagactaaaactgaacaaatcagctgaaatggaaatatgggacattaggtcacttgcctttgtgacctggcaaatctctatctgtttgattttgctttcagatattagctcccaattagaacttcatttcagtagggccctgttaaatatcttctgttagattttgcatatattttcagactgatgagccagggtcttaccataggagctggggagtgcaagaaatggggagatgttggtcaaagggcacaaaactttcagttagaaaataaacaagttctagggatctaatatagagcatgggttccagggatatgttaattaatttgattgtggtaatcatttcccagtgtatatgcttatcaaatcatcatattgtacaccttgaatctaaacaatccttatctgtcaataaaatatttttaaataaataagccaaaacatggcaattcttcataaaaaaaacttagaacaacacatagaagtaattctgtatcattctcatgatcagatctgttttcatttccataggaagtgctgagtaagctctgttttcttttcaggaacatgcatttcctgcctcttctgcctttaggttctctttcaccagagtaagagggagattactgttttccatggaagtacaatttgtagaaaaagcctatatagaaaaatataacatcaattcttatacacactagcatagggagaaagtatggctctccacccatcagtatgtactgagcacctactaaatacccaaaattatgctagagtggaaagaaggcagaggacagatctgccaactccatttccctcttccaggcctcctcccaaatggagagaatcctcctgattttaaaccataagtacagctctctgaatttttattttatctccaaagtagcagaaacaagaaggatatttaaaaatgaaagaaaacagcttgtggaaataaaaatgaatatttcttgaccacctgttacgtgctaggcatagtgttgggagctagattctggggtaaaatgctttacaaaaatattcagtagttaggttaaggaaatttatttcacctttatctctgagtgggaagttttgttttcctttaattattaatgtattaactatttcttacttttagtgagaacttattattttgtaagaacagtccttttctgggtaggcgcggtggcttacgcctgtaatcccaacagtttgggaggctgaggcgggcagatcacttgaggtcaggaatttgaaaccagcctgcccaacatagtgaaaccccatctccactaaaaatacaaaaattagccaggtgtggtggcaggcacctgtaatcccagctgaggcctggaggctgagataggagaatcagttgaagcgagaggcagaggttgcagcgagtggagattgcgccactacactccagctgggatgatagaatgaaactccagctaaaaaaaaaaaaaaaagaacagtacttttcttacttcattaacctgggggttgaggacacttcctacttgtattctgagtctgactttgcctggacttaagtagatattaagaccaaaaaatttgctggctatgtgagtggcgtcaaacaaggtaagacctcagcagggagggtttcctttattctattaggttggtgcaaaagtaattgcataaacccaagttatgtcctattttagtgtggcaaagagggaccatgtcacctgatttggggctggggcaatcctgttcatatttgtccgtgattatccatccctagaggcagaggctgtgctgtagtgtttgcattacctactgcttgcactctattaataataaataaaaacaacaatgtagagtttccatattaaaatgtattgaatggataataagacatcctactattcctacattaggctggatttattctaagaaaattgatatagaaaatgagtttggccttttaaagactgcatttttccttatatttttgttggaaatttgcttccctaagtcatactcttaataacacattcattttatatcttgagagacataagccacatattgtttagtcaacaatctcaaatgcagtggtttttttgacacgctcctcctgggcttttatgtataccacagaatcagccacgttacagtttgaattaatcattttcttcaaaaggagtcccagaagtgaacccaaacaaaaagctactatccctttacagttggaaagtagaagacactggtgatgtactcagctttcatcttttatccttcgatgataaattgacccaaatgtacctctggccaggaagaagcaaggaatttaaatagtactagatgtcaaacaatactattaaaatacttccaatttgaatatcacatcacagttttgaaaatgcatcttcatttattattgctttgttctcctgtagtacaaaagggaaaactgaggttacacatctaggaatcaaactcatgtcttctaattcttgagctatatctactttggtctatagcttctaaatttgtaatagaagctcagaaatactcaggcgatgggcacagaggtgcatccaattaatcctatgactttaacaggaattaagaagggcttgattagctgggcacagtggcttacgcctgtaatcctagcacattgggaggttgaggcaggctgatcgcttgagcccagaagtttgagaccagcctgtgcaacatagtgagacccctgtctctacgaaaatattagctaggcattgtggcatgcacctgtagttccagctacccaaagggcaggttcacctgagcccaagaagttgaggctgcagtgtgctgtgattgcaccactgctctccagcctgggcaatagagcgagaccctgtctggaagaaaaaaaacaaaacaaaacgaaacagaaaaaagagcatgaccattctagttcccttgggtagtgcccatggattgaacaaatcatggcctctgtgcctgcctccgtgtctgtgtcatgttgctaattctaattctgttagatgacatatgcctcattcattctttcattcattccaaatagttattgagtgcctgctctacccagccatgtcctgtggggtactactattgcctgccatatgacgggtgctgggtagtcagtaatgggaagcaccaacagagtcctgctgtcatgggcctgacagtgtctgatgtggggctttccgcttgctgctctttcccacctgcccaatgccttcccagtggggactgacctgtgccaaatagcataatgatttctttgccaagttggggcacgttgaaatgatatgggtacaatggagatgacatgcttttgactggatgtttcaataccaaccagtgacccttcgccttttgttcaatgctttgcttattgttaactctcgatagttgtatgcaccctctaaacagcttcgcaaacctttgtcaatccatgtgatacagtccaagcctcaaacaaatcaggctgtgggtaaacatttaatcaaaaaattctacaagctgtgttcatgttttaatatttggaccttggtaactagaaatagaataaaatactaagaactcttatcctcaaacaaaattataatttttcatcatgttcctgcccttcttcaattctctttctttctttttttttttttttgttgttgttgagatggagtttcactcttgttgctcaggctggagtgcaatggcacgatctcagctcactgcaacctccgcctcccgagttcaagtgattctccagcctccgcctcccaagtagctgggattacaggcatgtgccacacacctggctaatttttttgtatttttagtagagacagggtttcaccacgttagccaggatggtctcgatctcctgacctcgtgatccacctgcctcggcctcccaaagtgctgggattacaggcgtgagccaccgtgcccggccaattctctttcatacatgcatgtgttgttactattattttcccagatagctactttctgggtatcttcataatatctcctattttttaaagttaccatttcttaaactcatcaaattcgtacatgtggtcccaacttacaaatttgtaccacttcttaattttctttctgaaactttttatagtttctcccaactacatacagtttttttctacaaatgtgatgagggtatctccatttccttcttcttagatgttagtgaagagaataaacagtggctcctttgcatcccaaataatgttttgcccagaggatgttttatcctttgaggggcccctagctggacacagagtaacactgctatttcagggattggtgctcctagttgccagagcatatatttaatctttccttctaatctatatgcggctaactcctctgtgagggtgcatcccacagtagcttgactcgtggctttgctgttgtttgtctggggtatatgcctttgcaagacgcatgacatgttcatttcagaggggctttgctccagctaatcctcagtgctagagctgtgcgttgctgagtagctgtgaggggcagtgattatcagaaattacaggagacccaacttgtattcatgtgctgctgttctcatgagttaatagttttttttctttccttctttttaaagaatgagcacaacagaacaacaaggtgatttatgagatatgacatatttatgttctctgcttctaattttcattgtgattcatgttgtttccagactgatatttttgttgttgctgctgtgagaaggaaaaagatgactgtagaatattacttacgcattggtgccctgcagtaatattgctgctaacctgggttatcagggatttaaaaataaaacccaactataagccatatatgaggtagaaaccctgaggctagcgtagaagtccatcaataataataccaacaataataattctttacaagcctagagggctttatattttaaagcatttcacacatataatttctcttgagtctctcatcacccttgttaaggttgataaggcaagtatgatccaaattttaactagtgagaaaactaaagcttccagaagttcaatagttgactcacttcacagtatagatttcaatggaggtctcactgtattctcttgaaatacaccaactctttaagaaaacagaaactcaaagtaccttatatatctcataagtcaaacgtttttatatattactctgtaatgagtgagccagaagtagacatttcctaatacattaccagttttcattttcacctgttgtgagactttgtgggaagttgcaaaaatgtctccaataaagtcgtacaggaaagtgttgctgagggtctttcttgatcagagcccagaaactgaggctctggatggtttgataaggaagaatgcttagagaattctggcagagggagggaaccatcttttattccttcaaagtacacgatggtgtagtataaagcaggaaatgaaagccgataagggaggatctctttaaaatctgaccaagagacataaattagagtaaaaaagaacctggagtgccattatttctgttgcagtgacacagactgtgtgggaaaaagtctgtaggctgttgtccctatttgagaccagagattggatggaacaaatggaaatgattgatcattccatcttcattttatgcccaatatattgaaattttagaaatgtatgcagcataaattgacagttgggtgatggtttagatatggggttcaagagagagggtgaaagatataaatttcttgaaattgataaatgttagtctctttccaacacaaatgaccctgtgagtcctttttcttcaatgttaggccagttgaatagcaatgatgttcatgctaattggctgtgtcagaccatagagatttgctattctgggagttctataggagaggatgtaaatttacttataaagtgacccagaggctctagaattatttacattctaaggagatgtcaagagaagcctcaacatttattgttgaatactgacttccttagaagtgcttctcccacccttgcctccaaaacttctgctacaaggaaaaataacaccctgattcaacacacctggaggagaaaagtggccattctgagatcataatcaggagaagcattcatacatcattcttgagctttttttatgctcataatacagagttatgcattctccatggtgaggatccaccctttcctctgaccacctcctccttgttacgtgcggtggcatgttgatgaactgcaaacctattttgatattctggtagagaaagcataaccaggaagacaaattcagggaaaaaaagtcaatgactgattctaaagttatgtatcaaagattttgtgcattgttctcctttgtctataggaagagttacaagtcagtattggtaagtggcacggtattacttatgcttcaagaacaggagctaaaaagacccccacacaccagaggctgaggacacatatcttctttgtgtgtgttcttgttgatgaggaatgcccactaccttctctggccacacaaggaaattgggtaattaaaggagtgatggatggtgcgttaaagtttaaacgttttaggaggacctatcttattaacactttaaaacaagtgagcataatatcattaactttgattaattcatttgctcttaatatagcttttaatttgtaattctacgtgaattacaatgtaatttggcattaattatactaaattgactataagtcagccaatcacaatggaaaattactcacagctgaaactaaaactaaacctctccatccagaaaggacgatgcttagttaagtggcaaacacactttaggctctttggcagtgagaatgacattggacctgctgaggactgtaatcaatttctcattctgcccactgctgggactatgtactctttggagtgaagccccatataaatccaataaagtgtaaataatgaagtaaacaaaggggttgatttatcaggtttgccaggtcccctgaagaatctttttgctcttctcatctcatgtaagttttaggcaatgtagaggggctgtgtagtgctttagaatgattaattccacaccccttggattctgggagttagaataggcacctacccaaattggcctgcttctcgtcttcatgctctgtgaaacagctgggaaatcctgttttcgaccccatgtgtagtcagtatcctgaagccactcctatttgacctatacacaaaatgccttctaggcagaaggaagtcatgccttaaaaagccaacaccacactgagagaactaaaccctcaggagatgatggagcatgtgtcattcattgataaagcttgtggaaggtgcccgggagcacacaagaagtaaagtgatctgctgaggaatgcagcccttgagaaagtgtgtgtgagagtgaggatggatttggaaaatacatgtgtttgaaccatttcccagatagctttctttgacaactgtcttctgaaaaacaaaacaaaaactctgagattttgcagaaagtcatatgcaagatttggcaatattctgcttgaagtccatttacatgtaggtagaacgacatgaattttgtacattctagatacattcctggtgagcaattggctcataaaatgaggcccggttcagaggcaacaaattttgctaaatattgcacggaaaattcaagactgttattttataggtcttctttttaccttattagttatataccccatctcatcattctcacacccaacgtagctaataaaatggcataagttttatataaaaattttgagtaaagaggttaaaagccaccttggattctgagccaacagccgtcctgtcctctgtcacttacacatatgcaggtgggattcacacagtgcacacacttgcaggtagacacgcatgcacacacacatattagatgcatattaatctttgcagctaaaaggctttcctttgttttgcagcactgacctaaatcataatactcccaccattggctcgttggtctcagcattaaagaaaatagaaagtagaagcttattttcaccactccaagcgtatatattccattcatcactaaactttttaaggatgttaatgccaatagtttgttaacagaagcagctgtatagatgcagctttatggtgtttcagttctctccaaatcctttttatgctagatttagcctggcctattgcagaatttttaattccttttccccagatattctttttgatatccacattggattggtgggttccagtccctttcctaccaattgtggttcccaccatagcatcaagttcttaagcaaaaacaactcctgtttgaggcatgccctctgatggatgagctcttttgagctcttaatgttcttactgcttttagagaactgtaaggattttggggcaaaggaactaatactgaagtaagcagagcagtgagacggggggaaaacatttacaggatattcctgcccttggttttatcttctcatcatttaacagcagcagaataaatgggtctgctaatgaaacagcactgagaggttaggtcattggaagcctttttagtcattttgtgcttttcaagagcgaatttgttagaattatgctgaatacccacttaaagcctcagctgataaccctacctgtgttttataactctgcactgtcagaactcataataagtcaaacattctttcagtggtgctcataagggagggaaaaaaaccacgcaaatttaagagtaatttcagattgtaaatgaaaaggagaggcacgactgttcatttgcaccaatcatgccttcctttcatctgctctgattaggcctggtgcggtttcatcagactcctccatcaccgagctgtcactccagccgtctgttgattgaaaacaatcaaggctctgatggcacaattattctgaccctttaactagaggctgctgtgataatgaaaggttgattatgatagtttgtgcctctttcagtttgccaagaaggttaatttgggcatcagacggatgtttaatgggcgcttgctggctacactgaggtaaatgagaacgtgcagtcttggatattgcacggatatagtttggctgtcaatcattgtcatttggagtttgtgcctcacactctggaaatcacattttattttttccttgggatttaatttattctgtgccctgaggaagttctttcactcggtgaccttcacagcagctttctctgccttttttttttcttttttcaaatggagctcaaaggcacaacacatctagaagagcattttgctttcattttcacttaaaaatggaaactttaaaaatccgtccttatcactgccttccaatagagcaaatgtttccattccgattgtgcagtgggaaagtataaacgacagggatactttagccagtttgctaatgcagcagctcacacagttgttctgccctgtttcgcacagtaaccagcaaatgcagtaaattcaaaatgggcacatatatgaaagtgaaggccccattctatcactagcatgtctcacaacagtttgtagaattcctgcttccaaacacagcatcttactccttttaccctccttcttggcaaacataggggaggggttgaggaaggaagacagagatttgtctgtggaagcactaaggttttaaaagttgcaaatttcaatttgtataaatccagcacctaatcttgcagctatttgaagtataggctaaaaacgatacagacatctaataatgctggtgtttacaatgtgcagctcacattgtgttataatgagctttgtaccgctttcatgcataccctttaaaaaagaaaaatagaggaaaagaaaaaataaaggaaaacctttatttctgtctccaagctatgcatagtggtctcatcatatattaggcacctgagagctagaatcgttttgcctttttttatttgttgtcttcattatttttttttcctccaatgaacattcagcagcatatttttacctagcctgggacattttttctcacatgtcaattggaaaacaattaagtctatagatgttaaagtgacagcatcataattattgtaattttacttcaagtgttctattttcacattatttttttcttgctttcaaaaaaccctatttgttttttaatagtaaagagagtcattaggtgatcattcagtctcacctgagaagtctccaaaaatgaattaagtcattgaatccagttgctgttttaatgcagcccttatttaatgaacagttctgtttaaaatgtttatttaaaaaataaatgagaatgggattgtgtatatatggtctcacaagattcctcactgcagtacaccacaaatgattatttttttagctctataaaatagtaaaatagacctcagggatacttcataaaattattgctttgttatgtcttgtttttggttaagcaatgggaactaaaaagataatttggagagaagtgcatcagtcaagtcaatcaatagtttttgctattagaaaagtaatgcaaagtttaattttcatattaacttgtgggatctgtgacaatgaattattttatcttataggttcgctatgtttttaaagtaatgggactcaagcaaaggccgtttcatcttaaagaaagcataactcattttgtcaaattgtttctggtctaagcctgactgagttctgagtttccccacgtctgtactttttatatcaaagtcatctccaacacagagggccttcttccctcatacacctgcatgacatgactgccactgtcctgctctcaagcagactctgtccacccagactgcacccctcaacggtgatattcccgcttgggtcctcttgcctttcattgcctgcctgtgctggccatgcttctgctaccaggctgggcctgctcatggggcccagtttctttttcctcttcagtgtggccttctctatcttcagggttcaccttgctcttcctcctaatctgataaagaatgtttcagacctgtgatttccccagattggactcctgtgttctttcattcgacattgatggttctcagtgaggctgcaatacagtctttctctcaactatcctacagattctcttttgcaacagctactaccttctactcattccttcctcctccacagtcctctcttctctcatgagtcttctgagactatcaggcggctggttctccaccacagggctatctctctacatctctgacttctttgcatgactgctgcacgctgggctctctgggccacttctcccacccgaactaagccctgcccccctgtctctgctgctttgattccttacatgcttgatttctgttttgagacttatctgacatttattgtttgtaatgatccttgtggaacccaaatcctttgatatgactacctgggcattggcccaaatcttctctgaaatttctatttgggttaaaaaaaaaaaaaatctgtgatcattgtggtgaagagggtatcttcttcgataaaaatattatttgtatgatcagcttggccaacatggtgagatcccatctctactaaaaatacaaaaattagccaggcgcggtggtgcacacctgtaatcccagctactcaggctgaggtaggagaattgcttgaacccaggaggtggaggtagcagtacgccaagattgtgccactgtactccagcctaggtgacagagtgagactctatctcaaaaaatacatatataaatatatatatataaattgtgtgtactgtactcacaggtgttacaaagtagaaatagaggattcatagttccctagttttttatactatgatgaaatgaagttagagaaggcagtgcaaaatatgctttttcaacatcagtagccagactgaaattcacctagtacaggtagtcagtggtgccatcaaatttatgtatatcctttgcagctcactgacagtgtagaccctggctccccttccccagccctaccagctggctggcagtgctccttgtcctatccccttgacagtagagtctggccctgacagtgtttagtcctgtgcttcagtttatgggttcccccatgccagtctctgtgccccatggctctaaaagatgtttaaagttacctttgactattcttttatttttatttggaggctgccaacattaaatccttaaatgcaacttgggtactttctggacatctaaactcatcatagtaccacttgtttgagggatctgactgtccctatgtcagtgacctggggcagctgcttgagcccttgaggtccatttggttataatattgaagatttgatttcagatggtgagcacatttgccagtgaacgtgctcttgtgctcttggctcattattcttttttttttttttttttttttgagacacggtcttgctctgttgcccaggctggatgcagtgacacaatcatggcttaatgaagcttcaaactcccaggcctaggtgatccctccacctcagactcccaagtagctggaccacaggcatgtgccactgcagccaagctttttttttttttttttttttggtagagacagggcctccctatgttgcccaggttagtcttgaacttctgggctcaggcaatcctcccacctcggcctcccaaagtgctgggattataggcatgagccactgcattcagccaagctcattattcttgaatcaattcatgaacaaatattcaaaggcctaatgctctcaggatgcatgtttacaaattaaacagtttttttaaaccataaaatgtataaatgtgccagcaacatttaaaacaccaatgaaatgacaacatagaaagatgattcgtgtgcgtttctgaaaaatctgtctacaaaaggcttaaacttccagatttgcaggattacctccaacaattccaaatttcattagaatattttacaggaacatatcaagacactcaaaatcaagaataagcctcgagttttatgatattaatggaagtgaatggcaaatgagaacgttgatatacactgattagaatctttctcaccaagtttctgacatataatggacacttaagaaaacgagaagtgtttgtaatgggagatccaagccaagtgatgaaagtgacttatatgctgagtattgtacaaaaacaactgggtttcagtctgtctctcccttttcattcattcattcattcatgcattcgttcatgcttctccaacgttgaatttaacaaagccacagaacttaaattactggattagaattactgagtttatttgtgtgaaatatggttaatcataagagctagtttataatctgttgtgctgccatggttttattatcactttaaatatgtgaagtatttaatactgtatagcaaatttcttatcaactatagcaatctctcaaaatttacatcactaacacacaatgttgtattacataaaaatggtctgcatgtgatggctttatcatgaatttaaaaggataattatattggggaataccttcatctcttggaggcatattgccatcatataaattctgtacattgtctaaatatcagtttaccaggcaccttcacatgtctgatcgcattcagtcttccgtagaaccctatgacataggtattatcatacttgttttgctgagtatcagtatgttgataaaactgagtatcagcatgttggtttttcataaatgcacaaatatattaggttgcagaaatgggtcttttgacatcaagtcctgtagtcttttccttgtgtcagatttacctctataggcatataccaatttgtgatagaaaaaagcatcaggatttccctggccatttcagctgacttcaccctggtaatgcatccttattgcatgcagtagctaggaaacaatggggggtgttgtgacccacatgaggtcactctagtccctattgccaatgtgatacagaagggttttcttttattgaccaaattggttttctctcattttccagtgtagttatacaatataagctaaatacctcagtgaccacatgcaaagttccttcaacatctagtaggacatgttatgtaaatatgcaggagctatcattttatttagaaatctcatgtcatcaatccagtattgagtaatgctctgatgcaatcccagccatcaatgactagatggatgaatattgtcttttggctcagagactatgatcaaaccactgaagggaaattatagggtgttattctataactgtacatgtgttttgctcaaatatgaggagaccaagaatgggtttcatttttcctatggcatcattggcaagggtggtgctgttttttattgtcctgtaggacattttcgccatttaaaagttttgtatatactagatatgggatgggaatggtatatatacatataacttttattttaggtttgggagtacacgtgaaggtttcttatataggtaaactgatgtcatgggggtttgtacagattatttcatcacccagatattaagcctagtactcaatagttattttttctgctcctctccctcctcccccaccctccaccatcatgaaggtatatttacctctacgaggtaaataaatataaatataccattatatataaataaacatagaaatataaatatgcccattatatataaataaacgtatataaatgtaaatataccactgtattccctcatggagggaatggtacatttaaagacagtccagaggtaaaatatatgtgaacaatttactaaaacttgaatttatctttttttttttttttttgagacggcgtctcgctctgtcacccaggctggagtgcagtggtgctatctcagctcactgcaagctccgcttcccaggttcatgcgattctcctgcctcagcctcctgagcagctgggactataggcacctgccatcacacctgggtaattttttgtatttttggtagagatggggtttcaccatgttagccaggatggtctcgatctcctgaccttgtgatctgcccgccttggcctcccaaagtgctgggattacaggcgcccagccatgtataaaatcttattctgggattctaaccaatattaccttgaagcagtcaccttaataaatttgaaatttgtattctttggcacaaattttatttttacaagagatggtattattattcagtttcatgatataatctgatcaaagttgttcctagggagagtgactatgatgtaacctagttctctgcattggccccacgtgcatgtgcactttcatacatgcaaacattcacgcagacatttctgctgagcacagaattatagacaaaaaaatgtcaccttgtttttctgaaaagagatttatcaaaactctctgtgctacagaaacctgtgacttgggtactagattaattttggttgcctctaccacctctaggaaaattagagaattctactttaaaatatttttggtggatccataggtgacatatatcctagagaaggaggagactctctcatcaactaatttattttaaaaatgagagccaaataactgatccaatgtcagccatatactcacattgcccttttaatactggctttccaaagatcagcttacactggtggctgaatctcacaagtagagaagatatcacaggttattaacctcacctcttatcctatcttgattttctcttcatcttgatataaaatttaccttttaaataaatcctcttttgttattgttataagattgagcaaagggacaactcaggtcacttttcatgcacccccactaaatatctggaacttacatgtggcaggtctgagggtagtttttgttgtggttcttccagtcctgtgtgtttatccccatttgtgggaaatagacacctttagttgcaagggcttttcgcttttggaactctgaagtatgtactttaaaacatgtgtttaaagatgattaccagagaacaaatcttatgctaaaggtgaacataataacatttaccaatctttcaatttcccaaagttttaaaggaacaatgaaataatgtattattatcatctgtgataagctgaatattgttttaaaaatctgtcaggttttttttcttacagtatatgagcctcgggcctcatcagatttggttccattgaaatatatttcttagaagaaaaaatagcctatgtgtcttacataagtctgtagtcagctataatggttaatgtgcaatctcccttgaaagatctgtcttacaaggaaaatgttgacgcagttttaattatagcactcaggtgagcactgttataatttttaatattcctccatggtaacattttcattgttctggtaaaggaaaatgctctgatgctgcgtccctagtttctggtgcttttcgattttatgggaaagttgtctttttgaactgaaacttttcatttggtctcaaggaagagaatgtaactataagatctgtcacatttatttattagtatacacttttctctctatggcagttgctattctggtttatgacaccattatttcaccttacatgattcacgttaaagaggtgagcttctgtgtagtattgcatggcaaatcgcaacacctgctcacttgcattagggaaacatcacatttttaaagaaactgtatgtaatattaaaaggataacatgctaaagttttatgtttattagaattcaaggcattataaaataatatctaaaacaatgtactttaatatagaatgatcactgaactcttccctttgagaacacaaattagaagataaagagcatgctcgatactctgtttagaaaggaaaagattcgtctatgcatcatcatccattctattaaaacacgctttcctggcttcctacttcttgttgcccaagagctcatcaacatgccctgctgtttgatggaggttcaggagtgagtttttgacttgctcctgtgcccttcctttgtctttttctgaatttgcagaagtgtggaatttgtgctgccttttgtgcactgaggggagactggtgccctggcttacctcaatgggatgacaagactggtaaggatatggacacttgtgcctcacagcgtgggattctgcaaagagaagggctccgtgtgcaccttcagcagagctatctgcaaccagattttacataggaacataataatagctgcccctggccaaggagcagaataaaggctatgagcaaaaagaccagtcattgcttactcagctcttcatgatgagctctgtgataagaacatcctttcagtgaaagacaatatttgtagaccaagacaaaaaaaaaatacttgttacttttagacaatgacatagggctttattctttgttagcattgctttaaaagatttgatcactcatctgatgagagcctgctttttaagggcacttgtatttatatatatttgcaagatataaagacagttctatggaagagtgcaataatgtttattcttgaatttgggatgtcttcataattaatgtattttctggaaatcggagaataacattttcattgttttggcattcctttggggtcatagtgtataatatatatggatatatacaagcagttggaattcaaaacatccacttctttaaaagaatcaggaattttagatatcaaaacagcagcttctgtctgagtgtgtttcacatgaacaataaaggaattagaatcacaatatgaggacttgataatgttaggaatataacttttttcatataattgatatatttctgaaatacatatgattaaattgcatattttaattgaactaggacaaaatttgtagcatttagaattatactattatgtttaggattatatatcatatattctactctgtagagtagcaatcagtagggatatgctgagaaaactaaagggaagggattatctgttctgtatatttttgggtcaaatttagttaacaagaaataatctagaactaaaatacatttaaaaaatagaccgggtgcagtggctaacacttgtaatcccagcactttaggaggccaaggcagatggatcatttgaggtcggtagtttgagaccagcctgaccaacatggtgaaaccccgtttctactaaaaatacaaaaaatagctgggtggtaatggcgcacgcttgtaatcccagctacttgggaggctgagacaggagaatcgcttgagcctgggaggcagaagtcgtagtgagctgagattgcgccactgcactccactccgggtgacagaggagaccctgtctcaaaaaaaaaaaaaattaaatgtgaaatatgtattctcataaaaagggaagcaataattcaacactcaagacatgtccttttccctcagtatttgttctttaattacaaactctttacttggtatcataaacctatggtctttatttctgaagtaatccataaatgaggctcactgaaaaatactaccaacctattttgaagcaaaacattcttatttttaaagcagaatttatttttctaatttattgaatatagaagttattttttgggctgagcgcggtggctcacacctgtaatcccagcactttgggaggcgaaggcgggcggatcacgaggtcaggagatcgagaccatcttggctaacacggtgaaaccctgtctcttactaaaaatacaaaaaattagctgggcgtggtggcaggtgcctgtagtcccagctactcgggaggctgaggcaggagaatggcgtgaatccaggaggcggagcttgcagtgagccgagatcgcgccactgcagtccggcctgggcgaaaggcaagactccatctcaaaaaaaaaaaagaagttatgtttggacttagtgcatttgcctggattttcccttgaaataattattgatggaaaaataatggcaagtagatataattaaaaaatacatggtataagttaaaaacagtttctagttctagcttttctgctaattcattgtatgacttgggttaagtcggttaacttgtctggttttgatttccatttgtaaaatttaaaagcttgagccaagtggactcagctttcttcttgctcaaatattttataatttatttgaaggtttaaaacactgcaatgcttattgctttgccaagaatctcaaatagaagtggccaacaccaaacatgtgagggaagaaaacaagggcttatgaatctaagtttagggcactgtatgctgcagtgtggagccttgagggcttataaaggccttataagaaagccataaagatgagataataaaatagaaaactgaagcctgtgatagataaataaatatgtgtgtatgtatgtgtgaataaaggatttgatactatttgtttgagagaatctgagaaatagcctaaaaaccgaattttccatttatgccacaaatatgtatagcaaactgtgggtcaggtgctgttcttagcaaatatctgaggatcaattggtttgaagttggattaagctgtagctaatgttccttttaggaaggaacaattctccattgtggtcagatgaattgggtcaggcagggtgcttgagagacctcctgttgtacatggaaatgacggtctgctgtgttgcaggtggtttaggaaatgtcttacctaatggccatgtttcctaagcactctttcgtaatgtcctcctaaactgaatctgttgtttcttttccactcttgctggcttggccaccaaaaatgctgcatgctccattttcttccccattaaatcctagagtttatggtgatagggatttcagtatgccagaataaataagatagaataggattcagcttaccctgagttgtgctttctcagtgtaatgccattattttaaaagccaccagttccaagaataatttttttcaagcttaagcaccgaaatataccacaaagctaactgttgtctttgggttttatgatgccccaatgataaatcagctttcctcttactgtagtagtctttaagctccttaaatgggctccaggattccctccaccagcatggcagtgaataatgttagatgaggttcacagcacagaggtgattttgaagtggcccattgttttgaattttctttgccattttttaattatttatttgaataaacaagagttatctgtgatttcagtggggtttctcctttagattcttatgaacgtaaaaacagagcacagtaacacttttacatttatgtgtttattattgcaaaggcaaaaatgcagagtgtttctatggcttactttatgttatcagaatcagccatcgatttatagactgtatagaaccaaggtctcaaaaaatgctacctcatccgtaatattaagctaattaagtatcttatatcataacttaagcattacttcaacttcactggatttatacctgcttaaatttaaaaaacagagtgaatttcctctgataaggcagcaatttaccatagtggatggaacagttaataaatacagcttcgtagagtaactaaattcatgacagcctgataggagaatactgttatgaatggaaatctgtccaaagccttcctattcaaagtgtggtacatggaccagtggcatatgcaacaaggactttgttggaagtgcagactcctcatcctccagtcccccacctgctgaatgagagcctacattttgaccagaaacccccgtgtaatttgtgtacatgttaagtttgtagttggtgacaagatggttagttgtaaattagattcacctttgatctggaaaaaaatataaacccaacaagtagggatgacttgtatagtctgaaaatattaataaatgataaaagttgaaagttatatgaaatctatgagaagttagaaatgttggaaagaaataagataaaaatatctcagaaaatgcaaactaatagttatgcacaaaatattctgtaatacatagtatttggagaaattgaacacagaaagcatcatgacacatgtgatgtgggatgatagtagaccacaaaccagaaattaatcagtaatagatcacagtggtcaccgttccatggctaattttattctttagagattttcttaaaagcatagcttagttgaggcttgtgtgcttctcacgcagttagtaacactgcttgctggaaagataaagataaaccggagggtgttcagagatgggccagaagattgattatggcataggaagagctgatttatgaggagagagaaaaataattaaatgggcagcactatgctataaaaagagcctatggagacatggatatttatctaatgtctctagtgctgtttccggtagtatctatgtggatgcagaactgtaaggatataagaatgccaagaaattggttgcagagcaaagcaatatcagctagaattacttgactaaattaggaacaatagcaaatattacgtttcagaaatttttccctggtgcataagaaatgaccttgagctggatgactttatccctgagaacttttaaaaacactgtgggcaaagagtggaaaattatttatcaagttgctgaacaatctccccagaaataattggaaccccgtgtcttgaaaattccaagattagggtagagaaaatctagggtgcagcatgtgggaactgtctccacttctggcagagacctggtgattgatgagtaccatttttccatatcactcatttcttttgcaatatctttgattattgcagatattaccatacatagataattttttgtcaggttggtatcttatttagttaaaagtgctaccttctataaaagcatctagagtgtatcgcttgtttgacctctaccgtgtctgcctccttggcacctagcgacatttcctttttcatttctctcactctgtcactcattaagagatgcaattcatgacgtagcagaagtgaattcacttccacgttcacttcattcagaaaactaaaaagacaagcccaaaatgcatcttgcctttctggagccctttttcaactggatgcagaaactctgaatgtctgaaatcatctagtgccttagagagtttagtgattcttttcaccgggttgaaaacccagtttgtgtttgccaaggagcagtggtctgagaataccacatttcctcttccctccctcagtacatttcccctgatcccccagtaaaatctgttatctgaacagggaagcccagaatcctgattccatggttcaaaaaggaagtaaagcacgataaaattgaagcaggatattttccttgacagctttgcaggcgggaaccggagcacgggcaatggagctagctggctatttcggtgccggcaggggcaaactcaaaacagaagcctgctgctgttggtgtggggatggttgtggcaattcacattgttctgaattgcttatctgattgctgggccaaatgcttattctacttagtaacatttctgaagtttgtagcaaaaccttaacattataaaagaacagataaggagccatttcaaaccacaaaggaagaaaggaaagataccacagaaaagtcttcggggtggggggtcttagccaaccacctgttacatctgggactgggtccagtccaggggccttccagcaacactgaggagtggccttggccagatgccttcagttgccccaggactttattctggtcccacatggtggctaagcctccatgaagggaaacagagccaacattcctttcacctgcaggaaagagagagatggcagtgttgcatcctgtcccctgcaagaggcatagctcagaagaaagtctgaggacaagaagagacagatctgcattttactcacccttctgatgtatcctaggcaggctcccagaggaagatcctgggcgggcctccagattccctgaccccttcacgggcgggaactggaatgcgggtgctggggctagccagccgcttcagtgccagcagaggtaaacttcactcactcgaacccgctgcacccaacccctcatgggacggaacatgcaggtgagtgagtgcaggacctggcaagtgcttttgggcactggcaggagcaaaactctgtgcaggccccaccacagcatctagtggggagtgcctgtagcccccaaagctccagaaggagtgttatggtacaccttcttttatctttgccatctgtggatggcttaaatattaacagctcagtggagggtcaccctcttggcacctgagttcttgtctggcgttcaggaggaatgaagtcacacaaacaagatgaagacggtaaatgtgggggattttattgccaatgaaagtgactcttagtagaaaggggagctggaaaggggatggggtgggaaggtaatcttcccctgaagtctggccatcccctgttggactcctctctgaagctatgctgtcaagctgtccctctgaagtcaagccacttctctccaactatagtctctgacatttagctgctgcttctcctcttgatgttcagtcacttctcctctctgctggctgtgtcaggggtttttatgggtacaggatgggggggtggggtggatcatgggtggttttggaaaagtcaacattccagcatgaaacaggaatgtatgttctcactttgggctgcggtgccaggcttgagggtggggccctcagtggggacccatcttcttctgcccagaatttcctgcctcctgtccctatcaaaattatttaatattctatttctttgcttcattctttcctgctaattccttcagactcacattcacattgtctgggagatctactttaatgtaagtgctgctaagaataattcatatcaaatatgttgactgagatgttagatatacttcattatgctggtgtgtgggaaggtttgccaaacttaactattaagtcacactaattaaattactttaggtgctccataaatgaattgtggttttttcattgatgattttttttttttcctgagatggagtcttgctctgttgcccaggctggagtgcaatggtgggatctcagctcactgtaagctccacctcccgggttcaagcaattctcctgcctcagcctcccgagtagctgggactacaggcacgtgccaccacgcccagctaatttttgtagtcttagtaaagacagggtttcaccatgttggccaggctggactcaaacccttgacctcttgatctgcctgcctaggcctcccaaagtgctgggattacaggcgtgagccaccatgcctggccctgatgaatttttttaattttaaaaaaaaaaaggagaatttcttaaaactaaagcaggtacattatcataaataacaaaatgaaacaatattctttattatttaataataaatatataattttatttataaaattattataacaaaattaaacaataatttttattatgtatgacaatgtacctgctttagttttaagaaattctctttgctcatatcaaaatgttataactcctttccttcttagaagagatctgaaaggaataaaaaggttaggattacattctgctattatgttcataatacaaagatgatctcctctatattctgtttttgtgcaaacgactctaacaaatttccagtatcttacatgtgcaaattacaactgtcttcaaggtaaaagttaattgagagaaaaaattaataggttagaatcttactttttcttttcttgcttcctgactgttacacctactaaagggatgtggggtgggagggggagtcttttttctttctaaatcattctgctagtgttatgttgactttctctcaagtacaccctgtggtctcagatgatcacatattttcttacgttactcatattgatacagcaccttggcttatgggttgacatatattacctgagctttgatgacacctcccaccattgacatttcctggtggtggggtgtactgagcctcttatgcatgaaacataagggaacaggctgtttcacaacagcattttcattctttgaaaatcaattactgttcaccccaaatggtatctgaagcccccatcagtgttgcttcacattgtttcttacccctacagcaatgtcttgagtgcttttgtgtctttgctgagacggaaaaaaagttcctcacatgggcttcaaaatattccagttatactgtttgtaagaaagtttgtattattacctgcctggaagaatacaggtaacctacctatatgctgttgctttctctttctttcttacctttgtgtctcctctcatctcacttccctctgtttcagctagctgtgaggtggttggaacacaactgccactaccagtacatggacgagctcctgcaatacatccgctttggcctaatggatgtggatactctccatacagttgccctgtcccacccccttgtccaagcaagtgagactgcaacagcccttgtcaacgaggccctggaataccaccagagcatctatgcacagcctgtctggcagactcgcaggaccaaaccacgattccagtcagacactctgtatatcattggtgggaaaaagcgcgaggtctgcaaggtcaaggaacttcggtacttcaatcctgttgatcaggagaatgctctcatagctgccattgccaactggagtgagctggctcccatgcctgtgggaaggagccaccattgtgtggcagtcatgggggacttcctgtttgtggcaggaggggaagttgagcatgccagtggccggacgtgtgctgtgaggactgcctgtcgctatgacccccgcagtaattcctgggcagagatagcacccatgaaaaactgccgggagcattttgtgctgggtgccatggaggaatacctctatgcagttgggggcagaaatgaactgcgccaggttctgcctacagttgagcgatattgccccaagaagaacaaatggacttttgttcagtcctttgacagatccctttcatgccatgctggatatgtggctgatggtcttctttggatatcaggtagaacatacctcatgttggatttatcaaaacacactttcattgtggtatatatttaaaagtcaagctttaatactgtggccatgtgtaattgaaagattgaaccaagcatgccattttagctaattaacattcatttattgagcacctactctagagagcaatgtaattggaaataatatgcctttctgtgactttctgagtgactaatggaataaaaattcaaggtggaaattgttggtccatcacaactgtttttttcctaccagaacttctcctgtcagctcttgattattcatggattgtattgcacagcttgtggtttatctaggtcctttgctttttctttcacccctggctacctgactagagccatttcatcaaagacaaggcaagagaagtataagcccagttaatccatttttctgggtatatcaataggtatatatccaagtaatcactatgctgtgcattgagagaagggatttaagttaccaaaacaaagttgttgttgttgctgtttcagatagggtctcactcttgttacccaggctggagtgcagtggtgccatctcgactcactgcaacctccacctctcaggctcaagtgatcctcccacctcagcttcccaaatagctgggactacaggagcacaccaccacacccagctaatttttgtaatttttgtcaaggcagggtttcactacattgcccaggctgcccttgaactcctgagctcaagcaatccaccagtcttggcctcccaaagtgttgggattgcaggcgtgagccactgtgcccagcctaaaacaaagtttgtttgtttttaattatctgtgaatggtagttacttgtgccattctaacccttcattcctatttactctcctatttttactgatggtacagtttgagctctagtttaccttttcatctcttttgaaaaccttttgattatggaaaaagtagggagactagaataatgaaccccatgtacccacaacccaaaatccacaattaactactccttgccaatcttgttttctctacacccacagacccatcacacccctctgggctgcctttttgcttatacagaaggagtctgtgaggcatatgctatcaacatcacattataaacatgtgttttcaatcttagttttgagaaaggccctaagtgttctcctttgaaaggtttttctatcaggaagaaagctgcattttctcccagttggaagatactcatattgtaatccaaatggaacttgttggatttctgtgtcatcaagcactaagaggaatagaaagggtaaaaaacttaaatattaagaataaccctgatgtttgtacttagaagaaatcattacttttaagtacacctgcaaaggcttctcagctttcctcaataatcgtctctagtgttctaacacctgctctgacaaaattctcccttgcacttctttaaattcatttggactttgactgtttgcttctgctgtcctcaataaccaggaagatagtcacaggctcagcttctctgagcggtgcctcagttattggcaattcactgagttttattgacagaacctagctcacatcagggtttaagtgctcaataaattaatgaatgaagggaagactaggactaaggaagcagacagatgaagtggacccaacatttactggctctataccaaagaaacattagaaacaagtatgtatgttagtatatgtagatatatttaaattaaaacctcatttatctaattactgttcctttttctttaaatgtatatttcaacagttaataaccaccaagactatattcttttagctgtgctggagaaatttcaagctaggcagcaaataagtctttgctaacagaaggaacagatctgtacttgtcttggatggcaaaacaacgatgggtttatgaaatcaatgccatttatgttttctcccaattgacattccttccattgactcatttagtttcatatattattaatatactgtattcctaaattttgcactgcattttctaagttttgtatgaatttctcataaatattttaataaatattccttgtgttttggctgtaaacctagcttgtaaaagaatgctggggtttcccttacatagtcttaaagatatgacgatttaataccttcttcagtgaggccttaagaaagcacagaagctcctcttagactcgctagatccgtcgtcctggtatcaagctgacttccctttcaatatgtgtctatatgtttccttttccattttattaaatctatcaacctattacagatccttattgctatctcactttgtttttctcctactgtgaaaggaaatacattttctttgttcttcttttgcactaatatatgctgcctctgttaaccaaacttaatgaaaacaatcacaattttctcaggtttgtttctccttactgtgtacttgagatgaaaaactcactttgctgtgtacagtacaatatctttaattggaaagaagaggaaatcgccagtgacatttctaataccttcagtcatctgcctctttcctcaggcccagcttataataaatcaattgtgaatctaaacatgaatagggaggggtgactagatttgctaatgggccccttaacaaaaatacaggtatagttcaccctgcctatcactgagttgggagtgtaacctgatttactggagcagatgaaaatgtttgaggctattccttatcctttaccaagtaatcatgtatttccaatttaattgatggggattgaatcattggcatccttctggtattttgcaaactttgcctgaggtgggggtagtatggattatagaaggtggattttagggtcttggttctgttctctagaacacagaatgaatgtttctttagagacttgacatttccagcgtgctcactccctctccacacctctcccccattttggtccattttggggtcaggaaatcttgaaacctgtttatagtttttaaaagtatgacaagccgaaaggaatccagaaaatcctgctgcgtgtacatatccattagcatttaattaaagatgttagagtcgaattgtacaggctcctgtagcgtttgacattgtgacccaattcacaagtgttccataccattttgatttgaaaattgcagtatcaaggtaaaataagctcttaaatatcctacagctgtgtttttaaaatatatgctctctgttggaaggtatagtttgtgaactactaaaaagaacctttttttgtgtgtgagggaaaattaatcctgagctcatcatgaagaacagcttatttttttcattttcatcaaatgatagcaaaataagaggctaactgcaaagttagtgctttaaaactataaaaataagacaaatgttattgcatttactcaaaagcaatatttagtgctttcttgattctcttggtgaatgccacatccttgtaaagtatagtgctgagtcacagatacatgaaattaatttagcaaacatacttcctgccctctaggagctggcaatcaaataatttttcagatatttcattaaggaaaggacatttgttaaggcttaactccctagaagctatgtgtattttcatcttgattaaatttatatgaagtttgcattgccccattttaaataacttcaatttattcaaagctactaacaggacttgggtttttctagtattaattaaaataatgtaaaattttattaacatttaaaaatataattgccttatctttttgcagatattgttttacttacatcttgagaattgtagacaaaggccgggtgcagtggctcacgccagtaatcccagcactttgggaggccgaggcgggcggatcgcctgagattaggagttcgagaccagcctggccagcatggtgaaaccccatctctactaaaaatacaaaaattagctgggcgtggtggcgggcgcctgtaatcgcagctacttgggaggctgagacaggagaattgcttgaacccgggaggtggaggttgcagtgaggcgaggtcacaccactgcactccagcctgggcaagaaaagcgaaactgcatctcaaaaaaaaaaaaaaagaattgtagacaaaatattgggaactaacagcaggcatagcagaggctgagttgtggtgcactgagaccacagaccgtggtcacacacacacaaaacttgtgctgcatttcttatccatgatgagatgctgagctcaagttcctaacctctccaagtcctgttccgggatagtgctggagcattaaagtagcatatagtagagggaacagacttttaaacaggtaattagagggtgacagcagaagtctttccaaggtacaaaagtagtgcaaagcagggagtgactattgcagaaggcaggaaaggtagcacctaaaataattgaggaattattttaaccctggaggtgcctaacttagctgcgggtccattggctactttctattatccattaactcctccctgtcctcacacttgaacttcatgatccaatcacttcaataattatcttgtcctctgggaaacatgcagtgtttgacaaacccagtaatctgcttgttctgtccctgtacctaggtggctctacctgtgggaggaggacaattagcaggagggcttggtatgggtatattctcagcacatcacgcacagtggcactctcagccctctctatcccctactgctactctctcacccctttccttcactggctggaacttcttcactttcctcaaaaccccctcttctcagactcagagagaagatctttcctttggtttctcagagcaaatctaagtgagataataggaggaggaggcagagagtgtgacaagagagatggataagagtttgtctggaaaggggctaagggcagaagtttgggaaacactacagggatatcaaggtccaaaatatttccactgcattttttaattgggaaaattgtagtgaaagcagtttcaggaaattggaagaaggcggaaactagaatacagtagtttaaggtatgattgaaaagtgaggaaatagaaaccccaggtgcagactaccttggcaaaaagttaggataaagcctttcttagtctaatactaatgaacaagcatattttctaaacttcattccccgaatctgagcttatcagacaactttccaattaacagtctggcttcctgtatacatttagggagagaatgtgttgtttttagttgttcacatattttagttcatgtaacagcctcattttttcattataaattaataaatagcattttggctttagtaagaataaaggagattaagaaggaaagaaaggaagaaagaggggagttggttgagaaaaggaagcaagaggggagtttggctgagtagctagaagacgaaatccagaggtgaaggagggattttgtttgtttaaggatgcaagtgcaccgagcatatatattaataaggaaagagagtgaaattgaaggtgtagggaggaggggcatccatttggctggtaaacgctgagagcatttcccaggtaccaggaacagtgaagagtcctgaggatacaatattgaaaacagacagtgtactgaaaggcaaggaactgggcaggggttaggtcttgaacatgagaagggagggacccttaagcctggagggaaggagataattatgggtgtgaacctaggtaagctcacaggtgaggggcaggaacctgaggaggtttcttgtagattgattcaaatgagaaacaggtctgtcgagattgtgcctgtcaggactaagtagagggcctgaggagagtgaccttggaataagcctctgagagaaaacagagggaattaacaggttaaagaaaaataggtgttcagaatccacactaaccttggaaaccacaaaactgtagtggctctgttttcaaatttctgtcgttttatggtgctcagcagaggactgaagaaggcagatctgtggattcactcatgatgaaaggttatgagactggaatagtccagagaatcctcctggaaggagttcagcaggctaggatctcagttaggtgagaggcaagagctgaagatttgcttgagggagaaaagtgtgtgttgcgggagtaagtagtaagagaatgcccccttgttgtccctggaggcggccatgatgtgaggaagctacttgcctggtagaggttaggaggtggataacttggcacatccacttaaaagttcctagtgaattagaatgtccatgaagaattaaatctttgttgctttagatcctagcaaccagctgcccccagcagttactttttctttttttcacttgtgccccaatctttcctacctcccatctgaaagagatgaaaacaaagctactctagtattgaactgaggtggaaaacaaacagaaatgtagtattctacaatgcttgttagagagctaaatgatttaaaggaaagaaagcaatcagatcacctacattctccaaataattaacaaagctttcatcctaaactgtcttacctgtatcccgaataagttgcactttgttgatttaccctcacatcactgcccaggaaatgaggcttgaagaggttaaatgactccacagatcacacagcttatagctgacagagttagaatttgaactctgtgtctctggttctttagaccatgcttttcccaccaaaccacacaggttaccagttgtttatcatgacagtgaaggtctgcaaaatagatgcttaaattgtaaaaaagaacttccaaatggcataaaactgaaagtaaatgatacacagaagcagagtgctatctggggatttgtttagaatcaacaatcattgattgtccttaattgcttaactgtccattcttctcaggggtgagaagagacacataatgtctttctgcgattttacggttcagtttctaaaatttaaaatgtaaagagaaaggtgataaaatggaactactctaaaatacattggtgtagattagaaatttttttctgaaagaattacatactacaggagtctaatggcctttaaaattggtgttgtaaagttttgttttgttttgttttttttaatgtccaaatcgttggctacaaaactcttctcacggagagaaccccctttgtttagatgattgttttgtgtctaactagatgggtctagtaaaagacggtaaactaaatggtgagctgtattgttctactaaagaatatgtgaacaatatcatttgctttattcccaagaggagagaagatggttaaagctacgccatagaaatagggaatggctgaagaacttagctgatggtggaagggagataaaagatccaagagcacagcaaagctgggacatgaaagacagacagaggtggccttgagagtttgaccctgctgggaatgtgcaaaaatatttggaggcaggatttcaactttctacagaatgaggaatgggagttagagtgaatattattgagattataaagggcaggtgaatctaattgatatctgcattatggttgatttcacccccattttatcatttcatttatttaaaacaatacataatgcatactttacatatttctgggtcacaagtttgcacctatttgctctaaatgacataatttctattttcaaatgcagcaaccctgcctttataggtattttgtaaattagagactttgcaggttttgagtatattaagtacccatcatctgtgtgggttcctcaagtatgacagaaataatatggatactagttttaatttaatgcatggattatgtatgcttctattcaagatgctaatttagtagaaagattcttagctgtaattgtttagtattataaacatccagaaaatatggacagtctaatgtcatataaaaataggtaagtttggttttgcatttattataaatgttcctatggtattactttttttaagggctaacaatgagtgtagccctctaaatagtgactaataggaacttgcacttaatggcaggttgttctttaggtaattaaattgtaagcgtgaagttatagtctttcaagaactggagaaagtttatggaaatggtaagaaatttttataaacagctacaggattgtagcaaacttccctctgtggattgtctctatgctttgcactctagttcatctgaaacctatgaggaatgtatcatcatcactgttttgcatatgaggaagctgagcatggctgtgttaaatggcttccccaaggatatagtcatgtaggacccatgttaatgccacagcctgtcctgaaactcttcccttagactagtgtgaacctggccactgcaggtctccaagacagttgcagagaacttgagatggttttcctcaatcctgaatttgctggcagaattccaacctggagcatgctcctccaccctgcgtgtggggatcagttctttgcatcccactctgtcctggtagtgcgttagcactgcattacgacccatagacatctactcctggagtttactctatttaccaacagaggtattttttgtcgttaaaaaaaaaattagcagagccatcagacttgacccagtctgaccatgtacaatgagagcagtttttctacacactctattttatgagcactgccggcattgaccagttgttgcttttgagtagaatatgagtttgagagtcagtgatctcagtagcagagacaaaggttgcttgtttggcagtcacttgtcatctctccagtatgcactcatccatttgtcacaacattttgtggcgagttgtacagggaagcttaagaaaaatgcttttctcctgtcttgatgatagaaagcatttctcactgttggtagcatggtggtaacttttcattccttctggcagtttttaaagacttatttgactttgggggaccttgcagtatatctttaagtcacagttcaaaagtataagacagggttgctcattttcaattttggctgaaaagtctttactttcactgtggcacttcaaagttagagaaaacttggttttaaaaatggatgctgatatgagatggcatatttaatgacagatgtatctatagaaagctgttaagatgcagattatcctccctggggtgggggagggagatcaaaactgccaatctataaaatatactcgatagaggaaggcatggaatctatctttgcaagtgctttgattgcaggggacagtatagcagcatgtggcatcgtaacccagagcagacaaatcagcttgatgactttcaaagccaggaatactgctgcaggcaagggtactccagtctaggagaaattaaaacatatagagactgttattaattccatatctatttttgtatagtcaaatctgtatgcaaatccttagcatctcatttcagcagattaatctaaaagcgaagagtgttatgtgaagggaatgtaatgataaagccctgcaaatgagtaacactgctaaagaaatgtgggctgcaaactgggatgcttttttaaaatgtatcttagtattgagagaaaaatgatttttatttatatgctcatttgtaaattatttcaaaggggaaggcaagagaaccagtttccaaggtttttctttgcaatcctgacttggcaaaagttgcagcactaggtttgttaggcacctcctgtggtttaacattctagagggaatctattaatatcaaataactgggactttaatttttactcccaactagtaacttaatatctcatttctaaacattgtcatttgagtgaaaatttgtatgtaagggtaaagaatctaattactgagtgcagattaagaagaaaatgtattatagatgcatttgtggaagacagtaaataataattctgaaaagcatagagataaattgtatgccctgcttgggagaggggatgtaatagctacattctaatccattggttgtatgtttaatctataatgggcagagtctgatacatacagtagtgtaagtattttcaaatagtgtcataaaacagatagtttactacagtagatattaattatgtcccatatttctaaaacaagtagagaaacttttgaagtctttaaatgatgggtggagctttgccctcggctccatttcagttagagaagtgattgtaggcaagctggacgttaatctggtggttatggctcagatcaaaagcactagcaattattttaaccctgaagacttgtgaagtctcaagagattaaattattcttgtgtggttatgctgagaaagaattattgaacattctgtttttaatcacacaagaaagggaaggttgggagtaaaagcaaacacaaccctatatttattttgacacacatcttgactatataggcatttcagcctcagctttcttaagtgtgttttcctttcctctgatttcatttttaaaatgagatattcgatgagaaatccagagaagactttctttgagggcaggaggctcatgtctgtgttctttgtggatttctctgcagacaaagcttttgttgttctttaaaatcttaaatcttcaagcttctgagataattttaaaaatagtcctctagttaataatagccaaagccaattatatgaaagatataatctccctcctggggttgagtgagagagtaatgattggcctggataggttccttcccctttatgtatccattagttttgattgattattccagctcagttaaggattagacactaatcctctggattcttgttgacttgactcctagccatgtagttgatggtggtgacctattcaaagtatttgaactgtcaaagcaaaaactgcaccagataaggttaaacagagaaagaagactttattcaagactatagcaataggagagagagatcagaatacagtctgaaatcaattctattaagcaaagtttttaagaggatggtttttaagcactggggtgatttagtagaaaagtactgaagaacatttcagaggagcttgattaatggatgtgttgtacccatgcagttatttctgagttgacaattttggtctctgtgattaggccatctgtgtttggtgcaaattggtgtctatcacagttagggtccttgggagactgaggttgcagtgagccgaggttgcaccattgcactccagcctgggcaacaaaagcgagactctgtctcaaaaaagaaaaagttaccgtcctaccttcccatagaggctgggatatagagcactatcttccttgatgattacatttcaaagggatggctctctggactttaaggaagatattattgggttataaaactggcaagcagcttttaaaatgatttacatctcaaagagggagagaaagaagttatgattacaagttttctaaagtaagtaatctaagaaaagggaggtcaaggggcctagagtcaggaagcaacctatttagtttagttaagctgggggaatgttaaggccctcttggtcagtattttaacagtgtttgttttttaaattcaaaaaattctagtaggaaactttttttagtcgggcttaattttatatctttattgaaaaattagctgcttctttgtgatactgattaaaataagaatattattcattttacaccagtgtctagaactacatgtaaggcaatatttctaaagatagatttctttggtcccatatccttgatattttattatctaacatttaatatctattggtgatattttcttactatgctgttttatgttttttttttttagagtttttccacttaatggtaaaacttaaagcaaaatgaataatttctgggttttacagggctcagtatacactacaagtatgaaaagaagtatgaggacaaataagagaaacttagctggaagtgtgatgattttttagtggttcttgattaggtgggtctcaggtctcttagatctaagcagttgtcaagagggcttcaaaagagtacaccacaatagcaattgcactgaagagccctagatttgtgctgctcagtatggtagccattagccccatgtgacttattgaatccttgaagcatggctaatctgtactgagatgcgttgtgtcaaatatacactggcttttgaagacttagtatgaaaaaaagaatatgaaatatataaaatatcttaataatttttatgttgatttcatgttgaaatgataattgtggctatactggggtatataaaatttattaaatttaatttcactgtttctttttactttttatgtggctactggaaaatttatcattgcatatgtggcttgcatatgtggctcttgttatattctattggacagcactggctttagatattttttgataagtaatatcaagagatatcaagatatcactgtgttagagtacggatgttagagctttaaaattgacaatttagtgaaggacaagaattttccatataactatgtccctggcataaactgtgtagagatttgtctatgtgtactatgttcactctcactccctaatactttgcccctcattctggccatgcagaacagcttgtcagaattggggtcctcttggtaatgtcagcatacttgttgcttgctcttaactggattgcttctgaaatgtttcttgaaaatgaaactgcttcaacaataagcttcttaattatgtcatgggctcaccatgagggtatacaaacagatcctcagcagtagctaattttcctttaattgtatctcattcttatgttggaatatcctattttttattcatgaaaagctctaacacatgttaatccattacaggtggagtaactaatacggcacaatatcagaacaggctaatggtgtatgaacctaaccaggtaagaatcatgtaagaacacctcattatcttaattaatgaattttaaaagattccagagtaattagtaattggaatgccaagtctacacacacagatatgcatctttagcttatatagagaaaaggaagcatctgaataaactgctttttggttcctttttttgttttgttactcaaaacatttcagctcctctagttttgtgctatacagaatacatcaccctttcagagttctgcataatatagaaatgatttgaattgtcctgttgtaacgtccttctggaaggggctgccattctaggaggggatcatgcttatggtttattctaaaaaacaagtattaacttaatatagcccaaatgacctaaaacagtatctaggacaagtctaaagtagaagtatatgaagaatctgagagatgagaagtatctgaagggttttcatctaacagctgggggttgaatatgcatatggatggtgcctgtaccttcttttgtctacatttcatgtacacccaattactattttcccccaaaagaaatatttttattctcttttccatatactaaaatatggatgaaccttggcaattgcctgctgaattttgccatttctatgattttggtaatgtaaatatttttgattatgacggtattccaaaatgatttgtaggcttaatattcatcagctgaacgtaatgggatatgacacaacaggttggctttggcagtctgggttgggactggccaccaaatctatgtccctagtggactcagtgtatttggtatctttttattttagcaattacttgattctgtatttaatgaaggcatttctctctttgcaaagtgtgtttcctgatgtcattagaagctgtagatttcagagaccaaatgtccatgggtcagctgtctcaagagggatcgttaattgcagttgcttgagtttggtgcacatgtggttaaagaggaagaaggtgttaacatttctcaaatgagttctgtttcatgtttgtacacacatgctcttttaaaaaattctgctggcatattgtttacggtgggtactggcaaacatcacatctgcttgcatcttgctcagaatctcaataactctatcattcagccctggtgcttatttctcttctaggcctttgtggagagtcgataatgcctgccatctgccacagagcacattgctacctgccaacaggcaggctggggtgacctctgcttccccaccactgattagtattcacatgctagcttattaggaatgaccccaccaggcctctctgtttctttgcctttgcagcggttggtggctcacctggcaggcactgcagtgaaggaagctaaagatataatcaggggatgcaggcaggctttgcaaaccagatggcatccatagtctggtggcaggggactggactgctaatgcaaacattgattcctaatactgtaatgggttgtttcatagaaaacacctaagaaaagcgtcctcagagttttgagttaaatacattcatgtgtaatgtattatagatattagcaaaatagctgaaaggcaggcttgactattttattaaagaagacatttgattggaaggaaattcttattatatgttcaaatgggggaacagataaatgcaagcttttcaagctgtacaaatcacttcttttcttgagtgtgtctttaaaagagctagtctatatgcctattagtgagtggaccaatttttatacaaaatgtttattgttgttgtgtcttgcttcttcccttacagttttgtgaaatggtgaaattctatgtattcaaaacatcgtatgactttttttctggccgaaatccaaatttttcttggcaaaaaggaatctgggttcttcctgtatgcttagtgtttatgtagaaagaaaactgttagggttatttacctgtccattactttctttacttatctgtccattacttagttgagatttaaaattaaagtcatatttggtcttcatttaattttacaatgagagccttattttaagaaaggttgggcatactcttcccattactgagggtgaacaggaaccaaatattgaaggtttcactattccctaaagttatcatataaaaaagtcttccagcagggtgcggtggttcacacctataatcccagcactttgggaggccgaggtgggtggatcacctgaggtcaggagtttgtgaccagcctggccaacatggtgaaaccccgtcttcactaaaaatacaaaaatcagccaggtttggtggcacttgcctgtaatcccagctactcgggaggatgaggcagaagaatcgacttgaacctgggaggcggaggttgcagtgagccgagatcatgtcactgcactccagcctgggcaacagagcaagactctgtctcaaatacaaaacaaaacaaaacaaaacaaaacttagtcttccaccaaaacaaataaatgtgtgcctagaaataacctttcccaatttggcaaaagatgtgactgttaatatattaaaggaggctgataaaaggaaatgtgggtggtttgttgctgaaccaaatcttagctcttccactgatctcaggaggttaattttggaaagaacagcaaaaccattaccctagcttatctagcggcctgaggtacccaatgattatcatcacatcattttgaaaaaatgaatatgtattgaacatttttcatgtgcatttttctaagtgctttatgtgtattagctcatttaatcttcacaataggcttatcaggtaggcattattatccccattttacagatgagaaaactggcacagagatattaagtaaattgctcaagatcacatacaagttataaacccaggtagtctggatccagaaactattttcttaatcattgcaccactgtatacagtatacctagccatgtgctttcactcttaatgaatttgcatgagtaaattctctgaattgggtgagataaacatcatgaaaatttcaatgttcccctgatgtaattcaaaatgcactataaaatgcaacacaaactagaggagatgccgtgtgtaaatcgcaaaaacaattggaatatgtggctcttttgtacttgttctcatgtaagaagcccatacctttcaatatatataaacaacattcaaacagaatgttgatctattgattgataaacattagggttctcactacttatgaggcactcgttgctgttttctgacatggaggtctcctactaacagaatacacttaaatttcttttttcagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggcaagtacctttgattaagtaaatcaggaaaagtagattcaagaagtcaccaaacttgtttcatagacatctttagggcatcactaaatattaagtgcatagttgtagaagaacctgcatttattaaccagaaaggtgtgtatcatttatgttctaacagaactggactcatttaggtagctgagcatctagtttctcagggcctatattactaccattatgcacatcctcatatggctgagaggcatgtcaagtccattatcatccatcagtgttaagatggaactctgatacaagtaggaggaaccagacactgaaggatttaataactctttacagaaggaatttattgtttacttctcactgcttttagtcttatttcttgtgagttcaggagtttaggagcatggtcttcattatttgtcactgtcaagtattgtttctgtgagtattctcctagaaatgaaacccttaagtggttctgtacacaggagtttagctgcatttttggccacaaatacccatccaagcatttaccacagagcaacattaggtatggaccttcctcatcccaaaaaaggatgaaagtaacacggtgaacaacttacccctcatgtttctttatggagtgaataacttttcccccttgtcagcttgcattgttaacatctacaagtgatcagatcccttccatgtctgctcaaataataggaaaaatcacaaactgaaaatggtaggttgggttaagacattttaatatgctgagtgggcactcaatcccttgcagctgctgctgggggaggcaacgctgggaatctaatcagaggtttagatgcttgtattgagctcctgtttttgcaaaatgatttttgaggcccactggacaaggacttagaaactctctgagttttagcggtaccttaggccctcgattctggatctgtgattctgcctgctgtaagatccagcttatttattaccccagtcaatcctgtgtcagcccatcaataaaaagagactctttcactctgtgatggcctccagggaagaatatgtggtagtgagttattctgtcttctttttgaaatgggaggggaaacctttcatcattttggcgtgtcagcatctagggattatccaggctggtcccagctcaggaactttaatataatctttaaaatgttgggtatgtaaagaaaggtagggtagcaagttgatcaatctcttctgccatttgtcttcatttggggcatgctaggggcatggctctgctttattggcttcttggggttgcagctgttactttacaaatgtaagcacttgtctaaaaagcatttgcgggtatagaagaggtgtttgcatttctataatataccttatttccaccactgtaaattaatggcatgtgacatagcatagaattcagttctacatggcttactattgctgtatttaatgctgtacttactaacttggctggctaataagtgttttggcctggttctgacctgacagattcattctctgagaaatagtgcttaatttttctgagtactgggaggcagtgattagttgctgcaaaaatcccatggagtatacaaatgtgccacaaaggaaaattgtatccctcagtggcaaaagggttaattaaaatatgtaagaaatggattttttttctttttattcaattctctttactttaggccaaaatgaatctggagttgctgtccataatgggagaatatatttagttggtggatattcaatttggacaaatgagcctctggcttgtatccaggtgagtggtagaagttccttttgaagtttgttcaagtggttcagcgaggttacattttgcaatgctgctactgaagaaagagatatttatgtttagaaagaggcttaacgtcccgttttttgtgcaactagttcagccactaaacttcatcctgtatcctaaaaatgatgcctaaataaattattgagccctattaaaaataaaaatgaggatgaattttgaaaaatatatgtaatatatattggaaactgggaaactgggatagcgttccctttctcataaaccaaaaaattctaaaaatctttggcaatagttccttcatatcccccaagctttacaaatacttcctttccacaccattgccttattttctatattacagttcattcattcccacaaatgccacctacaagggtgttcttccttcacggcagaggctgtgagcagtagtggtttatgactggtctgatagggacagcctctgtcccaaagaatagccctggtgcatcagcatatgagcagcccaggctgggcaagttgccagctgggcctttcagaagagcaatagccctcattgatagacacattcatagtattattcctattattattttacagttattaccatagttttctcttttacatgttctctgataaaatattgacatgtattagccctgacctttcttcctgacctccagaaaagtatatccttataactacttttattatctaatcgcatctttatgggaagatttttaacaactgcatcaatatctttaatagttgcagaactgttcaacctttttatttctttttcagtcacatctcataaagtacatatattttgaagaaaattccatgttgtctaagttttcaaaattgctagcatatagttgttgtgttatccttagttatatctccctttacattcataatattgtctcttcttctcttgatttgtcttgacagaggtttgtctggggaatttaaagtacttctattattcatatagatgaagttaaaaaagtcagcaagggtaaggtagatatggaaaatataattaacaagcttgtctgaatggatatgggttctgactgagcagttggaaagactgtatttttcttagcatacatggaacatttacaaaaaccagtcatgtactagggttagggttaagaaaactttagttaaaaaaattaagtattgtttagtattatgtatctctaatacaatgcaattaagttagaacttaacaaaaaaaaacccctacataactggaaataataaaacacattgctatataacttatgggttaaagaagaaatcataatggaactcaaaaaaattcccagaactgtgataataaaaacaatatacagcaaagcttgtgagatatagcttcataagttagaaaatgaaccaaaaagtaatctcaaagaaagtagaagaggagagatgataaagatgagagaaaattaataaactgggaaacaataatacaggagaaaagaattatcaaagccacacacacatgaagagccacataagactttaagggagttcactgaaggctgccttgtactggttttagttagttaatggaaagctgccttggactagagcttcgtcctgtctttcggataacaacaaatgaacaaacttttctctcaaagagtgcttctagtcttcatccaagcatgtatttggtagtccttcatagtcttttaggtttctttttattttttgcttttcagaattggtagaactcagaactgggcaacagttctctatagtgctggaacactgttttttaaatggctttgggacccttcatttgatcacttgcacaatggaagtaagtttgggtttatcatgaaataaaattgtaaattttaaatacatttatgagcatatttctactagttttagtatcagattagctcaaggaatagaaaattagtggaaatcataacataatgaggaaataaagaaaatgctgtacgtatcaagtttaggagatcagagtgctgccatagtgcacattttttccacatctcatattttgttaacagtcgtgaatgttagtttgtaagacatagaaacttaaataaaaaaaacttcgtagtcgcatcatttgttttttgtcaccaaagaatttttctgtaaatgatcactaatcatatacactaattaattgctaatgacatttggctgttttcaaacaaatctatccacaagaaatgaagaggtaaacaaatgcatattttaaaccactgaggatatttgagagtatcctcaggattatggtgattatcaaaggggattcaattatttttttaagtcaacacctgtattagtggaataagtttcacctctgagattgtacaataatatattctaatatatttgcttttaaataaaagtcagcatgatgggtatttctgtgttccagtagccattctgatgaacagaatcaatcctttggcaaatactgcgtttattcctttggctggcacactggtcctacaaagcacagacaaatttgttaatttttttttttttttttttttttcctgagagtgtcttgctctgtcacccaggctggagtgcagtggcgtgatcttggctcactgcaacttctgcctcctgggttcaagtcattctcctgcctcagcctcctgagtaactgggatttcaggcatgtgccaccatgcccagctaattttttgtattttttagtagacacggggtttcaccatgctggccaggctggtctcaaactcctgaactgcccacctcggcctcccaaagtgctgggattacaggcgtgagccactgcatctggacgatttgttattaagagcctttactattaataggtaataagtatccctataagcatatggattatcacttaaagagatgtttgaaatagaggtattcatggatagtgacatgtatctttcattttagttaatgacagctagttacaggctatattatcattcattctgaactaaagctccatttttttatgttatggatgacgatagaacaattggtttcaatacactaacagtaataaattaaattgatggttggagagaatagctacatgttcaaaagtaggccacttctttactacttaaagaacatccaacagaggcaagatgatgggagactggaataatatttatgagaaaatgcttaacagtggaaattcctaagtatgtcagtgggttgagaagtacagaagcatagtggggaaaaaatcatatgcatactaaaaatataaaggtttaaattttttgtgtcatcagtcacaaatctgtatatttgatccaagattaatccacaaatcattaatccaagagcatggctgattaatggaagtcatacttaaatagttctgagattgttctattaacatttggaagtactaatttttttttgccctcaaaagtaccagccaataacttctcacttaactgtcccttctggaccctaatccaagctcatttaactgtgatttgtaggattcaaccacagtgggatgaagcatgtccaatgttgaaaaagcatactttatttcctgctactactctgatttagcacagactatttatccatcagaaggacaacccaaacaagagaaaagcagagatactcttaggttgagatttggacttgttagtaataaacaaacactcatggaaaataatggaaatagattactgacgaaagtgaaggtgttcttgtttatttagtgggtgtgtaaactaatgtctgtcacagaggtttgactctaatcttgtgtgccatggatgacaagtggcacataaaggagcagctgcgtaagtgtgcaagtgattagtctgtgtttctagatcacctctactgttatcttcatttactattattttttttggctggaggatacagtgccagcttggcaccacactctcccaaacgccttctttcagccagtttacaggggagtgttttggagaaaaactgccaatgcttccttttcccttctcagattaaatacattacatctgcttaacatatgcagtctctgttggcccaggaaaccagacaaaagctctctggatgattatctcattagtattttgccttctaaaaatgttttcagtcaggagggagggcacaaaatccttgctctttctgggttgcgtcttgagctcaaatactggctccaccacttgccgtgtgaccctgagaaagtcacttaattttttccggtatcaattttcttctctgtaaattgaagacaatacttaaccttatagagttgtggtaaatactaaatgacctctgatttactttttgtatttaatgaaatactagccaaaaccccaccggggttttcccttttctcatggggcgaagtagtgatacttgtcaaactaatcttgaaagattctctaggaaagtaaatgagtaagaataatcaagaaaattttgaaaataaatgaggagtcttgccttacctagtcaaaacaactgtaaatgtgacactgaaagaaaatacatcaattaacaagagaacagagaaaacgtttgtatttagtatatgagtgagttattttaaattagtagtgacagggtatattgttcaataaagagattgggacatctaatctccacttgtttgttctttcttttattctaggacttcttagtaatttcctcctttgtgaaacatggatccccaaatttcaagggcccatttcctgtaaaataatgcgttgttgaagttaaagtctttttttttcccccagacggagtatcactctgtcgcccaggctggagtgcagtggcgcgatcttggctcactgcaagctctgcctcctgggttcaagccattctcctgcctcagcctcccgagtagctgggactacaggcagccgccaccacgcctggctaattttttgtatttttagtagagacagggtttcaccatgttagccaggatggtctcgatctcctgggctcgtgatccacctgcctgactcccgaagtcctgagattacaggcatcagccaccgcgcccagcctattgcagttaaagtcttaagatttatccacacaggtgatagatgaaggcatgagagtggactagatcattaaagacgggtacaaagaggtctgtgattgaaatattgggaaacacctacgtccaggatgcagatgaaggaaaagggactcaaggtggattgcaatatgataatgtcaatgacaaactttcatttttttaaaacaccaaatccacgggaggcaaatgtttaaatagttagagaaaagtcaaatgaaaagggatcaagatgataactgcagacttgaaagagcctaataggtttgacaaatggggcgagagcagctctcctgaagaaagaattttcctgcttcaaagattcagccaggttcagttaggagacagcaggcactgactaacagaggctgtgctatataagaagagaggccaggcacagtggcttacacttataatcccagcacttcgggaggctgaggtggaaggattgcttgagcccaggagtttgagagcaggctgcacaacatggcgagagcccatcactacagaaaatttacagattagctaggcgtggtggtgtgcacctgtggtcctggccactcaggagggtgaggcaggaggattgcttgagcccaagagatcaaggctacagtgagcaccactgcactccagcctaggtgacagagcaagaccctgtctcaaaacaaaaacaaaaacaaaaacaacaaaaaaaccccaaaaacaaacaaaacaaacaaaaaaactccagcatgaacaggaaagaactggggaaaaccttccagaatcgactgaattttgaatttgctactaagctgtgttatattccactacctgccagacactgagctagatgtcatcaattttcacaacaaagctgcaaggtcttgttttcttcatttcacagatgaggatgtttaagccaacattatgtcagactgcctactaactagtttgggcaagttatttaacttgtctaaggcagttttcttaaatgaagtaatgctacctacctcataattgttctgaagattaaatgcttataaatatacatgtatgtatatatgtacatccaaaaacatactaacatagtgtagcatttagtaggagcttaataaatatttctagtaccatccaagcaagaaaaagaattcctaagatatggtgatggtgacataactgaatttaagttcagaatttcttttatgtatacatagctttattttgagcagtcatctttgatacacaagcttcttctcttcctcttttgtaggtactggatgtaagcagagaaggcaaagaagaagtattctatgggcctacactcccttttgcttccaatggaatagcagcatgcttccttccagctccatattttacatgccctaaccttcaaactcttcaagtgcctcatcacaggattggcaccatctgaaaagccaagccatcatgaacaggaggaaaacatagctctgactgttggatactgggcatgaaaagactcagtgctccatgcttccttgtcttgctttataggtcttatattcggataaatttaagcaaaaaatgaacaattttctaaaatacgttattgaaaactcgtcacccttctcagtgtatgtcaacattcaatatgtatgacttttattgtggtatagcttagtgccaatttaaggtatattgtgttccatgggtctttagagcattctttgtacactttttctaatcagcactgtcttaagacaacataacactgttagtaaggcaatttattggacacaatggcatcgatgatcttaaaaaaatatatattctgtacttaatccctttattatttaaagccgggcttgtaatttttctttttaaaatttaacattatgcagccctgctcagtagagactcactcagcattatgacatcataaatttttaaatgccatattttattcaaggtgatacgaataataatagacatacactggaacagcagttgttgaaatacccagatttttcaccttggttactctgaccttgggtcagaacctaactttacagtgcttcagttttcccaccttttaaggaggataattactgatttccacgttaatttaaaagaacattatgaggattaggcgaacactttgtaatactttgcccaagaaaaagaaaaatgttgttactgaaattataaggtattttattgtctttagaaccttgtaattgaacagggagattatttttgaagtttaaaaattactagatagaatttggaaacatgttgtggaataaatgattctaaaaagcatgtgaaagagacacacaatgaggaaatagggagtttctcaaaatctaaacttgtacaggtatctaaacttgcctcaagtaactctcagatgtcttatttaaaatcatttagtgaaaaatgacatttaaagctaaaaaataatttagttgtactaattatggtaccataaagtgctttgacataaatttgaacctagaattggcagttctaataaaagtttttccactttgttaaaggttatgtcaatcttgagtgcttgtggaattcttcaccaccaatacatattttattactatctcttttaataatgcataggaattcttttttagactagtttttgggtttgctttgtctataacaaaaaataaatacaacaacttaataatcacatttgaaaacaaatttaacaagtacaatgtgagtttttcttttttcctaacttcctcaggacctaggtcacctttattaaaaggaagaattcactcttttttccttggcagtttaatcattcaggaatccctctcttaaaggaaattgttattttattcatgtaacctttttttgtaatcaaaagtgaataaaaacgatctttttgtcttacagaattcactaacttcatatatcgttatacacaaaacattgaaaatacataaaacattgaatatatggcttctggttattcagatttaaagggcaggaaaggggactagggagaaggaaaacaggtaaattttaaaaagaataggaatttagtatagacaaaccttaagagtatttggacagttctgaacagtgaaaattgatattgacaatt

SEQ ID NO: 1949 - DNA, 1654 bp, Homo sapiens
cagtttccccgcgcgacagttcgggagcgcgcaggcagtcgcgcgcacacacgcacgcaggcacacacacacacacacacacacacacacacactttcgcacacacaaacacgctaggacgctcgtcttcgctactgcatccccgaaccagcagagcgaagctactgcgggttctgttaacctcagcatcgtggggcgaagcagagccattgtgcatcaaggagaggccggtgcctgcgctgccgtctctggcacctaacccagcagaccgctcaccccatcggctggaatgcttgctgattcctctgcacacttctaaggctgagaacctgaggaacccagctggaaaatgccgtctgaacgctgcctcagtattcaagaaatgctgacaggccagaggctctgccactccgaatctcacaatgacagtgtcctggcagcgctgaatcagcagaggagtgatggcatcctctgcgacatcaccctgattgctgaggaacagaaattccatgctcacaaggcagtcctagcagcatgcagtgactatttccgggcaatgttcagtctttgtatggtggaaagtggagctgatgaggttaatttgcacggtgtgaccagccttggcttaaagcaggctctggagtttgcatacacaggacagctagctgtgaggtggttggaacacaactgccactaccagtacatggacgagctcctgcaatacatccgctttggcctaatggatgtggatactctccatacagttgccctgtcccacccccttgtccaagcaagtgagactgcaacagcccttgtcaacgaggccctggaataccaccagagcatctatgcacagcctgtctggcagactcgcaggaccaaaccacgattccagtcagacactctgtatatcattggtgggaaaaagcgcgaggtctgcaaggtcaaggaacttcggtacttcaatcctgttgatcaggagaatgctctcatagctgccattgccaactggagtgagctggctcccatgcctgtgggaaggagccaccattgtgtggcagtcatgggggacttcctgtttgtggcaggaggggaagttgagcatgccagtggccggacgtgtgctgtgaggactgcctgtcgctatgacccccgcagtaattcctgggcagagatagcacccatgaaaaactgccgggagcattttgtgctgggtgccatggaggaatacctctatgcagttgggggcagaaatgaactgcgccaggttctgcctacagttgagcgatattgccccaagaagaacaaatggacttttgttcagtcctttgacagatccctttcatgccatgctggatatgtggctgatggtcttctttggatatcaggtggagtaactaatacggcacaatatcagaacaggctaatggtgtatgaacctaaccagaataagtggataagccgtagccccatgctgcagagaagggtctaccattccatggctgctgtacaaaggaagctttatgttcttggaggcaatgacctagactacaataatgaccggatccttgtgcgccatatagattcttacaacatagacactgaccagtggacacgttgtaatttcaacctgctgactggcaagtacctttga

SEQ ID NO: 1950 - protein, 442 aa, Homo sapiens
EPEEPSWKMPSERCLSIQEMLTGQRLCHSESHNDSVLAALNQQRSDGILCDITLIAEEQKFHAHKAVLAACSDYFRAMFSLCMVESGADEVNLHGVTSLGLKQALEFAYTGQLAVRWLEHNCHYQYMDELLQYIRFGLMDVDTLHTVALSHPLVQASETATALVNEALEYHQSIYAQPVWQTRRTKPRFQSDTLYIIGGKKREVCKVKELRYFNPVDQENALIAAIANWSELAPMPVGRSHHCVAVMGDFLFVAGGEVEHASGRTCAVRTACRYDPRSNSWAEIAPMKNCREHFVLGAMEEYLYAVGGRNELRQVLPTVERYCPKKNKWTFVQSFDRSLSCHAGYVADGLLWISGGVTNTAQYQNRLMVYEPNQNKWISRSPMLQRRVYHSMAAVQRKLYVLGGNDLDYNNDRILVRHIDSYNIDTDQWTRCNFNLLTGKYL

SEQ ID NO: 1951 - DNA, 188017 bp, Mus musculus
  misc_feature (1)...(188017): n = A,T,C or G
cgacttgtggcatattggacagctgctgaggtgggacagcagggaccgcttcccaattcagagggaacaactggacagtttccaattttactttcttttaagtgtccccagacagctggcactttctactcttacctgttaagatctaatcccagatggcatctgacagtacaattaacttttctcattatactattttcaaacattcctcggccagaggatggctgtctagataatgcctgacatacagtgaaaagccttgtttcatggtgggcgatgctggctctaacccactttaaactcaggtttgcagagaccgtgatgccatggcattagaggcctcaacaccctgattcacaaaagtttggagtaagctttccttttcttctgaagtagataccatagtcccagatgaacttgatgtgagaatactgtttttattcatgtcacatcagcacagcgtgcctgtgtgttaactttaccagactccctgcaagcatcttgcctctcagtatgtgttccacattacctttgacagaggaactcttgagactcctgcttggaatgcagcattgaagcaatacccctgaaagtcaccgttcatcccagttgaggtagaaaactacagttggggccgggggaggcggtgtggacagccccattgttagggaaattatcagctttcccccccagagagctaaacactttccatcctttgccacgtgctaaggctgagttggatgctgaggcttgcagttcctctgtgccattccctctgtgtgaccaagggcttctggggtttcagtgctgagtgcctgctctgatagtcagatcgtattactttattttaatatatccctgtgttcatttgaaaattaatattctgctatataaagttaaggacgcttcataactgagaaagaataggaggcaatcatttatttatttaaagaagaaaaagataatgtcacgggctggggaagtgtttcattggagaatgcttgcctagcatgcttgggaccctgggtttgattccttaccccaatccaaaaacattctttattaaaattgtcctatcatttcagactttagtaatttatacagtttagactgttgttgtggtctctctctgtataatgtagtggtgtgtatttatctagatctgttaaatcatataattgattcctgaaagcagaatctttaagatgactttctgttagatgatgagaacatttctataccatttgctctactcaaagaatcctatgcatttgtccttgtagaaggctgtacaatgaattatgttgtggtacataagtttattatattgtattctaattgaaatgtgtcttgctgaagaccacagttaatattcatacttttgctagaagatgctttgtgtctttcttatcacccttagtccttaggaccccagctcagaaggcccctgctgactgttaccctctagttccggactgggtcttgctgttctgatctttctgggttaatggaggcctatgggtttgattttcgaaaatgagagagttgccattatattttatacttatttgtggtgtgaactcttaaggcgttttgacacatgttaggacagggtttctaccttagaagcttttgtggcggtactgtatggtagcactgctgtaatgtgattttcatatcttgtatttctgaattacacatacagactagggaacaagctttactgatctgaaaatttatttttctagatatttgtcattttaaagatacttaatcaagctacaaaagtcttttatagcattgtctctatttggcttcctagacatttcataaggcctgatttttattatttttaggaagtaatatttttacaatatatacttaggaatctgaacattcatttcaagtatgctctgtctgtatgagtaaaagaagcctaagaaatatagaatataataaagctttttgaacagttacatttcatatgcaaatagattttctgacccttattcctgcttattttgtgagctgtgtctacattttgataacaagaagtaggtgagagaacaccttggtttcttgtaagcagaaatgtttgctcatcctgaggagatgtttcttaaaacacatttttcaccataggtcttcctttgctgcttgtctgcactcttagggggaaatgctcggacatctcactacaacatagacttgtaaggttttcatagagctcatttcttaggttgacaatttctcatttcctgtttgctgagagttttttattaataggtctctgttaaattttattgtatgttttctgcagctctatgttgattatatgattttgtttatacctttaaattgcttttattcattgtactcaatggtgagttttataaagacatttcattaagtagatcattttggaagcatcttgaattgcaagccaaacttttctttaaatttgaaaattttatattcaaatggcatatgatatcgcttctctgatttgtatgtttgggtgtttaaaagaaaagttatttcttttcactctactaatgagcttattaacccccatttttcctcattttacatatattgcttgagtttctgtgatgagcctcctaggcgggcttggggtgggggtaaacttctccctcctgatgactgcaagccttgcacttcctctccactctccacccctttgttgtctttgctggagccccgtatgtattccctccactcgcagccccctgcatccacccacgtctttggctggagacctttgagttttataacacaaatatgtgaatgccaagtgtttttgtaggcaaggagtgtattaaagatgtctgttccctcaggtggtctgcaatctagcagagaacagccagaaagtgtactgtgattgacaggaggtgtgattaagctatgtgaacaaattcagaacagataggttcaaggcactgttgagcactttgtgtgttttaactcagtggaagtatacatgcacaggatgggtatcggtcattacacctctgcttagaaatgagggagcaggcaccgagaggcagagatgttcactaaccagctcaaggtcacagctgtcagttccatggggccagattccacctgaggcttctgtttcggtttttgtttcatttgtttgtttttgtttgtttgcttgtttgtttgtttgtttgtttgtttttcacttcttagcctccaaaactaactacatctaagctgtctgggtggagtatggaggtttcctggagaagtcagggctggtttcacacaagtgtttgagctgaagcttaaggaactgatcggaatttccaagggagaaagttaggtgtgtttagagagaggaacagatgtaggggcaaaagatgctaagaagacatttcggacacagctcagtgttgagctcttgcctggcacgtgacaagtttgatcccctttactgccaaaggaaaattaaggacaaagaaaaacaagaaagccatcaaatgtttgcacagctctgggaagggcaagtgggagggaagggaggcaggcttgggcagctcgagtcataaggatgagacgccagcttttgaactctattgagcagagaagaaatagcaagatttgagtttgagaagggtgtggtatcccttggaattcagttttaatgttgcctaggctgtagggatattgcagcaaacaatcttcatgtgtttgagaggcaccccattaaagacatacggctggtagggatgtcacctcaaaagatgctgaagttcttggactttggaatagggttggtattggtgtcctcattagccttaaacagaacggccaatgaccttaaaagaataggagaaaaggaagctacacaggaagaatgaatatctgaataggagccgaggtagggaggagtgacagcagaaatgggagtgggggaacatcagtggcatcagtctgccaccagctaactgagaagagacaaagaaagacttcagccttgaacatcccttgctgcctatgaacttcccccttccatagcacaggagtactctgacctgttctaattcacatactttgtggtgtctggacacaagcatgctaatgttgctgtttaactattttgatttgtagttagtatcaggagacgctgtgaggtctgctaaatagcagatgagtgtagtcacggagaggaatgtaaattcttctctgcccccttgctatgggtgatggcttcccacgtgtttgttcaatggcttcagttgctatccagaaatgagcaggctttgaaaactgtcagacaagttcctctccttgtcctacttcaccttaaacgccattcatttgaaaggcaggaaaaagtcagttctctctgttttcttttgtaaaccaaaagtgagcaccgtttctgcgttgacactccggcactgggcattgaacccaaagcctcacacaggccgggccactctcaccccaggcccttgcttgtgcactgttaactttgcacttcagtgtggctgatttttcattcatgcctagtggtagaggttgtggcttcttactctaatgggttttgtgaggcttaggatccaccataaactagtcaggtgagtttctaggttaggttaagacttacttgtttttgatctggtggaagtgttgcccagttatgacaagtatggctggatagcacagaaagacgaaaataatgtgaccggtcttgggaagaaaggtctgagcctgaatgtcctaagagcactgccagtagggcttttgcagtgttcgtccaccaatgcctacacgcagctctgtacaggagcccatggtgcccacatagtaggctcacatagtagggcctacatagtagggctcatgcagtgtttgtccaccaatgcctacacgcagctctgtacaggagcccatggtgcccacatagtaggctcacatagtagggcctacatagtagggcttatgcagtgttcgtccaccagtgcctacacgcagctctgtacaggagcccatggtgcccacataggacctgagaaatcaaaagccagtgctttggcttacacctaggcctgtgaaatgttcattttgtaaatagttcgttttattcaggttacatggagtaacagtctcggcgcccctccccctcttcatattgtttacagatttatttctgctccatctgcttacagcttttaacctgaaataacccagagtttcttttaaaatgtgtctttctatcatttttttccctcagtgaagggtcttttccctcatttcagttaaaaattccagagatggaaggatttgatatccatacttaacacgaaccagttctatgttcattttagaatattcttcttcattttcataaacttgggaaactttcacattgattttcaagagaacttcccgaataatgctgcaaagcaccaaccagcaggtggcggacctcacaaggaaagctttctgttcagcagaggatgaagggcctttcagacccttgttatgtcggctttctctgtggctggcccttttcccttctggctggatgctacccaccagaggcaccaaaggctggcccctggactcggtagaggtagaagccaccttgggaagtgaaaggccaccgtacattggtccagaagttatttgtccccaagccaagttggtcagggccaagatgccacagaagggtctgggaagacccttaaggaaaaatgagggagcatttctgtgtctggaagtagggaatgcttccatcctggctgttcctattgcagaagcacaccgtgactcctgcccaccccattcctgccctcttgtttctccagcccagtgcagggcattaaacatgcaaagtctttggattcctctgaagtaatgtgggaggttaagacatggtcctaggaggatccctgagcggtctttttaccatcagtgctagttccatttctgtgaacacatacctcagtgcctccccccggtgcaggccacctctccagcactctcagtgccatcagagagctgtgaaggagaggttcccttcatccctttagtaacagactcctaggaaggcacccattctcacaggacagagagtggtctcatggctaacagggtgagaagtaaaaaagcaaaaaaaaaagtactctgtgtgtgtgtgtgtgtgtgtgtgtgcatatatattaatagatgctttttgtagctcagttgtacaatacttgcctagtgtgcataaagccctaatttcaatcccggacaccacacaaatgggtcattatgcatgcctatgatcctggcactctggaaatagaggctggaaaatcattacatttatcctttgttacacagcaaattgaaggccaccctgggctacatgagaccctgcctcaaataaataaaggtggaaggggagaatggctccacggtgctgtccaatgacaatccatgccatggcatgtactccaccaacccacaccatgtacacacaaaatacacccttttaaacttggaatgaggtaaagatagtgactgaatgtgctgttcccacagtaatccagcaagcctgtgggacttgtccaccctgcacatgtgctctgttcttaagcccgatgtggcaacctgctagcctgtgaacgaacagcttacttatttacttattaatttaatgtatgtgagtacactgtcactgtcttcagacacaccagaagagggcatcagatcccattacagatggctgtgagccactatgtggttgctgacacttgaactcaggaccttcggaagaacagtcggtgttcttaaccgctgagccatctcaccaaccacgagttttcattagtattttaatttgtaattaatatcctggagactgttgggagttgccactcttcacccaagggtagcatattggtactactcactacttaggagtcaatatatgtctcagtaatctctctggctgctgagagctgataacatagttatcacatagcacagtttttcttggtgttttatgtatctatctctcagcttgattgtttctgtctgggttcatacaagtgacagtggcactgtgtgtctgtgggtacatagacacattatctgtatggctggatcttctgaagccgtctcaggttgcatgctggtcagagctgaggatatccaaaaccgtacctatgccgtgttagggtcatggccttgaaaggtggcaggtatcactccctgaggtccagccccagcccagtgctgggagcgttaggagcagaggaaaaactgtccctgaaactcaaacttctgctgttctcttctcctctcttcactggcccactgcgagttaggtctggccttggtcaccaagttgggtatgcctggatagaggctaaaagcgcctgggtgctcatgtggtatctgcttggacacctccaaagtaactccgcataccactttgactattctttaacaagccaagagcatcagcgactgccatcagtctgccactgtctgactaagaagagatgaggaaagaccagcctctgaggcacatcccttgctggttgtggacatcacatcatgctcttcagagcagaggagtactcagacctgttctaagttacacagcttgtggtgtctggacaaaagggcctagaaacaagcatgctaacgttgttattctaagtattttcatttgtaattaatatcctggagactgtgttgggagttgcctctcttcacccaagggtagcatattggtactactcactacttaggagtcaatatatgtctcggtaatctctctggctgctgagagctgataacatagtgtttgggggttcacatggttagctgagggtctgtttgattttatacactatatgtggttgtatacactacactgtttaaagggtccacatgattgtagatacactgcactacacacacacacacacagagcgactgtgtacacactttatgtgtggttagaaagggtccattggattgtgcacattccatgcacgcggttagaaagggtccatgtgacctgcacatgctacatagaaaaagtccatgcggtcgtgcacactgtacacgttgaaaaagatccatgcaattgtgcccatcctgttagaaaagatccaggtgcctcgccacagcctggccctggctataggcacgtccagccagcagccagccccgcaggcccgaggaggcccctcacacgcccactgagccactgccgcccgggaggcccgcgccacccacggtccggggcccagcgtagcccgcgggtggccgccacccaggccagcggccgcggccgggcgcgcgctccccggggcggccgcggcgcctttaacccgggcggctggcgggcggcgggaggaggcggcgggcgggcgctcagaggagggctttctttcttctttttttttgaatgaacggtgacgtacgtacaggaaaccaggcgctccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaatcagaagaggattccggtcccggtcccccagctcctccatcgtccccttggcgtgtctctctgccctggaggtctgaagcggtccggtggatacggatccatgcctgcgctccagcgtgtgtgtgcaagtgtaaattgccgagaagaagggagaatcacaggacttctgcaaatgctggactgaaaaattgtaattcatctgccgccgccgccgctgcctttttgccccgctgcggtgctcttgagatctctggttgggattcctacggattgacattctcagtgaagccggagtgtgaggacccaatctggaaaccctcctgatttttcctccacctagcccccagaccccaactcccgattcattgcaagttgtaaagaagcttatacaaggagacttctgaagatcgatggtgtggttgccttatgtatttgtttgggttttaccaaaaaagggtaaacttgacagaagatcatgccgtccttagaaaatacagtaagttctttgcacaggaatttggtttaatataactttccatggacgcgtttgaaatatttttttacttcaagtgcattcaagcaaatttcatttccagacagtttaatgcatttttaaacgtgtaacttgtagcggatatacctttcttaccctaaatatataaaggaaaacacacctgattttaacttcctaggtcgtcccgcctcttcacctttcagcattgcggaggaagtagactgatattaacaaagcttaataaataatgtacctcatgaaataaaaagcagaaaggaatttgaataaaaatttcctgcatctcatgccaacggggaaacaccagaatcaagtgttcggtgtaactaaagacaccccttcatccaagaatgcaaagcacatccaataaaagagctggattataactattcttttttttttttttctttcggggccgtggggcgggagtcgggacttgaagtgccattggtacctgcagcttcttttcggggaaggatggcgcaagccgggagaacagggtatgataaccgggagatcgtgatgaagtacatacattataagctgtcacagaggggctacgagtgggatgctggagatgcggacgcggcgcccctgggggctgcccccacccctggcatcttctccttccagcctgagagcaacccaatgcccgctgtgcaccgggacatggctgccaggacgtctcctctcaggcccctcgttgccaccgctgggcctgcgctcagccctgtgccacctgtggtccatctgaccctccgccgggctggggatgacttctctcgtcgctaccgtcgtgacttcgcagagatgtccagtcagctgcacctgacgcccttcaccgcgaggggacgctttgccacggtggtggaggaactcttcagggatggggtgaactgggggaggattgtggccttctttgagttcggtggggtcatgtgtgtggagagcgtcaacagggagatgtcacccctggtggacaacatcgccctgtggatgactgagtacctgaaccggcatctgcacacctggatccaggataacggaggctgggtaggtgcatgtctggttgaatgagtctgggctttgatctcaaggccaagatgcgcaggttggggtgtgagtggattctgggtcaaaatgggccattgagcagatgaaataaagtcgagtttgtagctttgctcccctgacctctcactctcttcctctgggtacatcacaccctgccaacactgtgttaactcctgcccgctggctgtgagggagcaagaatccagcatttttgatccagtaggatctggagataatagcatccctccagtaactctcagagttagttcgtctgagtagcttgctgcagatgttctgggtcctgtgtaagcaccagacctccaacactccctcttgacctgtgcatctttagctcctctggtggactaacaaactttaaaaggtccatctagacatgcaggctccaccagaggacgcaggcaaaccttttctaactcacttgggaacattttcccaaagaaaaacaacacggctccttttcctggaaatcatagctaagcttgtaaaaaaaaaaaaaaaaaaaaaaaaaaggtaagcttaggtaggtattcgtggatgtttgtggaatccagtctgtctatgccatagtccccagtgggcatggtgggtgtgcaccctaaacatgtccgtcaacgaatatgcgatgatttagaagtctgcatccactgtatgtcttacttttctctacctgcattctacatagttttgcgatctctactgctgaatggacttgcatctagggtgcctatgaaaggggtaatggagtccacttagctgtggcgtctccagccctgacaagttaaaatgattcgtatccacaacactggtgagcatctatggggtgatagttttctgggatcttgggaggttcagcttccatattttaccgtgtgatttaagcttttctctggttctttaagggcagagagcagacttaagacttgctatagctaaaacaattaagttatgtgaaagcaatcattattgtctgacattttttaaaagaccttgttttaatgaaaagggttttcattttagtcctgccttggtagtataaagagaacgaatatatatgtgagtgtgtgtgtgtgtgtgtgtgtgtgtgtgtgtatatatatatatgcatatatatatatacacatatacatatannnnnnnnnnnnnnnnnnnnnnnnnnnnnnnnnnnnnnnnnnnnntttactacagtttgcaagatatgctaatattcataggccctgaaaaagccaagaaaaatagatgattgatgtgaacatctggatcttatttgaccaaagttgacaaaatattggtggcactgttcgatgtttaaaagtaaaattaactcaaatatcagagtttttaagtgcttgaaattcacatgctctttgtgaattgcttgtttgttgacatcccacaggatcagtctgttagcaatgctggaagacttggcggaaggagagaagctattttgtaagatgtttagttaagtaggtggtttgatattttagccactgtattcagagagatgggaacttcgggctctagaagaatcattttaaagtcaaaataaaactgatttaggtttattatttcatatttttattaacagtgtttctttctatttgaaagaaatccacagcagtgaatgtgtgatattgactatcaggttaataaaaagatgggaaacagggcttcagatacaaactgacctttggtgccgactcgcaacgtgttaacacgtcagacagccgaggtttctctttaaatggagagtctcttttcttctctgttcaccatcaaggttttgttgcagggcctatctttgtggtcaacaggtatctgaggttgataaatgcacaggcttcgtgttatgaagccaaaccacaatggcatattggaagagatgataaaaacttaaaaaaaaaaaaaagacaaagcctcttatagtacatgtaagtcatacagaacaacacataaatgaatgatggagaaaacgtctaatagttttcagaaaaacacataaatggatggctatgcagaaaaagaaagcccattgacaagagtatgtgtcagaaaatggaatcaaatgtgatcacttgggaataaaagtggtagtatttgagaattcttatgattggtctatatcagcctatggtttcaagtgtcttattaatgtaaatgtttgttttaggcacttggcatatagctttccctttaattttagttggtcgggatttcatctctaacatgatgcatactgcggtgacattttaataaccacagctacgtttcagctgagagcttcttgacatgagataataatgggaatggtggacataatttcccatggttagtggagcagcttgactgtagacctactgagaacacttggagctttacactggaaatcactttttgttttctgctccaaagtcagagtgctccaagcctggggaagacattgttccatgtttcattccagagaaaacagtccttggaaggaccagcttctgatagagggttctgcaagttaaataaagaggtaattgggtttaaagtagagtatgacttggccccacgtctgaattgagggctttgtgccatctagagaaaggcaaggaagagagagtagggagacagcagtcattctagaaaaatatctgaagccttacagatcagtagcatgggtgtcacggggaccttcctgagcagagaatcccaggcttcactctggtaccactgagtcacaatctttggtttgtatgtacagtaaaatctaagggtgctggctgccgcttaatcctttctagatatgggcggcttcttgtttgttttgttgtgtttggtttttgaagggtgacatggcttctcttgaccttagtgggctcccggttgagaatgttacctggaatcctgtctctcaggcatccactacagcactcttacccccaacaggagtagagaacgaaggcaagagagaagttaaataagcccagtcatactcctctcagagatgcttctctcggtggttatggagtttgcataggcagtattgaggccattaaagtgtcataggtttccctcatcagctaaagggaagctcatgtctctgtacccagtagaggtcagctccctttgtctcaggtagttagctagcaagtagatttcccctctggatatagttcgcattaccactctcatgtcagtggatgaactacatgaaagagcatcatttttccagtggccagtatcagcagccatggccaattttggcagcaaactgatagttttaaaaatagcattgtgatgatccagtcttaaataatacattccctgatgaactttccttgggaaactgtgtatctctgtctgctaggaatctcatgaccactttcaataatttattttgtaaggaaaaaaaccgtgttattggtcttcaagttcttagtcatgtgctgttgactgtcttcctggaacttcatacaagtctagatccctccgttttcctttctgggctgaagtttttgtggctgtttaacatccactgaaagatttctgtgtcctgttccttttagttgtgttttctaaaaagagcagcctgttcattttagcaacccttgattgaactggtacatgtcatattgtttaaaggccgtagaccacacatacctactacatagcagaaatccactgagggggaaaagaaaacaaaccaaaatcttgccctttcccccctgttctccttgtcttcatcttgtttcgtatctcagatggatgataactgcatgcaagcaacaacatggctgggtctttgagtgcattgcagtaggggtgtctcctcatggtgcaccatctcacgtgctttaaggatactcactgtgttcatagcaggttggcaaaggaggacatttgtacaagaaaacaacacagtctttgttgtgtacaagcacaaagccccccccccccctccgaggtgtattgtatgtgagagtcaaaggttctgctaaacctttttaaggtaatctgatatccccttttccaggtacagcaatgacctttcataaagaccactctgagtttatcttcctatgaagtatgtctttcactcttcttggtttaattcagacacacacttaatgtctgagcaggttaatcattcaaggactgagtttccagcagaacaacatggcaagtttcacatgtgccaggccctgaattaggttggggacatgggaagaaaagctctcccgcagcctggagagatcacaggctgtgatccttggtgtcttagtgtggtacccaggagctgagcaatcgagatcctggccttagaaagaaaaacacaagaagtatgttgttttgcatgtgcttcagtcttaaggttatttctagccatatggttgttcgagtgtgcattagggctcatttaaataaggggctaaatgcaggtaataattaaaaaaaataactacttaacatagacataggattaacagaactgaaaggtgggggggagttccctatttaaatagtaatcaactaaacactgtttttcacattgagtagacttaataaacactaatctacagttttaaaagaatttcattaaagggttattaaagaaagacaatcaaggcttgcactaattagaacacagtaacttgaagtcgtgccttaaataattccttctcatactcagaaagatgcaagtatgctttgagccagacaagagactccctccacccccaccttagagaggaagaaaaagcttctcttttgcttcggtttcagtcctggtacttttcttttatcagatgtttctcttctgaaatgtgattcacaatttacagggatctatactatactctcactgtgttcctaagcaacagtgtatggtacccgtgggcctcttcctttaaatgcagacggggaaagttttaaaattaaacagttcttttccttctaacaaggtcttcttgcaggtggctgtttgataggagccagtggtacagtgccagcattggcctctggtgagcatgaggctttcatgattttaatgatggtttctctccctaaggctttgtagattctctcattggcaccctgagttagctccttgtcaccatgcaacagttgaggggtaggattcacatggaaagcttggcatttcatctagattcttccaggaggtagaaagacgtgagattctgctaaaatatagctttccagactcggatcttcccacaggcagaaaggcagataaaagttctgttggcaggtgctgccccttgacttcagagatgataaatcccaacccctcgaagaggacagtatcagctggcctagttggtttttttttcccccttgcagggatccctgcaatttgtgcttccagcaggcaaatgccttgactaaggtaactaagataacctagtgtaaggacctcttccccaaccccacccatcagcatgcttgaaagggcatctcgatgacatgctggtgtagccactctgggttacatcttggctagttttcttgggtgatgcagctcatctcataagaggctaaccatgaaactgaacacaccctcttttacacgtcatctgtgaacatgaacttcgacagcaaaccattaggcaaccttacatttctgtctggctgtttgttttgtgttcaggattttcggggctagagaccattctctttctagttcataacctgctttctgggatttcggcatcatgactcagaagcttatgacccgctctactctgctctttattacatctcctgaaaacaaatggagagcccactgtgtcaagagaaacttgaatttttcaagggagatctttttttttccattgagaccaatatgtcttctcttatgacagttccaattgtgtatttctccgttttaagctatcaagaagacagctcagctgtaaagaataatgggccgtttacaggtgttaatatgtagtgccccaaacaaggggtttgagttgcaggttgggttttgctctcttttcagctctctgtagtatacagctaagacatctgctttgcggcatggtgaattttatatctatgttattaagtctgaagttgaatcgcagccaacccttcccctctctgctgcatctgaaatttccaaggtgagaggacaaatgcttaggcctcttgattagtacagtgcttttgtaggatatagtacatatccgtattacagttaggatagaaataaaatcaatctgagtaatgtcatcagctggacatgtcgagtcacatctcggggtaaggagagagagttccacgcaggacggcagctctggcacctctatgtttacagctccaaggctagcacctagcctcttcctctttgcattcttgccagtgtcctttttttttttcccattgaggacagaggtttgagagtattttacaacaaaattacaagtatatagaggcagagccacttactaaacattgaaacagtagcacaagagtaagattatccaaggaagcattaagaaaaatgaacattaactcaagatcccaggatctagaacaatggtgggctcggatgggttcaaaggatcttgttatttagggaaatacacacactaagttttttgttcacagaggaaaacatttattagaaacctacatacaaaaagatcagtgctaggtgttttggttaaataagttttttttttttttttttttttaaagaacaaacatttggacttggactattctgtcggtagccatgttgtcattggttttagctgacagagaactactctagttagaagggaccccagaagagttccatgtgggagatagttttgaagcaaattttggagaacagataggaaagaggtgaggggagggagtatttaaggcagtgggacccagagctacaaaacatgcaaggatgtgtgagttgtgtattgaactgggaggtctggcttgatcacggcagcaaagactattatgggactaacctaatctgagaatgtagtcttcgatcctaaactgagagaggtgttatattaatcagggatccttagagtcacagaacttattaagggaaattattagaatgacttacagtcttaagcccacctaacccaacaatgagcagttatgagtagttgctcagtcccacgagggctaggtgtttcagctgatctcctatataagctgggatgctgaagaagtaggttccaactgatgtgctggccagtaagtgcaaacaagcaaagaagagtgagccttccttctcccatcatccttatgtagggctccagcagaaggtatggtccagattaaagatatgtaccaccttgcctgggcctaagcttttcttagccgatatttctcaagatctggaccaaaaacctgtattttccagcctcaaaatctggatcacaggtgtgccgtctatttctgggttgcagtccattcccaatgtagtcaaggtgacaactgggaatagccatcacaggtgtatatagcttggaagatgttgaaaggatcctgcgagagagcaggatgtatgttagagaaagactggactggtgatgcttgatgctaggtaggcatgtagagcaaattcctgggaatggggatgtgggaaaggctgggaagaccagaagtaccaaaagatttggattccaagaggaatgaaggacagaaagaatcagaggatttgaggagtatatcagctggttggaaaagagaaagacactgtcttccggagaagggaaggcccacttgccatgttgcatggtgggtaaatgtaacgagactgactttaaactagttcatcttgggcccttatgaggatgtccaagtgaaagagccaaggaagtggtgagacctacggatcaggtgctccaggggaaagaggtgaaaaattaacgcctttgtgcctaagctatgtaatttaacttgagctgaactagtattgtcctgcaagctgctaagcacgccccccccccccatttgtggtctaaattcaagggactttgggagtctctgcaacttccttgtgaagtaatttatcccattaaattcaagatggaatcatgaatatgtgagcaataagtgttttatagtaaacagtaggtttatgaaaagaatgaattagtgaagtgattctagtgaaccagtctggatattttagctcatcctaactggccagtcttagtctcttaatgagtgatctatccccaactgtcacatccttcttcttaattaatatttattaaaaacaaaagaagacagcatacttataatttccttgtatctttttctttgaattaagtataatataaatatagatttttaaatttttaggttttagatttttaaatttaagtttttaaaggataatataaatataggtttatcaatatggattttgctttgcactaaacattcctcagagattcctctttccgtgccgacatctgtnnnnnnnnnnnnnnnnnnnntgatatgcacacaggttccacacatgtacttcttttcgttctcctcctgtttcagacctaacccaaactgtgcctgccttgatgtctgagattttcatcaccttatcattaaagaaggcttgtgcaaggctctcgaggaaggagcaaggtggatttgggctctgattagtgtgctcactgaaatattaagagaattgcaccaaagtcatgaaaataaatgataaaatccagcagcccattgaagctggaagtcagttcgggtcagcattaccaaagttcacagaacttaaagattccatttctaaagatactgaccaatcagaagaccagggctgtcaccagtaaaagtattggctgagtagctttggctacatttggcctgttctggttgaagccagactcacagcctatctgtggctttgagatctggaggaatttgtgttttgagaacccttggcataaagcaactttaaagccctgctgctcatcgttcatcatctgtttgagaaagatcagatgatttgtttacttgtaatgaaggttgaccatacttctctaggggcttttaaaaggacggatgtgtcaacttgcagatttgtccccatgaatgaaaccacaaattctcttccgattcccctccccctccctccctctcttcttctatggccatctgtgcctctttcccactgccagcccctcttcaagtggcttatctttgagtgaattcagaaacttcaaattataaaggacacccagataattggcctggtctccaaactatctgtcccctgtccaactgccagattccttcttaatgaatacatccactgacagagggatcttaagcttgcccacatcgtgagaaaatgagctcgcctgctctgcaacagcttgcagcacaggggaagcaatgacagccattgcacaagttgtctttgaatgtagttttctttcccataaatgatactttgagaatacagttaagggttattagctttctatttcatgcttggcctgtgtgtgagaataacacaagctgtcactgcaaatcagtagctgtatctggttaatgtgagcatttaatatttggctcgattaaaaattaactgatgaaagtccatgtcattggaatctgaaaatgacttttgtaagaaatgtttcaagggcatgaccaatgagtaaattagtggtttaaaaacatggcaaattaaggggagggctaatgtgagtggagatgtttgactttgccttaaaacctctacctgcttggtacagtaaaatgttggaaaggactatcttggttgtcattgctaaagatcaactcatatttttttcttcatttttttgcatttggtattaagtgaacattttttaaagttggacattatttactgaacatagaacaataaatcaactattaatttatatatgactttttcacatcatagtgtactaattatgtttatataatgttagctgtggtacctgtcagaaaccacacaagggaggaagatttggggacctcatggttttagaaggttcagttgtagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattggatttagtcccccagcacccaccatggtggccagtaaccatctgtgactccagttccagtgggtctgatgacctctttttgcttcatctagcactggtcgtgaaagtggttcacagacatacttacagaaaaaacactcatgcacataaataaaataaatatgggcctgtggggagacatttcatattcagatgataacgtgtatattggccaggtcctggagtaagatggtcgtctgacttgcggtctgggaggtataggggatccagaatcagacagcacagacaagcatgcctagtgctgtgggagaagaatgcagctaaggcagaggtatttgtgaggtcaggaaggtaccccagggagttagcctaatgaagagggaaatgtgggaccagctgatgaaggttatagggactggggagcccagcctggctggcacagagaaagcaagccagctggatcagagagaggatgctagagacacacagcctgcaagggctctttccacacaggccgatatgagaccctcacacaattgatgtcaatgggactgggaaggtgtgagtgggcagtaagagggccctgtgcctggcctcaggaccagcagagtggatgcaaggataggatgcagagattgaggaagatggggcagtggaccaagtatttcatgtaccatccattttcttttaaactatagtgaccttctctctacctatttttaaccagctgtggctgttgttttagttctttgtgagtcttgcctcatctcatattctcttaaaccagcagtgtctggttgaaggcctagaattcacagtggaataacccccttttaaaagatcagcccatcaacatttctttgagcagaattcagttatggaaggcggctgtcacagaattttttctatgtgaaaacaaagaacaaaactatcctatgaattccctctgttgggccctaagaaaggcaagtgccgtgccgcagacagcgagccagcccactcttctgtgtatgtctggaggaggaaacctgctggcagtgttttagaaccaggaagctagggaggcactgctcttggccctggtagatcactcaccttcctggtatagtttcctaagaccagaccgcatccacttctgtcctctccctgtgggttgcaacccctttaggaccatttcacaggggtagcctaagactattggaaaacacagatatttacactatgattcataaccgtagcaaaatcgcagttatggagtagcagcgaaaatcattttatggttggtgagtcatcacaacatgagaatctgtatgaaagggtcacagtgttaggaagttgagaaccactgtcctaagacacccgattatttaataggaattgaatcaaccctatttaattttggaaatatgtatcctctactgctttctattgcaacataaataaatcacaaaagttaaaatgtggcttaatgatagaatgtctgcctaacctgtgattgattcaaggctaaatacacacacacacacacacacacacgcacacgcacacgcacacgcgcacacgcacacacacacactaatagaatgcctgatgtccatatatgagctcaggaccctgtggagacttatgaggcaggtggtcttggctctaaaagaacagtactaaagggctaattggagacgtctatattactgcatgaaacaattctataaactaccacacacacacacacacacacacacacacacacacaggcctcaacagagagacagcaaaacctggtgaccagcacagatggtggccttggttgtcactacctaaccagcaactatggtttttatttgcatttaaaaatgggctcctctctaggtaaatggtataagcacgcgttcattaaattaaaaaagaatagcatagctttcatctttaggtagcacagaagtgctaaaagggccatggactctactctttcccttcaaggaagcatttatgaggtcattgcgaggcagtagtgtttgcccattggtgtgaggctccatccagaatatgtcaaaaaattcttactgttggtcttggtagctcatatctggaatttcagcactcaagactagggctggaggattacttgtagttcaaggtcagcctgcactgctggtataaacctttaatcctagtatttaagaaaagcgggcacaggcaggtgtcttttgacatgaggccagcctggtctatatagcatgtccagagtcacatggtaaacaacaacaaagcaaaacaaattgtgtgccaggcgctgttctagaagaccagagctgaaaatacaatgttcagtagccctttttccttcagccctcgcctcctacagcatggggaggtgagcattgtgcataggtaactacctgaatagcaggaaagccgcagactaaggaagggtgtgtgcggctggtgtgcgtgaggcaaggtgggcttgtgtgttttggagcatcactgcagttcacacagcaaaggataaaggcctttgttcataaaccaccccaaatttagtgttctacccttaagtttaccatcagtttcaggtcagttactatgcagcaacattaattaaagagaactactatttttggattacgtgcttgaagcacccctccacttctggatctcttgttggtctcacccccttctatttattgtagcactggctattggactgggcgttaagcataaggaaggaaggacacgagcacttattgaactcccataagtgccagaccctatgtttaaccttagtaacctcctaagaatggaaagcagaattagagattcagaaaccgcacgacctctccactgagaggcaagaccagctcttacattcaggcaaccccactgctaactaaagtcctataggacttaaagaaaaatgtaagcgtttaaacacagatccattcagaatgacaaatggatacatgcgaggttcttgtttttgtttttgttttgttttctttaagaagccacttagtcatctgcatttcagtaacaaggagatgaaatctttcccactttatggggtccaaacagtctttcacagagctgaggggaaaaaaaaaaatgaagcttttaaaggagtcttttctgtttctttcttctctggctccagcatctgtgcagcttttggaaaaataagtggtcaccgttgttttgttcagggccagacacctgactgctgtgctcttccaggggtcagcatattcagaataacaccccccccccccccaccgtgctgtcctccatccaggcagtgacttcaccagcaaattgtaacctgcctaatgcctttaataaaaaggtgggaaggtctgtggcttcaggtcctctgtcctcctgactccctggccgttctttttttaggctagacctttgtgtgtgtgttttttttccagcgtccagggggtggaatgacatgttgctcacatttacaaggagatgatgtatctcctttaaaagttagctgtaaattttcttctactcagaaataaacctacctccggccagatgaggtttccatgcctgcgtcccagaactcgagggtgcttccatagtaactcttgactgggatgcatgcagtgctgaatcacagggctcagggagcgccagggtaggccgggaaatgcttttcttcagtgaaatgtagacaccaaactctgactagtgaggacattcttcctgctttcttatgaaatgtttctgttatgttttgtctgagacaaggcctctgtatgtatctctgaccagtgtggaacttgtcatgtagaccaggctgactcaaactcagagatctgcctgcctctacccactatgtactaggattaaaggtgcagaccaccacgcctggccaaatgtctcttttcttctctttctctctttttaaattgataaatttcttcattactaagcatagatgagtcaaaaatttaaataacttcaagttcacatgcagaatgtaaaactcaagagtcaacaaaaagaatcacatgtattatttttttagtaaagcatagataaatacaaaattaaatgtttttttccaagcctaactaatgttaacacttttaagagcagaatagcatagtatttcttaagacgccaaaaaaaaaaaaaaaaaggaagagaaattgttatttaggtccagggaaaataataacctttcattaggcaagacagagttcaacatgaggctcctcaaatgcccagcctctgtggtggtgactgaactagccaactgtttattcttgttttaatttataaggaataacccaacaatgtagtattgaaaaggctgctgtattttttttaaaccctgactatcccagtgtattcccactcccagtgtctcccatcttttagtagagtgtgtgtaacaagtgctgctttaaggacaggggaggactttggctttggtgtgagaggaagaaagtcccacgctttgacctcagttctcttgggtttcctcctgatgtacccaagaaacagcaaccttttgtcacagaactgtaatctgtgtggaggaagctttcagaactacagacacattaatgtcttcagcaatctctgctcagtggtggccgttccatacaacagcagctgtgcagggtgagcttgctagcatttacatccagagccactgcggactcggtcaccgttccctagccaacttgcaaagaaacagtgtgtgtatgtgtattagaatttaccgagtttgctaggttttgttgtttttgagacaggtttccactctgtgccttagatggctctagaccttacctgtactgttctgagtactgaagaagcaatacttgaggttgtatagaccctcctgtattcacctctttagtactggggttaatggcatgacttaccatacctagctaaaagtcatattttattattttttgtggtatttggtattgaaccagagactccaagtacactaagcaccctagtttactcttctattgtgaaaagacaccacaaccatagcaacttttataaaagaaataatttatttgggtacttgcttacagttctagaaggttaaaatcattattattatggcagggagtatagcaacaggcagataggtatgatgctggagcagtagctgagagcttgcatccaaatgcacgggcagcaggccgagagagacagacagagagacagcaagcagagacagacagacagagagagtgtggcagagagagccacttggcttggcttaggcttttgagatctcaaagtccaccagtgacatatttcctccaacaaggtcacacctcctaatccttctaatctttcttaaacagttctgctctccagtggctaacgagcatatgggaggccttcttattcaaaccaccacgctaagtgcgccctctgccactgagctccatgtcattttaacaatgctgtttaatgctgtacagttgccatcattttccatcactaggacttgtgtgatccccaaagaaagtctcctcccatcaaataataactctgattttttttttccttttctggggaacaacctctgctttctctgcctataaacctggctattccacaccttttcaaagcagaataacaatttagccaatttgcattcacaaggcattttctcacaagagtattgatgtttttccatcagccaatcatgacagcaaatgcattaaaccaaaaccaagttaaatgagagagatctacacattattaaaacaattgttttagagtctgatggtatttttcttgctgtgtagccaactctctaacagaaacaactaaacggggcaagagtgactttaattgtcaggttcagagcttagctcattgttcttgaccccactggttctgggctgatggtgatgctgagtatcatggcagcagaagagaagagaaagaagctgttcatctcatgacaggaagcagaacagaaagaggaagaagctacagcaagatactctttcaaaccctaccctcaatggcctgctcccttcagccatgcctagcctctcactatttcccaacagcccattcagtgggtggcaccgttgatgaggtcggaaccctcacactaaaactgtctgtggaaatgctagagctaagctttaaataactcctcggcacttctcaggccaagcgagttgtcaatcaaaactgatgtcactctgctgtgaagggcagcctggcagctgaaaaggctgatgatcttctgcagccctgtgtatggagcagactcaggaccccagaggtccttctcaactcctacccaactcagcacagcgctctccagacaagggaattgctcacagcaacaggtggaaaatccagaaaaagagggcaatgatttgcagaaacccctccattctaaatggttaacattttttgaaagtttaggcttcagccatctgaaaaacccactttgtgagacaattcatttcaactcactgtgaaagagaaggtgagtggggtgcagagtttaagtcagtgtttgctgacctgctttgtgctttttctcttctcctaccttactttagagtggagagttaggtgagaactctcaagtgggcatacagcagtttacagggggagttttggctttaccattgaatctttatctctttctgtgtataaagtcacttatttataagggtcactggcattctgtgtcagctagagtggctctggggaggctacttcacatagactgacccttaaccaccattttggacagtagggtatgatagcatctggcctggttggaggcctgacctgttgtgatagaattgcggttggagtctggacacaccacaccaggccaatgagagaggtttattgtgaaggaagagggcaaacagggtgatggagatgaagggagaagagagaaaagagagggcaaagttcaagagggtctgccttttatttagtctgatttaaccgcttgcatgagaggtaaaccagatggatactgggaatgtatggcaattgccatggcaacagatgcatgggtccctgtcccctatgggtgacatcaccggagggaacctgcaaccaaaaaaaaaaaaaagctggttcctgataccaacattgcctgtgatggagaaacaaagaagtagattacagacctgtgagctatcctgaaaggaagtgcagagtggccattgggcccaatggtctggggaggtgactaatggcagtgattgcagggtgaagctggggttgaacctaaccagcaccagagtagcttgtgtagacacactactgctgttgttccagacttgagtttccagaaagctgcttctctcaaggccttggatgtgatgactcggggcaaacgtgagcagccgcaggacgcttgtttaggaaaccatctatcttgtgtagacagagtatctgagatgaccttagcagtaataacaatggtaatgataacaacagcacagcctttcccctggcacaagaaaccagttttgtaatgaaactggaatttccctggggaatagccttagagagaactgggcgggtaagataaaaataaccaatataaaatagtgtctgattgtgttctgttctctcttctacacttggccttgcgtgatttactttgtttagctgtcatgttgagtgttacttcatttaactggtgcatcctttggtccagagaaagaaagatggctcagtgggtttagaggccattagtcaccttgaatttttacctcaatgcacctggcagagaggtggaaatgactctgggcgaatgttgccctggggatggaagccaagtctctttggaataaggggtaatgggtttggttttccagggttctggaggcccaaatctgagctccccagcacatgggcatgtgtacagtcatgggtcattaggacatcccctgaagctgttttcttgccataagtcagaatcttgtaaattgactcttgtcataacaaacgatgcagcagccatatgatatggctgggctccctacccctttacccagaggatgccaatttccaagtgggcatagaagattttacttttatgttgactctaacagggggtctgtcttgctagaccactttgtaaatggtgacaaatagtggtggtcatagcatcatggagaaaagagtgagacttccaaacctagccaagctctcttggttccagattttatgcaaatttgtataatagaatgcaaatgatttcccagtaattcagggcccaggggcccatgttcatctgtttttagctgtgtacctgggcttttttgatatggttactttggagtgagggggcatatgcagtgaagcttaaagaaggctggggggttctggcttcctccatcagtagacgctatgcctgggattgcatcttgaagctgcagcttctctgtctacagccacaggccatgacttacatatgtggggaacaggagaaggtcaacccagactaacatatttttaaaaagtcctttatttctgctcttctcccccaaacatttcagtgccatagtatatatcatttattcatcgcacatgtattatttatcggctataagtactgcagtaggtattgaaaagaaattagcatgttctcctcctaaatgtgaaattgtggaactctggctgtagcttttccacttccaacatgatagctggcccctgtgcatgttgactgtgtgagtgtggtgagtctcatttcagatgggttgagcatgtaaatcatgtgtcaagtttcaaagactcttggcatcaacaagtgaattcagaaatgttcatatttatataaacatgtttgtgtatcatttttatattaactgcttttttaaaagatagtataaataaaaatatattcaatatgaccactagaaggattgacatggtgtatatagctcccattgggtttctgtagggcagcattagaggagacttctagcatctcagtatacaatgtagtcaccttctcactttggtgtttgggaattatatagaattgtaaaagatgacctttctttttccacaaatgtggtctagtttacatgtttgcagcatcctgtataacccacctcagagtatgttcctatctatagttattccactgtctgtccactgaagtagtcaggcaggctttttcttatcttcatagaggaagatgcagagtcagggtgacttgctaatctacagaattagagctgagctgtgaatagaattctagcctttgaacttctatccctattggatagaaggctgttagaaaatatactaagtatataagtagccaaggagctaaagggatctgcaaccctataggtggaacaacattatgaactaaccagtaccccggagctcttgactctagctgcatatatatcaaaagatggcctagtcggccatcactggaaagagaggcccattggacttgcaaactttatatgccccagtacaggggaacaccagggccaaaaagggggagtgggtgggcaggggagtgggggtgggtggatattgggggacttttggtatagcattggaaatgtaaatgagctaaatacctaataaaaaatggaaaaaaaaagaaaatatactaaagcttctccatatggacatttttctttaccaaaggctattgtgcaaacacagtccattcagaagtgtatgtaggttatacatttaggtaacatatcagacagcttcattgtgtgtgtgtgtgtgtgtgtgtgtgtgtgtgtgtgtgtgtgtacttgtctacagctggataatatgacatagccatccaaggttttagctaatgcttagttttaaggtacaacttctgttggatttgtaggcttgttagggaagaacaaggtcagggtagcaggtgcattgtcactgttagcatgtataacatttataacatcttctcatgtcaagttcttggcattataaggcatggctgagaagctctgattgagattcagtcatccatgatatagaatggcaagacaagttgcctggaacttcaaggcagtgaattgtaaccaggaagtcacttgacatgagaggtggcctaaacacggagaggggaagagaaaggctgtatcggtcaaggcaggtaagatgtgtatagttgttgagggcactgaggcccaggagatttcgagtgtcttcctagctttaccaggtccacaatgttggaacatgttatagtctttctgtttctttatgttccattgagggagttgggttagagagtctctcatcattttgaatacatgacttttgaaggctagagaatcaacaaagagaaagctaataagctaccaatcacagcagcgagcttttggctctcactgcccttccttctgtcatctagcagagtgatgtgtggctcatgtgaccattgccttggactgttcgcatgtcctgatggaacacaagcttatgtagaattcctttatgacggagaccaaaacatagcagttggagtgtgagacctaaaagcatggttctctgcttgtttttttgagcttaccctgatctcctaacattttctgagttctaattatttctcccactattccatctacgctatacttctacagattaaaacatttctcagctagagatgaggcagtatttcttcttagaggaattttaatttaattgagtttcctatgttcagggcaacaaaagtacttgaatagtaaggtagctttgtgttgtggaaagtgagtctcaggggcgcatcccctctgcgaggccctagtcaccctcttctgcctcattattctttgcttagcacggagaagcctggcaggctttctgttggaatgaagagattggcagagccaccctagacggcagcatcccaaaacactgtggcagaaggtttggtctacataccaaggcagccagaggattaattgcattctgtgatcacagaaaaggtgctgaattatactcctcgtgttttaagaatgacaggtgtttgctttgccgtctctgtaaacaatgcttcacagggaatgcagaagccagagttcagaaaaagaaataaataaatgaaatgtaccaaagtnnnnnnnnnnnnnnnnnnnntatagttgttgagggcactgaggcccaggtagatttcgagtgtcttcctagctttaccaggtccacaatgttggaacatgttatagtctttctgtttctttatgttccattgagggagttgggttagagagtctctcatcattttgaatacatgacttttgaaggctagagaatcaacaaagagaaagctaataagctaccaatcacagcagagagcttttggctctcactgcccttccttctgtcatctagcagagtgatgtgtggttcatgtgaccattgccttggactgttcacatgtcctgatggaacacaagcttatgtagaattcctttatgacggagaccaaaacatagcagttggagtgtgagacctaaaagcatggttctctgcttgttttttttttgagcttaccctgatctcctaacattttctgagttctaattatttctcccaaatatcattagtctgctgtcaccaaggttctaaccccctacacacactgatcatatgctttagaaactcacatcttgttctttgtctaaaactattccatctaccctatacttctatagattaaaacatttcccagctagagatgaggaagtatttcttcttagaggaattttaattttaattgagtttcctatgttcagggcaacaaaagtacttgaatagtaaggtgctttgtgttgtggaaagtgagtctcaggggcgcattccctctgcaaggccctagtcaccctcttctgcctcattattctttgcttagcacggagaagcctggcaggctttctgttggaatgaagagattggcagagccaccctagacggcagcatcccaaaacactgtggcagaaggtttggtctacataccaaggcagccagaggattaattgcattctgtgatcacagaaaaaggtgctgaattatgctcctcgtgttttaagaatgacaggtgtttgctttgccgtctctgtaaacaatgcttcacagggaatggagaagcccagagttcagaaaaagaaataaataaatggaaacgtacccaaaggtgaagttctctgggagccagttagctctttaaaaggacctaaaaatgaactatttcatgattggaacctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggccctggtgttcccctgtactgaggcatataaagtttgcaagatcaatggacctctctttccactgatggccaactaggtcatcttctgataaatatgcagctagagacacgagctccgagggtactggttagttcataatgttgttccacctatagggttgcagttccctttagctccttgggtactttctctagctcctccattgggggccctgtgatccatccaatagctgactgtgagcatccacttctgtgtttgctaggccccggcatagccttgcaagagacagttatatcagggtcctttcagcaaaatcttgctagtgtgtgcaatggtgtcagcgtttggaagctgattatggcatggatccccaggtatggcatctctagatggtccattctttcgtctcagctccaatctttgtctctgtaactccttccaggggtgttttgttcccaattcaaagaaggagcaaagtgtccacactttcatcttcgttcttctgagcgaggtaacccaatcacaaaagaactcacatgatatgtacttactgataagtggatattagcccagaaacttagaatacccaagatacaagatacaatttgcaaaacaaatgaaactcaagaagaatgaagaccaggtgaaatctttactatctgtggtgtgctgcctacgcctgcctttcatttcaatacacatgaagcgagtccagccccatcccaagtcctctgatctaggtggtcctttctggaacccagcttgacacctcggttttggatatttttccccttttttatatctcagaaaaatcttcttctgtctaaacactctaaaattcccatcatttctgacataggaaaacatggtactggcctcaaactctttgtctcagggacttccaaccttgctatggcaccctgccaagtgtggtcacatgatgagtgatatatgcaaatgctttctacacatttaggtgtaaaagtatcctatttgcatatctattaccgtgcttaggctacagatcttggacataagtgttcagagacattcactaaatgatgtgcagtaactaccagtttttaactttacctaccttccttccttccttccttccttccttccttccttccgttcttcgtttgttctacagttatataagcctacatgtgtcttgtactctgctaagcatgtgaatccattactttggcatgctgactagaggtgcacacatctttttattgttttaagacctgccatattttccaaagaccctgcttagctcttaaataataagcagttattttaaacgttgcctgtgttgtatctttgtagcttatgtctgtgattaattttgcttccaaaacattgtgtcttcttgatagcttgaggttctagttcataagattggtatatcttggtatatccccatgagtggcacttgaaaatattgaaaattgtactccatttttgtgtttgtgactactaaatgaactaattttccaagttcctctgaaatatagacagtctcctaattccagcccaaattgcaacatggagatattaattaacagtcagcaaatcaatgcctgtattcctttggtgatttatactatattataaaataaaatcaccgaacagaagagcagcagattagaactgcgatgaataagaatggaaaacaattactttttaaagtttggtgtttatttactgacaaggaaggaaagctgtttgattagatggatggagataaggtagagttggtggcaagggcagcggtggagaacatgcagagaacttgtcctagctcaggaccattcttcatatcacctttgtgactttgagtctcagtctcaaagcaaagataacgtagaataatctcatgtgccatcctcatgaaggctactgcagccccggctccactcatcacagctcccgtgagcctgtgttggtggaaagatgctgctttcaatgcccaaacccaacaattttgttttcaaatccctcaaaactaaaataagaaaccttggtgacataaatgttccaaattcaaaatatccacagtgaactcatctacttcctgtttgggcctgctcctccttgtctgtctgtctggctaatgacatcatcacccaatgggacaaagcccaagctcttaactgtcgtttaccttcttcttgctgccagatggagctttcctggatgaattgtatggtcctgtctgacatcaagcatctggatgcacagtcctccactcttccccctcatctgaattccagtgttaaaatatccaagctcaatccctgtttctattttttagttcatttattgaattagctcctcaattgtttttgactatcatgtgactccccatctcatctagctgcttatttatttatttatttgtgtgtgtgcagccttcctcgggggaattaggacactgcagctgggcagtgtgtgctgtcttttgaatgatcctccatgttgagaaggatgtcagaaaagctagccttgagatgagcatagtgatgtcattcctctggcctgtcatgagggcactgtgaggcagctgctagctcccagtgtgcctaggagtttgggaactaggaaatgttgacttctggctacgtatcatatgcccttctgaagtttccctccaagcctccccaactctttaggctattttttctctggtatttttggtacctcaccacctctagtaggctctgttctcttcccttcctgccctgaccctaccactgtcccagaatatctcatatttgaaatacatttaactcccctttaatcaaaattagcttttgcctacattctttctgcatttataagaagtataacaggtttcacagctgtttctttttgtttttgaaacagagcctcaggtagtcaaagctggactcaaactcattatgtagtcaagggcaaatctgaacttctgtttctcctgcctctgcctcccatgtgctgggatttatagggatgttccactgtgcctggtttacttggtgtttaacaaggactctaccaattgaactatacccccagccccacaaataggtttatattttaattattcatccacatctctaatgtcccctggaacagtggaaaacctgctcagtttcatgtttgatgaaatgaacttcctaagtagtcatggcaatgctgaggacagtgaagagaacagagaaggcattgctcttacatggtggtgctcacccttgccgtaagcatagttttcacttcacgggtttactccacttgtgaatgttccagaatggctgacatgggatcaaacccccatggcgatgcttttatgagcatggcattagaagccaggctagacaggtccagaagtggtgaagatatgggaagcctgtctgtctgctgacacagaaagtgaaaggtgagagaggacccttctgttttcaggaggggaacaccacccctctgcacccattcctctataacctccaagtatgtatgctgtcaagtttcagttgccaacagaatgctgtaccctaaggccatgctcactaacgctgagtgaagggcatgttcagccctttccattcctgctctatgatgcagaactcccctctccctgtgcctacatgaaaactcccatcaccttcacacagtcagcgtgctgtgcacaggtcctgatatgagagcagacaggccagtttgtgaaattcaaatgtggcattccatgcttgtataagaagtgtgctactgggccactcagaacatgtcccgtccagtaactcagcagggtctacccatcttggatttgcatatgttcctctttctcagattcagagggtactgtcccagctgtctcaggtacagctctctcaaaggccatatgctcttggggagaggtcaggagaatcccaagggcccctttcgtgccctgcaagcacaaggccatgggtcatgcagagaaagaaccagctgaagcagcattctccctgatgtgttcttcccatgcatctggtcttctgagtaatggtccttagtgggaatgagaactcctcagtccgtatgtagacattaagctcacacaaccaactgcttcatgaactttgttattccctttagatggatttctttctccagttccctcttcctcacactgcttcaccccacctcaccataattcttcttgcagatgggggagtagctatgggtgagaccccaggggttagacctctgttccctgagatgcccgaatcttctggccaataagtcttacaccttaaatgcctggcttttgccagcacccacccttgcttgaggaaaaccaatgggggggccaggccctgtgaccctccaggacataattacatgggcctgacctagtcctggagaaaggttagctttgagtaaaaaaacccaacaatcccctcaatataattattgaatccaatatatattcaagattttctcatgccagcgtgagtgtgtgtgtgtgtgtgtgtgtgtgtgtgtgagagagagagagagagagagagagagagagagagaatgtgtgtgtgtgtgtgtgtgagcacacccactcacgcatgtgcatgcgtataagtttgcatgcatatgtggagtcagtactaggtgtcttctgaacttggagttcacaagttcaaaagcaaggctaatcagccagcaagctctggtctcttgtctctgccttctcaggctaggattaccagtgtgtgccaccacacttgggttctgtgttagtgccagggattagaactcaggtccttatgcctatgtagcagctctctcctttttcttttttcctttttcttttttctttcttctttctttttttcttcctttctctctttcttttcttttctttttttgtttgcttgttttgttttgtttttcgagacagggtttctctgtgtagccctggctgtcctggaactcactctgtaaaccaggctggcctcaaactgagaaatccacctgcctctgcctccctagtgctgggattaaagatgtgcaccaccactgcccggcagcagttctctcctaactgagcaatgtccccttcctcgtgccatttagaataaaatgttccaagtactcctggagctatcaagttgaaggtagtggcttacaattaaaatttcaaaatagcaaacagtttaaagttcctgttgatatctggggacacttacgcattgttgtacagtttgcagcagctgtatgaggtacgtgtgtcccgggcctttgctctgaagcctaggaatatggcccagagcacacccagccaaaggccttctaattgtgactctcaggaaatctcctccaatttgatgcacctctgaccctggaggtcttaatgcatcgactcccccttgatattgatccccttagaggaaggcaggtcatatatatgctccagttcagtcctgccttcctccctctgactcaaagtgtctccattaagcccaccaaaaccatagttctaaatacccactactagagcagtttaatcaggctatgcagggagaaggggagggagagggagaggcagaaactgctgttattaaagttctatggaggctccctaggccatgggcactagtgtcacctctgtggtagcactcagtggcacaccattacccttgtattttcctactatagttaggctgccagtgctgggtgctatttatacagaaaagaaaggcttcttagctggtacttagactgaggtcagattttcctttggaacaggaagcagatgccaagtttattttaaaagtgttcttggtctacctaaaactagagggtatgaagactcctctgagggtaacattctcacaatataatgagcctttgtttcctccaaaccaaacctagggttttaatctgtgctccttagggtttttgtttttgtgtttgtgtttttccccaattggacagaaactagagacacctgggaacaagcctcagctgagaaactgcgtgcatcagattggcctgtgggcatgtctgtgaagcattttcatgattaatgactaatgtaggcagtgccacccctgggccgatgaacctggaccgaataaaaaagcagactgatgaagcctttaagcaccattcctccatggtctctgcttcagttcctgccttcagtttcctgccttgagtctcttccctgactcccctcagtgatggaatgttaccttaaacaaaccctctccttcctaagtttgttttagttgttgttttgttgttgttgttttgttttattttgtttttacagcagtagaaagcaagttagaacatgtcccattacaaaaaggtgccctgtgacttactaggggtatatctgaatgtaaatttctcaggtcacctatgggaagggacttagccagttttgagaccatgggaaaaaagaatctggagttaggttggatcttcatcatctttactgctccatgcagtgagcactgtctctctgggagcagagacttcccagctgactgagaagtgattatttgtttagaacttgagaagagaaaagcagctacaaccgttttgtactcagtgaaccatgccgacattttaggttggggaaataagcagctaaattctaggtggtttgttttattgtcagaatgatctagtttcacaggcagaagagagtttatctccaagacagaaaaaggttaagtgtctgtcaaggaagattaaaaactcagatcggaaagatccatttgatagctagtgaccaaatggccttagagaagacacggagcagctctccttctgagggacaagctttcagtgctggacagatgacagttgtcctggtatccggtcccctccctgccatggttattatgttagttcctagtgggactgtgttcctgctcccaattaaccaaaaggcaagatgaaaaaaattagttgaatttaaaactaaagaaagagaggggaaatatgtcttgaaagtttcattaattgcaaaatgatgctaatggaacattcaataaaaatacttctcagaaccaacagttattctcagaaaggggccattaaagccaagttctcgaaaactgaggaaatcccgggaacaaaacccaaatgcctgggagttgggtttcagaagacattttgagttggtcccgctcagtaatttacaaaatagggtggaatcgctgagcattctaaaaatctgttccactgcagtgggacagtaaagctcagcccctcatgagccccccatgagccatgcacattcaacttgtctgctgttacaccttttagtgccatttattagccattgtttggtaatcgtggacctaggtttttgacagtcatgatatagctttggacgaggatccagcgtccttcccagaactctctagcaggttatggaagagccaggttgctgactgctgtttcaaggaagtaaggctttgtaatggcattcgagacatttggacatatatttaaagccaaccttaaagacaagatttctgtcccattgagatgatttaaaagtcagttttccacccagcagataaaaaagaaagataaatgaaatcagctttcattacttaaactgagagctaaagttagtatgtcaacggaaagcctactgcctataaataagtatttttgaaaatgtgcagaaattccattaagagtaaattttgatcctttggtaaatgaaagaagaaattactagttgcaactcatgcattggaattgctgttggaaaaaaaatttgaaatagcactcaggcataatcaaagggtgacctgcagtttaacttccttaattatataggtcaagaacttcaggtaacagaccagtccaagatgagtgactgactcaatgtctgtctaatcagttatagtctctacctgatcaacatgaagcccaccttcccttacagggctataggctactgtcaaatagaaacctacaggtctgataatactggttactactgtgagctaattataggtaattttactgtacaatattactactagtatgtgcttttgaaagataaaatagctagtagaaattgctcatggactatcagacaacatgatgataacaaaaatatcaataataaataattaaaccatcaacagccaaaccaattatcagtctatactgtatatgtcatttcttctgtgttctaaacatgttataattaactctttttctatgtggaagtatcttaaaataatgattactggcatttttaaagtcttttaaaattgtgctaaaatgtaacctacagtgtacattgtaagcattcttaggtattcagtggcagtcagtgttgcacaatctagtttcaaattgtttcttaatctgctcataggatctttcatgaccttttagatgacccaacccagagttcctgtcccttccttccctgcctctagctgctggcaacccccatgctgtctctatgaatttgactagtacaagcgacctagggaagcaaagtcatacttgtgaatgtcttcacggttcatccatcttgtgccatgtgtcagaatttcccttcttaaaggcacatattgtccccttttgtgtgtatagctggctgtcactcattcacctgggttgcctctagacgttttgtgattgtggacaaggctttggtgaaggtgttcagaatctgatcaagcgcccactctcagttctttagaatgtgtacccggaagtgggttttctggaccatggtgatgctgtttataagcctttgaggaacagccacactgttttgcagagcagctgcaccaatatccattcctaacagctggaaggggttcagcttctccctccttaccaacacttgttaaccttcgtttgcttgtttttattttgttttgttgttgttgttattttggataacaaatgatacatttatttgaaaataattaataaagtctatcatttattagtgataaaaagcaaatttgcatactaatgggatgggtgtgggattttcaaaaatcacttttatctttttacagttcagccatttatcctctcctgttccccctcccacagttcctcatctcattcctcttctcccgtgtctccaagaggatgtcccccacccctgccaggcctccccactccctggggcctcagttctctcgagggttaggcacatttcttctcccactgaggccagaccaagcagtcctctgctgtatgtgtgtctgaggccttgtaccagctgttgtgtatgctggctggttggtggctcagtgtctgagagatctcagggatccaggttagttgagactgctggtcttcctgtgggatcacccgcctcctcagcttcttccagcatttctctaattcaaccatagagtatttactctaacttcagtccaatgattgggtataaatacctgcttctgtctcagtcagctgcttgttgggcttctcagaggtcagccatgctaggctcctgtctatacgtacactatagcattagttatagtgtcagaccttagagcctcccattgagatgaatccaggttggtctggtcactagaccacctttcccccagtctcttctccatttttgtccttgcagttcttttagacaggaacaattctgggtcagagtttttgactgtgggttggcaacccaatccctccacttgatgtcctgtctttctactggaggtttactctacaagttccctctccccactgctggacatttcatctaaggtccctccttttgagtcctgagagtttctggcatatttaccacatacctcccacccctccgaggttgcatatttacattcattctgttggcccttggggattcactccagcctccatcccccgtacctgatcctgttctccctttcccctccctcctcctcctctcacccagatccctcccttcctctgcctaccatgattattttttctcccttccaagtggaatttaaacattcttaactcgacatttctacttgttaatattcttgagttctgtggattatatcctaggccttctgtacttttttgactaatgtccacttattagtgagtacatgccatgcatgtccttttgggtctgagttacctcactcaggatgatattttctagttccatccattttggggtaaaactcttgatgccctcattcttaatagctggatagtattccattatataaatgaaccaaattttttgtatccttttttttatttgtgggacatctgagttgtttccagcttctggctattacaagtaagactcctatgaacatagtggagcatgtatccttgaggtgtgatggggcattgtttgggtatatgcccaagagtgaaatagctgggtcttcaggaagatttatttccaattttctgaggaacctccagattgatttccagagtagttgtaccagtttgaaattctaccagcaatggagaagtgttcctctttctccacatccttgccagcatgttctaccacttgagttttttgctcttagccattccaattggtgcaaggtggaatctcaaggttgttttgatttgcattcccttgatgactaaggactttgaacatttctttaagtgcttcttggccatttaagattcctttgttgtgaattctctgtaccccattaaattgggttgtttaattgggtcggttgtgtcttatggaggttaacttcttgaattctttatatactgtgtatattagccctctatcaactatggggttagtgaacattttctcctactgtaggttgcctatttatccttttgactgtgtcatttgccttacagaagcttttcagtttcatgaggtcccatttagcaattcttgatcttagagcctgaaccgcaaccacaccccacgccaatgagtttgaacctcttccccactttctctattattagattcagtgtatctggctttatgttgaagtccatgatccacttggactccagtttgtacaaggtgacaaatatggatctattttcattgttctacatacagactgccagttggaccagcaccctttattgaagatgctttcttttttctattgtatatttatggcttcattgtcaaagatcaagtatccataattgtgtgggtttatttctgagtctttagttttttttttttatttccatacttatttatttatttattttatttggggggttgttatttttatatttatgtatttttttaattggatatttatttcatttacatttccaatgctatcccaaaagtccccgacacgctcctccacccactcccctacccacccactcccacttcttggccctggcattcccctgtactgaggcatataaagtttgcatgaccaatgggcctctctttccactgatggccgactaggccatcttctgattcatatgcagctagagacatgagctccgttgggggggggggttattggttagttcatattgttgttccacctataggattgcagatcccttcagcaccttgggtactttctctagctcctccattgggggccctttgatccatccaatagctgactgtgagtatccacttctgtgtttaccaggccccgacatagtctcacaagagacagccatatctggtcctttcagcaaaatcttgctagtgtatgcaatggtgtcagcgtttggaagctgattatgggggggatccccggatatggcagtctctagatggtccatcctttcgtctcagctccaaactttgtctctgtaactccttccatgggtgttttgttcccaattctaagaagggacaaagtgtccacactttggtctttgttcttcttgagtttcatgcatttagcaaattgtatcttatatcttgggtattctaagtttctgggctaatatccacttatcagtgagtacatattgtgtgagttcttttgtgactgggttacctcactaaggatgatgccctccaggtccatccatttgcctaggaatttcataaattcattctttttaatagctgagtagtactccattgtgtaaatgtaccacattttctgtatccattcctctgttgaggggcatctgggttttttccagcttctggctattataaataaggctgttatgaacatagtgaaacatgtgtccttcttaccagttggaacatcttctgggtatatgcccaggagaggtattgcgggatcctctggtagtactatgtccaattttactgaggaagcgccagattgatttccagagtggttgtacatgcttgcaatcccaccaacagtggaggagtnnnnnnnnnnnnnnnnnnnntgtcacctgaacttttgatcttagccattctgactggtgtgaggtagaatctcggttgttttgatttgcatttccctgatgattaaggatgttgaacattttttcaggtgcttctcagccatttggtattcctcaggtgagaattctttgtttagctgtgagccccatttttgaatggggttatttgattttctggagtccaccttcttgagttctttatatatattggatattagtcccctatctgatttagggtaggtaaagatcctttcccaatctgttggtggcctttttgtcttattgacagtgtcttttgccttgcagaagctttgcaattttatgaggtcccatttgtcgattctccatcttacagcacaagccattgctgttctattcaggaatttttcccctgtacccatatcttcgagggtttcccctactttctcctctttaagtttcagtgtctctggttttatgtggagttccttaatccccttagatttgaccttagtacaaggagatagtaatggatcaattcgcattcttctacatgataactgccagttgtgccagcaccatttgttgaaaatgctgtcttttttccactggatggttttagctcccttgtcaaagatcaagtgaccataggtgtgtgggttcatttctgggtcttcaattctattccattggtctacttgtctgtcgctataccagtaccatgcagtttttatcacaattgctctgtagtatagctttaggtcaggcatggtgattccaccagaggttcttttatccttgagaagagtttttgctatcctaggttttttgttattccaaatgaatttgcagattgccctttctaattctttgaagaattgagttggaattttgatggggattgcattgaatctgtagattgcttttggcaagatagccatttttactatattgatcctgccaatccatgagcatgggaaatctttccatcttctgagatcttctttaatttctttcttcagagacttgaagttcttatcatacagatctttcacttccttaggtagagtcacgccaaggtattttatattgtttgtgactattgagaaggctgttgtttccctaatttcttcctcagcctgcttatcctttgtgtagagaaaggccattgacttgtttgagttaattttatatccagctgcttcactgaagctgtttatcaggtttaggagttctctggtggaatttttagggtcacttatatatactatcatatcatctgcaaaaagggatattttgacttcttcctttccaatttgtatccccttgatctccttttgttgtctaattgctctggctaggacttcaagtacaatgttgaagaggtagggagaaagtgggcagccttgtctagtccctgattttagtaggactgtttccagctcctcgccatttactttgatgttggctactggtttgctgtagattgcttttttcgtgtttaggtatgggccttgaattcctgatctttccaagacttttatcatgaatgggtgttggatcttgtcaaatgctttctccgcatctaaggagatgatcatgtggtttttgtctttgagtttctttatatagtggattacgtggatgggagtctttagttctgttctgttaatcgaactgtttctctttgtaccaataccatggggtattttatcactaagagatatttattcctctgtagtatagcttgaagttaggaattatgattccctcaaaagttctttagttgttaagaattgtttttgctatcctgagttttttgcttttccatatgaaattgagaatggctctttccatgtctatgaaaaatgtgttgtaattttgatagtgattacattgaatctgtagattgcttttgatgggatgacattttactatgttaatcattccaatccatgaacatgggagaattctccattttctgaggtcttctttgatttctttcttcatggattgaagttcttgtcatatagaacttgtttggttagagttacccctatattattgatgactattgtggagggtgttgttttcatattttctttctcagcccatttatcatatgtataaagaaaggcaactgatttgtttgagttaattttatatacagccactttgctgaagttgtttatcagttatagggactctctggtagaaatttgggggtcgcttatgtataccatcatatcatatgcaaatagtgacaccttcacttttttgccagtttgtatccccttgatctcctcttgttgtcatattgatctagctagaacttcgagtactatattgaatagatacagggagagtgggcatccttgtcttctcgccgatttcagtgggattgctgcaagtatgtctccatttaatttgatattggttgttggtttgcagtaacttgcttttattatgtttaggtatgggccttgaatttatgatctctccaatacttttaacatgaaggagaatttattttgtcaaatgctttttcagcatctaatgagactatcatgtaatttttttctttgagtttgtttatgtagtggattacattaattgatttttgtatattaaaccaaccttgcatccccgggatgaagcctctttggttatggtgaatgatggttttgatgtgctcttggatttggtttgctagaattatattgagtatttttgcatcgataagtaaaatttgtctgaaattttctttctttgttgatctttgtgtggtttatgtattagactaactgtggctttatagaatgcattaggtagtgttccttctgtttctatcttatagaatagtttgaggagtgttggtattagctctttgaaggtctagccgaattccattattgtgttgaaaacgctttatggtcctttgagctggaaatttaggctgtcttctattcctgttattctcaggtttggtttttccattgtgtcctggacttcctggttttggggggtttaggagcttcttaaccttgtattttctttgacatttgtcaatatcatctatgatatattctacacctgagattctttttctatctcttgtgtactgttggtgatgcttgcttctgtatctcctaaactttttcctaggttttccatttgcaggattgcctccatttgtgatttctttgttgtttttacttccatttttaggtcttggactgctttgttcaattcctttacctgtttgattgtgtatttcctatatttgtttcatccttaagggcttctacctgtttacctgtgttttcctgtatttctttcagtggattgtttatatccttgttaaaggactctattatcttcatgagatattatcttcatgaggttttaggtcagtatcattattttcgggtgcattgaggtatccaaggcttgctgtggtggaataactggattctgatggtgccaaaggatattgggttctattgcttatggtcttgttcttgcctctctccatctggttctctctggtgttaactggctttgatttctctgtctggagcctgctgcctatgtccctgggttgctgcaggtctcctgggagacctgtgttcctggctgcagcagttctcctcagaggaattcagagtgtggtatctttagaggagcagacatgctgatgatctgcctccacgaagttgcaggccaaaaggcaggtggagttcgagcataggggagggatcctgtgccctaggctctttgggagtcctagctgttgaggatatttgggcaggtcccttgcctgttgctctgggtgcagcagatcttctgaggggccttcagactatgaggtcttcagaggagcactgtagttgtttttatacaaagaattaagttttgactcagtatttggtacacagcaccttcaaaagttttcagagtttattaatattttgatttgttaatgctgagaaccccacttcttattctgtatgtatgtatatacacatacacatgccctcatacacacacacacacacacacacacacacacacacatacatatatatatatttatatttatttatttatttcccccctcactgggtaatataattatcactctgattcacatctccctagtaattgatggtgtcaatcaaacactcttttgcatgattattggtcatttgttttaccatttaaaaattgcttttcaggttttgctcattttaaaaacaaacaaacaaataaacaggttctttgtcttgttgtgtaataggagttctttatattctctgggtgttaagcccttatcagctatgtggtttgcagattcttgagagttacgataggccagaagctctttctattaagcactttgtatacaggacctccatcctttctatagccttgataggtaaatattaccactttatttaacatgtgtggaaacagctttggagtttaacattttcaagagcagagctaggattggaactcaggtttggttattgtaaaacctataatctcatgcaattaagtgtggatatttcacatttagactttttaattccccttactaactctttaaaaaaacagaagtataataaatgtagcatgctattgtaaataataatcattccagcaagttgttatgtttatttaaaaatttcatagatgcatataatgtgttttcatcacatcttcctattccttctcttctactttctcccttttctcccaaccacttcccccgctaacttcatgtgctctgttttttagtccactgaggccatgttgtgttgacggagcagtctgttagggatcacatcttgggagaaaactgaccctgtcccccccaacagccattcattgccagtgctcctgaccagaggtagctgcattgaccttcattctactgaggtcttagttggcttgatcttgtgcaggtcctgtacattcagtgtagtgttgtgagttcatgtgtgtaagggtcctgtcaatatccaaccaatactgttttgcctcaaacttccactcttctggctcttagaatcttctgttttgatccctgagccaaaagagagggtgtgatataaatgttccatttagagctgaacactcttgttctcccagcatattattttttttttaaactccatgtaggcactctctaactaaaagaaagaatatcaccagctcctggaaactattcacacatccctttacaaatcacagtccccgtgcatctcacagaagggagaatttacagcagctttcatggtagccagttcttagcttttcctcatacctttgacccctaaacatgaagatctgagtgacctaaatagttgtgcttatgagttaaccttatatgcatgcatgaaattagtatgtgtattttgtatgtttggattcttttgttcacagtttaagtttgtgaatattggtggggctgaattttcccatttctttcttgaattttgttgtgaaaccctgtctaatatgtagctgtgctagatattctatctaccctgtattatgcttctgggaacattattgttgctgttctttggcacctactgcatatatttctgtggggtacctgtcaaaaagagaagacatcatagatatattcccaaacagttttccaaaatggttgtacccattttcactcccaccagctcatgcaagtttgtgagtctatatatattccagattcagaattttttttcattttaaccattctggtgagtttattgagaggtcaatttagtttttcctgacccctaattaccagatagaccacctttttatgtttattggttatcctcttttatggcatgcctattaacatctcttttatggtttttgatagttgtttcctgaaagacttgcagttctttatgtttttgtttttttgttttcttttgttttttgttttttgtctacaagagtttcatgaatcctatgtgttgtagacatcttttccctgtctacatcttgactttgttacccttttgggaggaaccttttgatgaaaaagatttaatttgaatggagtctgatttatcaccttctcatttaagccttgtctcttgtttcttactctaaaatcatgatgacttttctcctggttaactcccaaaagttgtagcatttgctgttatgtttatatccatgaaatgtgcctgtagttgggttaagtgaatgtccgaactgggggaagggtcatgctttccttcttcgtatacggatattctattcactcagcaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttttctgactcagtagtttctaaatttatatgtgtcacagtgccactctgaataccagctttataataagtcttggtattgttgaaggaaaagttacttataatgtgtactaaacacgtcagggaagattttgttcagcgggagaccactaactgtaatagttacatgagcatcctcaatgtaatcttactatggggacagaaaagaggtggattctaactccaagaataaatgtaatttatatccagggagcagggtagggtcagtgggcaaaaaaataaataagagacatcagagctcttgttagatccacccaagagaatacttgttgaaggcgggccaagataataagatactgaagatgaagggtgcagagataataagaatgagaggttctaactaaagtgatttagtgaaattcttccttgaactatgttctctaggatggagaaggaagtgaaggcccagaactatgcagaaagaggactcagaaaagtgtgattccattgtgatcaagataaaacatctttgttaatgtccttcactgcattttccattcaaacatgtcctaactgtacttggcttgctggtttccacgtcatttttgagttaatttatgaaaactgacaacaaggactccttgagatttgaatttggatagcatttcttcctcatgatttgtgcataaaattcattttagggaagcaggaaggacgatgacatatttaaaaaaaaaaagaatagggaaagacatagctttgccatcagctgccattatttagtgatttctaaatatgtgtggtcctggcagatcatgccattgctgaaactggctttttttctaagggactgccccttccagattcaaaccattgcctttgtgaatgagacagagagggcaaggagggtaaaactgggccagaaccaggactctgttgagtatgtccacacagttggtcccaaggatacaatcagttttaaatctgccctctgcccttcagtataggtctctttgacccatactgctctgttaatctgggaaagggaaaagcaaggaaagacagagtgtgcaaaagaaaaggcagactgtgagccgagtgaaaggcagcctctgaggagacggaagtccgtgttgctgcagatatcacagggaggcagaggaggtactggttccagggaatctgagctcctttgaattgattcatcactagatgctgctaagtcccgttttgaagtcactctttcctggtgtcagaaaagaagacagatcaagtctttagtcttatggagcatgattctagtcataaagtcaaataataacattgaatgctaaacaatgaaacattctacatgagaaaaaggagggctgagaatgtgaaggaaggaaacctgtgggtgtctgggagaccaagggcaagtgggaggtctcagagcaggcagtgggcagtgaaaggaggatcagaggttgtctggatcgcccattaaagtgcctctcaatggtagggcactacggtgtcctctgtgcctcttatctgccacaggacagatgttagctgtcaagtcaagcaagtttcaaccaccatgtccccgaccccaggacatactcccaatctgttttgactccccttcctgtaataaatgacagatctatgcagaatgactagatgcaatttcacagttaaacttcacaccctgggtgttttgccaagcacctcccccctggaacacagccccctcccaacatcctggaaaccctgttggatctgctgccatctgctccaggctttgcttgggcctgcaggaccagtagggcagaagtatttcctgtaactggaatcttatgcttggccttccagacattgacagataattggatgaattaacttcaaacaataaacagaaaactgcacgtgatgcagaatgcacgctgctgccgagccaggcagcacatacacgaaactacctgagcacattctttagtttttggcaaccggtgaagctcattgtcagaatgggattcagaaaagggtcaaggcctgatgtgtgaagagatgcaaaaatggggatgcagattccaagtgtggccaccgataggtgtagggggatggggagaagttgcagggtgctgctggacgttgccatgactgactgcagatgcagtgggagtgaacggtattccagtcttggtcactattttatggccacttgtccttctttaccatggcctcagtagcttcatggtctttaggcatctcctctgccttctcacctcacacacatacatacagcactcgataagatgatgggtatgtttagttaacttgactaaatccttttagactgaagaagtagactgcagcatcccctttgccctataaagagacaattgtttgacaaataagatgtataaataaaataaaaactgcctattatttaaaagagagaaccttgaatatctctctgctctctaagaatgagttacaaaacccccccgtccaaaagaccctgctgcttctcagctgtcagctacctgaacagttcacagtgggctctttggcactttagacctgatttttcttagctctgaagtgagagagttgactaaggcgactgtgtggttccttacagctctaagtgtctgggtttatgaccaaggctgtggtgactctgacatctaaaggacctgagtcaatatccagcacccgtatggcagttcacaaccatctataactccagttccagatgatgccctcttctggcctccatgggcatcagacatgcacatggtacacagacacatatgtaggcagaaacactcagacacactgtggtggcttgaatgaggatagtcccataggctcctgtgatctttgttctgtttcatcatctcttcagtcccctgcccctccttacttcccatctctggaaggacagcttaagctacaataattcaggttattacacaatatgttaccagaatagttacaagttacaaagggttacaagaatagttgttattctatgtctgatttatttcacttactattttcttcttaaaagtcaagtgaaacactgttttgtgtgtgtgtgtgtatgtgtgtgtaagtgtgtacatcctgtatacacacaccatggttttgttattcttttatgcatgtaacttgggttattcagtgccttaactatgatgaaaagtactgggaagaacataggagtacaaatacttctttgacatatggattttagttgtgttgaatatatgctaagaagagagcatactgggccacatagaaattctgggttgttgagaaacctacgttttattttccagcatgaatattctaatgtatatttttgtcacagtgtagaggcttcgtgtccactgcaccctcactggtaagcagttaaacagcagtcttcttttgccatgtcaactcgctgaactttcatgtccctgatggatagagatgctgagcattattgccatgtgtctgtgggccatttgtatctcttcctttaagaaatgtgcatttaggtcttttgcatggtttaaaaaattgagttattttcttgctattgaattacttgggtcccttgttaggtatatgcttttcaaatatttatcatggttaatttacttttgtttgccattgaccttcacatcccagctggagagcataaattttagctgatgattttattttcttgatgtgtttgtaaaatgaatcttttaaagggatcagtgggatttttagaggggacttttttttttttttttttacctcaagactcaatccaagaaggccttggaacttctcagtcagctgacacaggcaagacccaagctttgtatctgaaaaagttagcatgatgtaatttccatgtacattggaggattagttttgctagagaaaaaaaaacaaccaaaaacaaacaaaaacctaaggaaaaaaagtactatgattctgaaataagctggcctgttaccccacactatctgcatttctctatcatgcttgcctcttaggaggtcctctttcatggaaaacaagcacgatggtcactgttactgcattatcgaactcaaacagtaaggaagcatagctttatttggttcctgtctttcctgtgcttttaggccaggttgtaaacaagccataatgcaaagagatgtataacagaagctgccttggaaagagaaattgaatttataggcagtaagataggataattagtttttatatttaaaaattccctccacccggaagccagtgctgtctccagtagagagtggaattgcgtctgaatcccaggaccttggataatttcaaatagttaagtggcaactgctagctccacatcaagtatacacataaacctgtgtgcaaacacacagaaaatatacattcacatggcacatatgtgaattaaagtgccaattcaagtcccacagttaagactgtgctaatcctgtatacttagaactcgcaggcttaagggttattgatacagcacaaaaataatccaactggccttccacctgctctttttttctttcaggaattatttggagttcaaaatcaaacaaataaaaacatcacagtttcttatgtggaaagtaagaactgttacttgcacttgtgtttccctgaagctcattgtctgtagactgtgtatttaaaagcccagggtagggacggcgagggacatgagatcaccatcttccgcttaccttctcaatcagccagcatctcagccctgatctttatcagaatcaacaagcagacaccagacagtggttttagatctccaggggatttggggggcaccggggtgaggaggcttgcttaaccactcttgggagtgcatcctgtctgatagatgctgtctacccaacctgggtccgtgaggacagagaagaagagcatctgtcagctgtcctgaagtctcccacatctggagtcagtcactaggtctttgcctggggttcaactaacagaactgccatcctttgacaatcctctcagcagagaaaagctaagactaggatgaacctgaagatcagagcaggtgggcttctccctccgctttcccctttgccctcgcagggggaggactcatgagaatgagcccccatgactgcactgcagatcataggaggtttccttcgcctctcagatcttggccgggttctctgcctccactcataagtcagtttcccaagtgaagaaaagagatcgttgttaaaccataaaccttcaggtcagctttggttacatcacattccaagatcatggccaaaaccttttgttgaactgaaacgctagattggtttagtttgaaatcactgagccattcatggcctaaggataggaaaactttctgttgtccaaaggtggtttgtggtgtgtggatgcatttgcttgcatggaaaagtgggatggatttgaagcagtgtttaagttgtggggcagactaaagaaaacagtagtatccaaagcacttaaaaccagaaaaagttccataggcacactgaatcatgcacttacgatcaccccattcaggtacagttccatccagccccttgatgtctgcagagtcacatcaagttgtgattcttgttttccaatacttggttcttatttgccgtgtactcatttacgttgcagactgttgcttaccagtgtgactctgttaccagaacgtgcatctctctgtcatacatctggggaagaggctaatggtgatttatgtccttttaattgatactcctctaaactgctatatttataacttcttcattcaaactgcttaatttataattagtatttccaaagatttgtttcttaaactttatttatttatttaatgtatatggatgctttgtgcataagtatctgtgcactgtgcattcctggtacctaaggaggcattggaactggagttatagacagttgtaaactgccacatacgtgtcgggaattaaatttcctgaattctctggaaaggcatccagtgctcttaactgctaagccatctctctagcaccccttttaaaggttcatcatcattaaaattgtgcgtctgtgtgtgttggtatgctcacgtgagtgtgtgtggtggcagagaccaaaggcatcagacctcctggagtgactctgagccacttcatgtgggtgctgggaagtgaacttggttcctttgcaggaaatacacattcttagccactaagctatctctccagccagggtttctttatatctttgttttattttctatacatgaatgttttgccatgcactgcctgtgtgcttggtgcccacctacacacacagggtatcagatcccctggaactggagttactgagggttgtggtgtggtgctgggaattgaacatggttcctctgtaagagcagtcagtgctcttaaccactgagctatctctccagcccctttgtttaatttataacaaattaactgtggaaagaggagaaagcttgattttattctttatagttgtagtggtatggcttcaaagaaaaccttgccttaaatgtttaaaatatcattctttttcagtttttcattaaaaggtaatatatttgaaatacacttgcttattggtgaacaattcattagttaagctaattattttaaataaatactatgttcctgagttcaatatgcaagagcttgcaagatgagtgtgacaatgcacacctgtcatccctgtggttgcaaagctgagacagaaggattgagagtttgaagagaatttgtttcaataaataaacaataaaaacttcaagaggttctaaaagacatgtagtgaggacttttatcctaatactgcctatagacaaagatatatttttctcagaatctatgcaatcagggtcttatggtatatacaaatacacatatatatacttcatttatggataagatgataaatataggtggatatatgccaatatatgtatatgcatatgtatatatatatacatatatagagagactcacacacacaggtgtgtatgtgtgtatgtatgcacatacagcttttctttttccatgcagagtgtagggtctttaaatttatgttagagtgcagtgcagttcaccatagcttcctctatctttctaagacaaactgtgttagctattctgtgacttatacccagaccctccctgattgacatttaggcttgttttacttggtgagagaatgaatgttagtgcaatgaacagtctgtgtcaccttattttgtataactgtaggaaaagcatcctttaagtagaattgttgtagccaaaaatgcatccattcatcattttggtggattctgtcaaattaccctgaataggaactaacagtgtgcaattccatcaacatcatgactggtcacctaccctttcatacttgtgaaaataagcggctttatctgcctcagcttacaattctatttgcccattttttgattccaagccatgctgaatataataaactctttaaagtgaaaggaaatattctaatagttataagcaaatatatttcaaagacttgttgtatgtgtgcatttgtatcaccttctacttctttaaaacactagcaaattatatctgccttctagaaaatttgacagagtttctatatagctgttttactaacagtaaataggctgcaaacgttgcaagatctgtgtgtccttcatacgattactgaaacatattgctgaaatctgatttcggctgaagttgtttttttttttttttaaataatgcatttcagactgatttaatcaggttttggtttgtaagggcacagcacatgttacattctaagaaacaataagtcaattaaatgctgacatatgttgccttttacaaaaagtacacagaaatcacattttaactaacatgatagaaaaaagttagataaaaacgactatcttctggctatttatctttgtattgagcattagatgaaaatcatctgtggctggttttgttttgtttttctgtgtgtatggtgtatgcattttcttatacatgtatcagcctgcctgaggttaacattgggagttttccttggtagctttccatcatagtcactgaatcagagacttgccatgtagctgagatctcagcaataccatgggtctacctaggcagctcgctccaaggatcccgtctctatcctttgagtgctgtaattacagatggatcaatatgctcatctagcacctatgtgtgtactgggcatctgaactctagtctatgaacctgtgtaacaagtgcactaaccacttagccatctctccaagcccctttgcaactatttgtagtggccatggctttgctgtaatacctgagttgatctggaagatttcatggcccctgtcacaagtgagtggcagaggatatcttatatgtgctgagttgtgtctttgttcatatccctttcctggtctggtaagcagttgtatgggtctccaagggtggaaaaacacattgttcatttcttggtagacagaactttttgtcttacactgtcacttacattatgaaaagccgtgtgaccacttcacagctcgactgacatttcttatcccctatggatctccatctataatttcttcagactatgaaaaaaggggggggaggcttccttggcagatgtaaaatttgaaaactgagagtctgctacagaataatagtagatatttcctttagggggtaaatatacttgtcacagcaacaagtttgtgactagaacatggataccatttctgttgctgggttaaaatattcactaatttccaaaatggaattgccctgtatatctaagagaagttttaaatgtttgagctattccacactgtcaagaaattcattaaaatccttttctgaaactggacttacacaacttttgtgccagaggatgtggagttgagcctgggagcagtcaatcttgactttgtaggtgagacactgaagcagagtcaggatgggagtcattgtcatgagtaagaaaatggttcttcttaaaattgtttcataaatcttacttacatgggattgtttgtttttaattttggaagggaagtctgtgttctttaaggagtcagtgtgagggtctttaagcccctcttggcagttctccttagtgaaaatttgatttgatgaagattctcgggaaaccacacagacctaagaaacatctcaatggtatgtgtaggaatttgcattctaataacatctcagcaatgtgtgtaggcacatgcctccttctgagtacattgtatgcaggcacatgcctccttctgagtacagtgtatgtctgcgtgtactactttctgactacagcgtgtatcagcatgaacatccttcttgacaacggtgtgggtaggctcatgcatcctcctgtctttaactgataagatagaaattaacccctttgtaaataaggtcttccggtatctaaagatgatctaaaggccctttgcattgcttcagtcatttcaatggcctctccaccacctactccgccccccccccctttgccctccacactagccagataaatgttctagaaatgcatgcccagccttagagtcctcctgcctaaatttgtacccataacagaaactgtgtggcctgatctttatccccacctcttgctaaacccctagcccaaacagctacagcccagccacctcatgatgtccttggggacaggagggcatgcccaccccttgactgctttaagtaccaatcctgaggaaccccctttcccacttccttctcttccaattcctacttggtctttcagacacaactgctctgactgactgatcacttaacaaccttgtacactttttcacactgtgccttattctaggatttgaaatactgtaccccattcactcctaaaatctccaaggaaaaggagtgattatcatccatcccaattatatgcatgtgcaagcagaaatctaaggccacacaattttgagaaccagaagtcacttgatttttttgtttgtggcatatgtacatgtacatgcatatgtacttgtatatgcacataaacatgcatatatatgtgtatataatttatttttgaataagcatatattataaaatgtaaaagatacataatatgagaacatctccttcctaactttacatttcagctaattctcactaaaagcatgatcactatcagtcttttgtgtatctttcttttcatggatgcatacaagcatctaggattccattttttctgtttgtaatgccatttccagtttccatctttcattggcttaacagtatgccttggggcttgttccatgtcaatatactgagagcttcctcttctcctttatgcctaaataataggccatgatagtaatacactataatttatttattagtgcctttttgttggaaatttaaattgttatcaaacttttgatggcacaaagttcaaacaacatggttttttttttcagacataattttacacaattatgcatttaacttgttggaaaaagtagtagaattagaatttgcatccaagggtgtgtgtgcttatgattttgatacatattgataaattgtctgtcataggatgtgcatgtttcttcttcctgagaaacttagaagcatgcctcttccctcatacccacacattgtctgtacactaaaacattttggtatctgctgttctaatgtgtttaatatgcagctttctgtgaccacagtgtcttttaatgtgtttctgaagtatttggattctcttttggttagctgattgttctttgtgctttgttggatccttttttatagttttttcttggtattgatttatagacattccttacacattaaggaaatttgccttttatctgtgatttatgttctaaatagttcccagatttgtcagtggccgtttgtcttcatttatggtgttgtgtcccatgcagaaaattgttattttcatgtaatctgaccaggtttttttttcttttatggcttctaagatttgaatcatcactatcactagaatgaccttccccctctgctggactgtcaaatcatctctctgcatgcctgtctgtgtggggtggtttcaaatagagaatcagtcgactgttgtagctcagaaaatacactgtggagtcagactgacccagttgccctggcttcatcttgaaatcattctgtaatcttggagaaaatgtgactagccattggaaatagctatattctagggtcgcaggttacggtggagatcaaatatgacaatgtagggaaatgtggtacttatttgtgttaggatccctttctccattcgttgacaaatagctccaggagaacagagtcatttcttcttttaaattttcctgctaccttggctttccctccccctactccagaggagtcctcaggacagtaccctgcaggctgtgcttgggtgctcatttagtttgctttggtgtttattttgagtggtgaaggaacggctggagttctggctggagccacctggagggccacaggtgcttctctctcctaccagctgtgtcccagcctcaagaggatcctggtgccttgaagcatcttgacctctgtgtctttccatgggtcactgatgagagtccattgagctgccccacggcctcctccctgcctctgtgcatcctgctctgtgatgtgcatgtgcacggacaaatagtaatgcccttgctttcctgttgcatctcagcctggttccttttcacataggtgcttggtatgtccccttccaaagatgaccttcgaggagaggcttgtttattgtaagagccccagatcgcttagctcttgactcattttgttgactgcattgaaagacttattcatagtaatgccttttggtgaacgattgtcttgcaaattccttctatgccatcttttgagactttattaaagttttagccaccaggatatgaactccttcaaatgtttcatagtaaccacaccatgtagaaacagcaagaatttgaagccagctgagaatgtggccttattttcctgatttctatctctgttactcctttccattttcccattccctcaaatattttctttctattttctctgtctctctctgtgtctctgtctgtgtctctgtctgtgtctctgtctctctgtctccctgtctctgtctctgtctgtctgtctttctctttctcccctagctcctcccaaagacaccttgaaattcctggagtagaaaatgcagtagtgtaatgcacaaggttacatcagatctaactttgccactactagctattaattaaaataattcctgggggcacacatgtcttgtttatatgtagatgtcatgccaatttgactgactaatctaaagcatgctaatctagtacctggcagagcatttggctgggttggggggagagtatatcatttggagagataattttgcagtagatggcaattagtggacctacagctggtcaatgtacagaggatacgtgatcatggagtgttcagctctagtgaggacattgatattatacatttccacctggccccctcccccaaggctcaaggatccttacagaagaggacacagaaagaatgtaagacccaggagaaaacatatgcagtcaaacactatttactgaatatgacagggctcttacaggggtcaacacacagcagctctgactgcatgctccaaacctacacaagatcaagctagatggggaggggctcatgaagtgtcaccatcaatgaggaccaactgtcagttgatggctgctgggaaagagagagtcagttttccttagggcagaggtaacagagaggctacctgtactccaatacatactcctgtgggcagacttggattaaacggcagagcccatgaatttgaaatggaagagtggtgggagacaggggagagactagaggagagaggggagaggcttgcagatggatttcatcaaaacgcatcgcttgcttgtatgaaagtctcaaacaataaacaaacaactagatagattatgggctggcgagatggctcagcggataagagcactgagtgctcttccgaagatcctgagttcaaatcccacatggttcaagaacctgagtccaaatcccgagttcaaaaaccacatggtggctcacaaccatccataatgagatctgatgcccttctctggtgtgtctgaagacagctacagtgtacttatttacagtaataaataaatctttgggccggagcaagcagggactgagcgagcgggactgttcagagcaagtggggttgacaggagctagcagaggtcctaaattcaattcctaacaaccacatgaaggctcacaaccatctgtacagttacggtgtactcatatacataaaataaataaatgaatcttaaaaaaagcataaggagctaatatttttttaaaaatacagaaactagatagattaaagtaatttgcttttgttaatttgaacacgagtctttactagaggcaggtaacgtagagaaaagaggaagagaaaggcctggcttatgaacacaaaggaaggactactgggtgtcaagcatttcacttgcgttatgacatgtcacttgtgagaatcttagatgcatctttactgcctatgtataatgagttggagagaaggtgggtgactggacattcttcatagtgtatcgaggcagggagcgaatggaatgaagcttatttgagaccctgtggtctccagctgagttgcatggcctctagacacgtacagccccggaaggggtaagtgggtgaggaaaagactgtttgcagtgaaaagagaaaaataatgaacatttagaaaaagaaacatagcgatacctttgaattttctttctggttgagctttttggtcctgtgttccgaaccaaaccatttcagtatggtggatgagaaggaggtggagaggggaagaaagaaaagataataccccctcattccatttgataaaaggtgtcttcttagcacctaacagacagacctaagtgggctctgaagcagttttgggagtgtgctataaaggaatactgcttgcttgactctggcaaggagctcactggaaatgaggctgcactagagtcatgggcccaaggggttagctgttgaaaagttcccaaggctcctgaatccccatggtgtgtcactagaacgttgttctgcagcttcaccccctctcaagcctggtttcctgctactcctatgtattgctcagataagggcatgggtggcctcactccctctgtctacccactacctgacatccactccagagcatgccaaccttccgggagatatttcagttatctgtctcttttgtttctagaagggactgttttccccagctggagatcctgctgtattccttcatgttttgaaaacaaactgtgcagtgggcgattctggctctgtgacgattggatggctctgtgccctgtacaacaatcttccctttgtattaaacatctgaactcaggagttctaaagctcattttcatattccctgttgacatgatttcttattttactttttttatttggggacaagagtttggtttttgcttttctattgatttcagatgtactttctttgatgacagagatactgttgacccatagacttaaattgtccttgtacatttgggagtgactctttcccctctcactgggaacttcttgttggattcctttggctgcagtgagtggctcccatcacagtgggatgggatgttcagagctgaggtacctgatctactggcttgcccatgagctgagtggctgaacttgtcacagagggtcaagatgaaccgatagaccaaaatagccacacaccagttcctttctggaaaggcagatgggctgcaccagagctccaagaagacctaatttggtcagagaagcactgactctggttgagactggaatcctgaccctagaatgagttccatactgtgcttctttaatttgttagcagccacgttttcatgtcctggagagggggggaggtcagctacacagtgacaactatttgttagcaaatactcttatgctgaaagcccatttcccttcttaaaatttttacttaggcttttattgccaggaaaataagtggatgtactctcatgtctagcaaaccatcattataaaaatccaattctgcatgacaaaataggacattttccccaaaaactcatataagccctttccttcaatagtgtaggtactacaacacaatattatattatttataatatgatataaattaatataatatatactctaagactatttttgtttctttgtaaaattcaaagctatttcttttccttattcatttgtcagacaaaccctggctgagttgctataacaggcaaagccaccctgcccagctgtccttcagccagtgggaagaaggcaagccatcacttaagctgactgctccttgcttcttattcctttggcagaggtttgagttggattttagctgtgcccagaattattcggcttttccagatgtgagcacttagtctaatgtctctctgggcagatgggccgatggcacacttattctgtctcctcttcctgagtgtcaggctcttgacatcactagtcatggacttgagacgcttctggcctagcaagagtctcagtgagctctgggcatgtggatgggttgtatcattttctaagtggaagagaattctatgcttccagtctgtttaagttgcctctgcacactgcaactagaaaaatccccctctgaacagacaagctcctgcgacaatgagaagtcctgtccctaacccccctaacaatgcccacctgagccagaggagcctggacagatccactgagcctcctgtggagttcgccttccctgcttgccctttctaagtaaactgatttgtggcacaaagtggctttacctgctatgggaagttcttatcggaggatcttttctgcctgagttcgtcccctttcccctgaccctgtctgtttggtcctatttttaacttcactttttccttaggcattttttttattattattattcctcttacttcatgatctcccactgtctgctaggaggtacagacattttggatcaatcgactctttttttttttttttttttttttgggttttcgagacagagtttctctgtatagcccttggctgtcctggaactcggcttcaatagactcttatacagagttctcactctcttcaaacccaactcctgaccaattgagttctgttctgttcctcaggactaagggactgttctgcccacgctgccctgctgatcaaggtgacccaaagtcatcccctgacaacagtgctctactgagtcagaaagctctacagactaatagctactcagaaatccttggataaaataatgccttaaagtcttaaattatagcctcaaacaatttacataataaatcaagagtttgggaatccaaggagtattagcatgttttgggttttgttgctagggaacttggcctcggacttcaaatgatgtatttctcttcattgctctcgcgctctctctcgccctctctccctccctctctctctgaaaacaactgagtgctttcatgtttgggaccatagggaaggacttagtaggttatgcatttatccggtggacgacgtaactgagcatatttacttttaatgtgactgaagaaaaacagcagatgagcagtagccaggcacatccaaggcataactaatgcatcaggttcctggaacatctgcgttcaaaggtttggtcttcatcaaaatgctccaaggtgattttttttttcaagagagaaaggtggaggcagccagccgtggagatgggtagcagacagttacctagcagatgtgtctactgaatatagctttaactcggtccatgatctctcttgcatgggaggttagttggaaaagttctagtaaaggttacacaataaaaatggagtcatttagttctttctgttcagtacagcttcatacagagagtggggttctgagctgtgattctatttgttgttggcataattgcccctgctttagacgtcttttgccagggtgacaaaagtcccttcagtgtggggtagaaggctctggctgagtctaacctgattataagctagtctctggatggtggctggctggaagggattacttggggaaacctgaggccaggatgcaaataaaggcaaagtttccccttaggtaatggcagcagtcagaactagacagctgataacattgttctgtttcctgtgttcctgtgtgatccccccttaggcatttcattcaggtctcatccacctggcaatgctgatgtgccaggaactggcaaggggcaccccagcttccccagggctgggtgcaagcagtcctcagcgagccttctctgcatgtgattgtctccccaaagttgattctctcttcatgtcatattagggacagtagcaggccgcccttgcacaagggctgcgcaagcctccatgggtggtgacaacattttgtcacaaccttctgagtggccgagttcaatgtgggcattcttcttagaggcataatgacagccaggagagtcacagcctctttctactacacaataaagacccttcacccatgccgtgggcgatcacttagaatctcattttgtggatttgataaacatgatgagcaaccgtttgtaagaaagcatttttgtgaggttttctgataacagatggttaaatgtttgaagttttggctggaccacgttttctatttgtaatctactaaaggaattcactgataagtcctctccctttctgtgttcattatagtcaattcttagtcatcaaagtcagtatagaaaatcactcatgatacaaacctaggaatggcctcaagataatttgtatttgattttgagttagaaccagcaggcatgtaacatccatgtgctcaaacattagcctgctgtgaggcccagtcgatgctacccatcttgtctgctttctttgtgaagacagggagggggtgtgtggaactgatacatacgtggtacaggaacaggcacagctggggccaggatagcaggagaagaaagtaagtgccaatcctcacagtataattaggtatggtggagatagtaggccagtatccttctggaaatatcacaggaagattttatggatgctttttaaaacattaaataacacctatgtgtgattaaaacaacaactggaaagacttttaatgaaaattaactaccctgcatcacctggctggctcctctcttaagcctacttcgttcagatagcctttatgttgctatagctgtttataggtcttcgggtgagtaccttcatctctgtaatggcacaagtctaccctgcacactcatctccctgggctgctaagtaccgtacactgggtgcacagcagagaccagcaggttgcttggtctcctgatctccaggttgggagtccagagtccagagtgagcaaggtcatctttgccgaaggctccagaaaggattcttccatgcctcttccagctcttgctggtgaccattcatccttgatattccagttgcttgtcctgcaggtctctggcttcttaaattaaaaaagaaaagaaagagaaagtttgtgtgtgtgagtgtatgtctgtgtgttgtagtttcactggcatgtctgtgtacatgtatgtggaggccagaggtcaaggtcaagtgtttccctcaattgttcttcaccttaattttgagacacagtctcttactaacctgaacctcattgtttggctcgaggagctgcacagccccagggacctcttgtcttctacctcccaagcactagagttacaaatgaatacagtagtgctggggaccagaactcacacacttgcatggcaaactctttaccaatggatccataccccccagccctatgtcacagccttgaaatcttttcctcctcctggaaggactcagtcatactaaattagaatgttgtactgtacctaatatcttcaaaactttgcttccgaattcaaacatgtgctcaggtagcagacacttgaatgtgtcttttgggagttcatcatgaaaccatgacaccactgcttatcacacaaacagttgactgtgttgtcttccatttaaggtaaatggatttttctctcttattctgccctattgccttcccaaggcttccattcctttactcccctccaatccaatccctgtaacctcatttcttattcccttctccatgcagagcataatgcattaaaaacacaagcacatttgtttctgtatttcccaccccaccccctcctgacaggcagcctcactgtggatggcgcctgttatcttccttacctctatggttccctcctctgacattggtactttcagtgcagaataactcactatttgtccatcagtgctgtgggtaaaatattgaatttgaaaatcactgaggtttgtgttctttgttagtatgactgagtgctgggtgcattggctctgcatgctgtctgagttttagttaaaacactttgtactatttgtggagtgacaacataatttctgtttgcatagtactttagaatcttcattttctttgatgttagatggtggtgtagttatctagctctgaatttggaaacatcatttattggtacattgaaatcctcctgtattacaaactgaaatgaggcttggtcctcttataaaatatttgatcacacaaaggcagtagccacatggatctctaatctttgtctgttcctgagattctagcatcaggtgactgaaattgtgggaagcaaactaccagatttcaaaaccctctccttttttaaaaaaattgaatatagaaataaaaatttgaacagctatagagatataacttcttacctcgctcaattgcaaagttattatttattttcactagtaaataaggaatacttaatatgtgccacaaaaatagaaatagcttgtcttggaataagttgtataattttaaaattgaatgaatgtaactttaaaaaccaaacagacaaaaccaaaaaaacaccttacttcttttgccaaggttttttcatttgatgtagactcatagcatccaaaagatcacacgtgtttccttggaacctcatttttctattctgttatccatacatactcatgtacatgattttaatagatgtagagaaagctggttccatagggactcatgttggagatacgcaggcaagggcaggcttatgtaggttgggtcatatcatttctgcctcacccacaactgtaatcagaccggcatagccttgattatgtgccctactgcttgacagctggcatttctgaagtatggtgttagatgtgagccttagttgagttcggagttgagtctgtcaccttttcctgtgtggtgcttcagtgactcacactttcctgtgtgtatttcttttttctttcactttttttttctccataaagtgatgtacctgggcaaatcttaccaaagtcattttgtaacttgagttgaggtgactgataaaaggttggctttcaacctgtacacaacgaaagcagttttgtagacactaaaatctgaagaaactgagactattgagtgtgtctgttgattaaccaaccagtaggccacctccttgccttaatgtagagtttgggatattagttgattagggttagtttatttcattgccacttttggtagaatttagtttttaaaagttaatggtattgctttttaacttttttttgataattttctttatttacatttcaaatgttatccctttcctggttctccccctccctgaaatcacctatgccacccccctccccctgcttctatgagggtgttccctagcccacccccgcctcgcctccctagaattcccctacactgggcatcaagccttcacagaacaaagggcctctcctcccattgatgcccccacaagaccatcctctgctacatatgtggctgaagccatgggtccctccatgtgtattccttggttggtggattagtccctggaagctctgggggtctggttggttgatattgttgttctttcaatggggttgcaaccccttcagctccttcattcctttctctaactcctccattagggaccccatgcccagttcaatagttggatgcgagcatctgcctctgtatttgtcaggctttggcagagtttctcaggagacagctgtatcaggctccttttagtaagcacttcttggcatccacaataatctctgggtttggtgactgtatatgggatggatcccaaggtggggcagtctctggatggcctttccttcagtctctgctctacactttgtcttcgtatttgccctcattagtattttgttcctctttctaagaagaaccgaagtacccacactttggttttccttcttcttgagcatcatgtggtctgtgaattgtatcttgggtattccgagctttgggactaatatccacgtatcagagagtgcattccatgtgtgttcttttgtgattgaattacctcattcaggatgatattttccagttccggccatttgcctaagaatttcatgaagtcattgtttttaatagctgagtagtactccattttgtatatgtaccacattttctgtatccattcctctgttgaaggacaactgagttctttgcagtttctggctattataaataaggctgctatgaacataatggagcatgtgttgttgttatatgttggagaatcttttggatatatgcccaagagtggtatagctgagccctcaggtagtaatatgtccaattttctgaggaaccaccagactgatttccagaatggtgtatcagcttgcaattccatcaacaatggaggagtgttcctttttctccacaccctcaccatcatctgctgtcacctgagcttttgatcttagccattctgactggtgtgaggtggaatctcagggttgttttgatttgcatttctctgatgactaaggatgttgaacatttctttaggtgcttctcagccattcgatattcctcagttgaaaattctttgtttatctctgtaacccattttttaataggattatttgattacctggagtctaacttcttaagttctttgtgtatattggatattagccctctatcagatatagggttggtaaagatcttttcccaatctattggttgccattttgtcctattgactgtcttttgccttactgaagcaattttttgaggccccatttgtcaattcttgatcttagagcataagccattggtgttcaggaaaatttcccctatgccaatgtgtttgatgctcttccccactttctctattagtttcagtgtatctggatttatgtggaggtccttgatcaacttggacttgagctttgtacaaggaaataaggatgggttcctttgcattcttctacaagatacctccaattgaaccagcatcatttgttgaaaatgctgtcattttcccactggatggttttagctcctttgtcaaatatcaagtaaccattggtgtgtgggttcatttctgggtcttgaattctattccattgatctttctgcctgtcattgtaccagtaccatgcagttttcatcactattgctctgtagtacagcttgaagtcagggatggtgattcctccaaaagttcttttattgttgagaatagttttagctagcctggatttttgttgttgttgtttcaaatgaatttgcaaattgctctttctaactctataaagaatcgtgttggaattttgatgagaatgttaatggcttttaattgtgacatttgtgagtcaactaggtagaaaattattttcttccttttggagggattagtatgaactgttgattgttgcctgcccctggtgagggctatagactctcctacccaggctggcagtggctcctcccaatttatgttctcagcttttaaggattgcatactgagccatttcaatttttgtttgcgtgtttgattttaagagccgagtttgaatgaatcaggcgtggctttctagttagaaacattcaagagtgtgttctgtaaggtatgggtagtgacagcattggagctttgggacacaggctagttcctgcaaaaagaggaagagggtctctgagctatgatggaccaagctctgttcttctgtcagaaataatggtttacactgagcagtctgctttgttgttacttctcattggtgactggtcacatattccacagcaaaggtctggctataattcaagaagctgcagaaaagtggccaatgctgagctgtactggtctattcagttctttggggcctcggtcagtaaaggagagattatgctgtgaactgccaggcacttccctctgtgtattgtcttccacatgcccttgctaggaataagcttataaccccatatctgtcctttaggtcaggaccactgggctctatcagatgccccaacccaggcataggcagagcctgtgtctgtaactttgtttacactttatctctgcctacattcccttggacctttggaagacctcattctttatgttcttttcagaccagtgttgcagggatctggagcacacattagctgtagactgccaggacaacacctgtgaccctccttgaagaactttagccaaaatccaatactcagtgtgacaaacaacagcaggacccccatactcagttccttctcttcggtccacagtttggatacatgtattaacttagaacacaaacctttggacgtttccctagtatgagactcttaaaagctgacactggcattcacaactctactcagaggagcttccttcagaggaaggtgggtttccatcgaagcatgtcctggtctttgttcagtcatgttatacatggccactgttgtaaaccagaaaagccaccaggcaggcatccctttatctcgaaagcaaacattcttcattgttaggagttcgctgtacatcaaagttttctgtcaggccatggctttccaagcaagctgtgactcctgaaaatacagtctgtggtaggaaacctccaacaagctctctgtgggtggaaagaaacagcgaccttgtgtgtaattcaggcacatggggcacaggtggggactgatcctgacaggagaaacttgacagaaaagcgacagcagtgtttggaacttgaagtcctaaaagctatttttttttctggttagttcctcatagccacaagtatgtgtattatttccatcttgcccacaatttattgagaatcatctttctaatatgctggggaatcccaaatttaaagaaatctgtttcctaaaaacaggcaagtgttttttttaactctagcaattatatcattcatatctagactataaaaggaattaaggaagtctctaaagttcaactcagtttgcctctactgccaaaggcttacgttcttatgaagagagtttggcctgacgttcagagaaaggcttcagaaacctcttgtaaagactcgctggtgcctcggctactctagggatgtgatgtagtgtcaggagcacattctgtgtgaattcttctctgagtgttgcaatgtgtccttgtagaatgatcatagatatactttggatatactttgtaggccaggatagcagcaggtcagaactgtcaggtgtttgcatggactaaggcactgcctgggtctcaaggtctccagccccaggtctgctgcttgccacctgagtggttcttcagtggttctttctttctttctttttttttttttttgtatttttttttccattttttattaggtatttaactcatttacatttccaatgctatcccaaaagtcccccatatccacccacccccactcccctacccacccactccccctttttggccctggcgttcccctgtactggggcatataaagtttgcgtgtccaatgggcctctctttccagtgatggccgactaggccatcttttgatacatatgcacactgctgacttttaaatactgaaattataaagattttgtcctatagggattgagagttaatggtatctttaattcttgattcatgttaatcactgtaataagcactatgcaattcttcaaagttagcaatttcacctcatacacgtgcttaacatacctataagaagtctgactttttaggattgaattatgaaaagattgatatgaaaaccaatactcatattgcttaattgactatcctcttatgttgctttcattctctgggaagatttttatatcaacatatatatgtttataccataatttagctctctctactacactgatgattcagttttcattactagtacacactcattatcttgcccatattcaagagtgacagaatatttgctcttccatgcagtggaatcacacactgccaccattgtccatatgctggttactaatttaatatgattaagcctacttttataaagagcttccatgttggaagggagtataacacatcagcgggagtatttcttctagggtcaaatggctctaggttcaaatactggcccaggtacttgttaatttcatagtttgacataaagaattgttagagttaactgagggaacgtccatgtaagtatcacgctcaaatggattgcacacactggtgctttgctgtggggatggtcataaagggctcatgatggatgttctactaacctgcagggaaagaaaacaggaggtccttgaaattaccattgtacacagggagccaaatatggttttgatatcagccatatgtaccccccatgtagactttggttaactaccctctgttaaacgtggggttgacctttactgtgttactatttttaagaaaactttgaggtctgaccttcttagaatctgtgatgttatgaagtcacaagttaaagaacaggagaccaatgagtgggtcgaacgggtagtgtccacagtaatatgaaggaagaatcaactggactcagtggtgcagttagtaagataattagacatgaaagagaaacagctataactcccaatgccaactatgcccgttatatcacagtagctccttgggatacttgcaggcatccattgctgaagttttggaaaacctcttgggaaaggctaatttaacaagtttcttggctgcatctccaagtccttgacatgctctgtgtacagtgattgtgaaataagtgtaatgatagtataatacatttctgaagtgtatgacaccatggagagagtattattttgtccctgactagtatcctgttgtactggaaaagctatttcatgggaaatagtacaaaattctaccctgctgttataacccagaaatgtggtagaacatggatgtcactttagtcaacccaaatgaatatactgagcttcagtcacccacaaggcctggaggaggccaaagatgaacaagaaacatccatctttgtaacaaatctaggcactcccaagcaagtgtcacactgcctgtgtgaataggagctagggtacactgtgggaggcagcatcctacaggattattgattcagtactgattaagggagtatccatactataccagcgatatgtttatccttgttttattaagaagctcttatgctcagtttccattcacttcagtgaagctccgcagtgaagagaaatgtgtggtatccagctgcgggtgcttcactgaactatttctaagtttctttgatcccacagtcatctgaccaccccttccacacttgcagtcaaaataaaacataatgggaggggcctggaaaattcaactgtagacacaggcgagcttctttgttatgagagatgtggcatctcgttggttgaaagtgatcttcatgtttacttcttgtcgatgacatagggctagaggcctgtggcagatttctctgggaaagagcacttcctttcagtggtcaggtctgtggactttctctccgctgtgtttctctgcctgttaggcctttggaaatgttctggcaggttgagcagttatttagctcatgttgtgagtagtgtttctctgaccttttgttatttactgaaacagtccaccctgttttcttttaagagaagcgtgaaatgaaagggggtcagtcagaacatgctgacttcggtatcagaagactagctattgagctgcttggcccattgcattcttttaaagtctcgggggtcactggcctccctgtttcttattctcgtgatttttaaggaggctcctggagaatatcttactctttgctagagcagatgcgtgtatggctagtcatttgtttaaaacatgtcactacatttcaaaaccctgtgagctgttagggaagtgcagggcagggtgggtcatccatgcctcacctgttttgagcggcggcatgacagatatgttctggggcatcagtgacttggtgatatgacagtccttactctcaaccctcagagtgaaagaagtaataacactacccaagactggttgggtagaccaggactgtgccttagaagccatttgtctctttccacctttctcatcacctacactgtctttatgcttactgtctttctagttcaggcagaaccttcaacgggaatcacttttggaccagggagaccttacaggagatgaactcagctcctgactttgaggacacctttcaagtggtcatgttcatgctcttagccaaacaaaaatgagtgacactctcaagcgtgatgatgatggattaatgctacccacgaatttctaatgatcagggtgcttgagataccattgtctaataaggacctatggctctggagggagtctcgtgtcttccatcatatggccagcaaataccagtctgtcatccatgcagaaggtgttatggggtgaagagaaaattctcatggtgcatacatgagaatacagagagacagacaatatgtaaaacgaagaacaaggtagacagaatggatgatggggggcacagaagagggaaagactgcttagattgtggtctataaactctgaatttactttctcaaagggctcagatgaggaagcagtcacgataagtcatggcataaacttggaggcaggagcaagaacaaagccttgactaaattagattattctttcctccctgtctcttacagaatgacctcctgtatatgtattctacctgggcctccaacttgattagtccttcaacctctaggtcatggataacactcacacagcatcagactctgttgttacaatgcagatggagagtcagagattctggtgagctcaagatggacgtttctaaaacccagttatgggcttgctactctgtctccatgactctcatattcacagattctaggttttgtgagtccaaatgtaatatgactttatttcctagagaactgtcttagaaaacacttaaaactcatgtgacagacagaagcaggctcagtggttgagagtacctgctgcacttccagaggaaacagttcaattcccagtactcatgtcaggtagctcacagctatctgcaactctagctacaggggatcagacgtcaccagcctccttagagacttgctctcatgtgcatatactcacatgcacacacacacacatacacacacacatgcacacacatctgcacactaatacacagttaaaataataaaaacaaatattttttaaagtttttaaaaatcgtgttcttagtaaaaagtaatatacagcttgaaaagaaatcaggtcaggtcgaacaagcagctcctgccagacattttcacaaactcaaaatgtctcttatgtttaaataattttaactcacagaaagctgcaaagatggtacagagagcccctgtgctttctttcctcctttccccctgtgataacagtttggtaaacagaaatgcatagaatcatgtatgtaacacattattatcatgccagtacaaggcagccagtgtgtgtgtgtgtgcgcgcgcatgcgcgcgcgagcgcgtttgtgtgtgtgtgttactccatatctaggttcctgaagccaccacagccatcagggcagagtgccgtctcatcatggacaagcagtgcctagtctgatggcacttctgcctgtgagcagtagcagcagatggtagtctcctttcagtctggactgggctacggatcaatgtgtagggaaaggattctgaactttattgccgcatgtggctgccatggaatctacttagttgacatacaaatgcagttcttcgatctaatttatacagagacatatgtaagcccagaacaaaagggaaacaaacaaaagaagaaaacattgatttcaactgaggagatggctaattcagaatagtgcatgtaaggtcatgagttagctcagtgttgggaaggctgagagacagacccccaaggctcagtggtcactttgcctagccaaattggtgaattccaggccaatgatagaccctgtaacaaaacgatgaggtggattagcaccggaggagtgctcagttgtcctctgtcccccacatacatggatacatacataccctcacatatacctgcagctgtacacatatacacctgcaaatatacacatgcaagcattgacctgcctatatgtacgcacacacaaaatcaaacaagtctgagtcagtcattttgattggctaccgaggacgctaataattatgccagttctgtggcctcaatagttggctcctgggaggaagcaaacactttactgtgcacagaacttgaaggcttcatgatctcaatgggccatttcctactgtatctcctgtgaatgaaaagcaagcattccaggaacgggttaacaggtcacttgaaagagtgggcacatttcttacagaaatcagaacaagagataaacaaaaaacccacccttttgtgtgtggaagcaggaaaccctcaggacgtgcagttagcagtgagaactcaaggtgcaggctgaaatggaaacatgctataaacagactgaaggagagacaacagacttaaggaaaaacatctgtcccggaatccaacatccaaaagccccatctgtggcctaagatcttgcaatgcttaaaacaggaatgtggaggggcccaatgaaagctctgcaagctctctctcttctctgtctctctgtctctgtctctgtctctctctctctccctctctctctgactctctctctgtctctgtctctctgtctcccctctctctccatctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttcttcttcttcctcctcctctactgattgatttattctgaaaaatgcaatcaacaattcaaatagcaatttacaaatcaaacacttgaatataacacaactaaaatatactgaggagtaatggtagaaaaatattaaaagtctttgctttccataattaaactattaatatttctataaaagcagacagtattgagtatacaatgtgttcttagctagtggtcttgaagctgaggtacttctaacattgcatggtgttgcagcatgcctgctgctgagaacacaggagttcagaactgaagctgtggtgtgatcaaaagaggaacactgcaaaaatgctatgattcagttcccatttgatcttgaattaatattgggtcataggatgtacagaaatcattcactgctgccaatttttgtgactctcacattcatttatgtgaacctcatgggggtcttaacttaggaaaactggattctgtagtatacctgtagccattcctaaagctgtgaattctctgtggcagagttaaatatattaccgtgtgtgtgtgtgtctgtgtgtgtgtgtgtgtgtgtgtctgctagcatgaagcatatgtccatactttatgaatagctttgctggtctcttggcttaaaaagtctagctgagcattttacccacaattacatctggatgcttctatggggactaagtgacccaatctatacattctatgaataaatttattggtgtactatatgcttctaatcctagcatttggaaagtagagacaggaagaccagaagttcagggtcaccctcagctacatagtaaatttgaaggtagccaatcacacacacacacacacacacacacacacacacacacacacacacacacctgaaaacaaggaagctcagcaattaagagtatttgctgcacgcatagtttccagcatccatgtaagataatgtgcaactacctgcatatctactcctaggagatctgacaccttctcctgtcttttgcaagcaccttgcccatgtgacataccctcataaatgcacatacaaaataaataaaagtctaaacaaaaaaaataataagagctgaaagaggagtaagatacccaccccaggcaagatagggtcagatgtcattgtaggggaacgcctgtccttaactccactggctgaatggtgttcctctctctcctcctctgacctctccttcctcctcagcagatgtgaaatagagatacaacctctccaaagtgagttacaggcccattgaaaagacatcagatgaccggcgcgagcagctggttgcttccctttttatgggattatgtcattgcctttcctaagaaggaggtttctctcctccacccacccccaccccaccatgcttccctcaagtgccagttccttgtgttaaaggaatgactcagtgagtgttgtggtgctgatggtgtgacaagtgagctttgagcagggaaatggtgacctacaacccattgtggaggccacaggccgtctgcatcatcactagtcctttgctaatgatgctcatggtgatactgccatgtgtccctcatcagtgcaagcagtctcagacgtgcttaacctgtgactttgtcactgtgccagcaggacccaaactaagatggctgtgggcaatctcttatgggtcctctggcgcatatgccgaaagatggaggagtgggccaggtgaatatcatatacatacaacctcttaaacataaccttcaaaaatgtatacttataagatgcaaaacactacagacagctgagacccatacaccattaaaaatctctccatctctcaatctctctctctctctctctctctctctctctctctctctctctctctctctctctctctctctctttctctctccttttgggttttctatgtatcccagtctgacctaggagtccagactggcctcaaactcatgacattcctccagcttcaacctacctacagctcgaattacagttgtaattccacccaccacaccaagtttcaaccactgcttataaatgatgtgaagaggaactgtaactttgaaagcctcctctgctgccactgacaatatcatgccccagtactcccagaaagaacccattcagctcttgtggtcatgttataagtctgatgtagttttgtattgtaagttataccccatattattctgacattaaaatgcacagttatattcttactagttagtatttttgcaacttttaatataacttgaaatattatttttgaaacatgacctaaattacgtgatctagttcctttagccaccatattgttgtggaatgaatatttgtattactcccaaatttatgggctgagtcctaattccactgtgatggcattaggagtaggtggttctttatgaattggatttatacaggatattttggagagctcactcctttaactatgtggatgcatcatgaggaaggctgagccaccactgaatttgctagcaccttactcttggatgctcactttctggaactgagaaataaattgtgattgttttgtaatagccctccaaacatatgtatgtcagtcttttcctgtgagtgtaccacagtctgtctgtttcatcgtcacagggctttagaggggggttctggattttgttttgtaagtactgactgctgtgagcttctctgattggatttccatgtaggcatgctgagttctcaaagacatagaaggtaattagagtctcaaatcttcaagtaaagacgtcaaaacctttggagctgccagagctttctcagctcagcctgtgtgaggacctggctgtgagcatcctctgcagctcttgacacagtcaggctttgtgatttactgacctggtagctcaagaggcatctcaccatagctccgatgtctggtgttctcttgaggttacctttggaccaccttccccacagttctcttgttgggacctctttttctttgtagtacctatgtgtggattcatttgggtgtaggggataatggattctcttttgttttcttatagttgtctaaatgtttgctatacattatggcacttaagagaattgcctttaaatgcctcatttggctttcagcagctttgtcacataagagactttgaaatcagttacttcattttcccctttggtttatacaattgtatacataatctcgagagtaaatttctgtgtaagttgaaaactctttttttttttttttgttttaaagttcgctggttttattaggatttgaatcttacttgggggaataaagtgagttagagatttttttctctacatgggataactgtcccacctgatgaaagttcaacctcctcctctactgtgctgtgttgctgactctcacatacgaatctctctctctctctctctctctctctctctctctctctctctctctctctctcccccctccctccctcttgctctcatatacacacatatgcacacacaggtttagttatctgtgtctgaaccaacactatgttgtcttagttacaagataaatgcatgtatcactatcttgatatatgataaagtcagtatcttattcttttccccaaacaattttcactagttttggatactcaccttttctgtataaaatttcaaatcagcaaagcattgaccatagaaaacccaggcttgagtttgaatatgaattaggtttggcttacacattaaccccgggggtactcatgtttgcgttgactcttgttgcctctgagcctgatgtatttccattattaaggccttgaagctttcagctgaattatatgtgcgcatatatacataatatttcacatgtcttgcattttacatatatttattcataggcacttgatcatttcttgctattgctgatggaattttatttaaaaaatacattttttaaaatggttatactaacatgtcaggatatattggtcttctttccagaatcctggtcagactcttacagttgtgtgtcatttctcatgggttctctgtgtgggcgtcatcagcagataatgccacttttccttccctccttgtcctgctttgtctttctacttttctctgttgagttgcacttgtgacatatctcacatggtgacagtaggtgtgcgtgtgcgtgtgcatgtttgtctagttgctggctttagagtgatcgtagcttcttagtggaggacttcctgggcccactgctgtctgtgccttggtcctggtgcctctggcatcccaccgtctacaggcatccctctactttaatcttgcatttgatccatacagctcttttggattttactctcatttttgtaacagaatcctatcaaacctggatccacgagagacaatttcacagtggggatgcttgaaaggtcattttcttttcttgcctcccgcaatagcttctctgtcttgtacaagagaacgtaggtcataaacccactgttcttctaaggtttgcagcatggcgctcatgacgtcataggtaatggtagctgatagaaggagaatccatcctgattctacatgccctgacttgactgctttacttagctgcacagcccttgcgcttccctggggtttctaggtcactttttacatgtgctgctctgtcagtgagctccttccctctctagcatatgtgcccctttgtgatctcagtcctcttgcctaaagtcttcatttaagtgttgtcatttcctggatctgccctccaatctcacactttccccttcaactttctaccagtttgtcattttgtactgtttgtagatattttccctaatttcactctgtaacccacctatttggtgttcatttctgtaatcttaaatttcctctttcatctataaataggtttttaaagcattctgttctgtttcagaatgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatatatatatatatatatatatatatatatatatatatatatatatatatacttttaaccctgtgttgcttgtctgtttgtgtgccttgaattcctgctctcctctagaagcctccttgtatgtctggctatctcggctatctggtcacttttaaagatggaagaattactgaacttattggaagctttgagggtaaacaaggagaatgtcaactttgaaatatgctgtagaatggtatgttgatgccatttgctgggtgaactcataattgtagccctaaagactctttgtggggtgtccaggagatgatccaataattgagcatactctacagggtcaacacctgtctgccccactgccgggagctaaagggaacaccaggcctagaatcatcagcctatgtgctacttgatgcaaagtaggacagctcattgcctaggagctctctctggccaagcccctgacaacaccaaatggaaaggtggctaccatcccggtaggtggggctaggaataaaatgtacagctctagggaccttactaaattatgaccaatgtcctcttcttctttggtgaccgactcctctatccgctaccaccgcagctccagaggggtctagtgatgcttctgagcttggtgcctgctggttctccccagcccccttactcctgcctcagtactctgttcctttggtctgctgtctatatgatcattcattcatcttttctatcttctaaaatctcgttattatcattcattatactcagatgtggccaatttacagcatgtgggacacacttagctgcctgaaccccagaatggctatgaatgcagcccaacacaaaatcctggccttacttagaaccttatgagcttctttcagtttctttttaaaacttgcttgcatggttctcaagcatgcactttagagatggcagtattggatgcgatgccaatggttggacatgctggttaggcttgcaaaaggttgccctccttagttagttttatcaagtgaacgtaatggcacatacagtgccttcagtatgtcctgtctacctagaaatgccagattcaatttgggtttttttcatcaaatttgttttccaactcactgttcctattttgcactgttcctctaatacctaagcttttccctcggttatctctaggaaatctatttccttctttctcaaatctacctattttctttttcttgcttgatcctattgttttagtattgttctttgtaacagcactaagcacaatagcatgcaatcctgttatgtagtccacttctgattttgatatttccaatttttaagatttgatttttaaagttttctttctctaactggcctatatagtatgctcctttgcccctttaaaatgagtgtattagtgtatgcttctgtgtgtttgtgaatctgtggtgtgtgtgtatatgattatatatgtatgtgtgtatactatgtgtacatatgtatatgtgtatgtatgtgtttataggtgtgtgtgtgtgtatatatgtacacacacacacacacacacacacctatataagcacatttcacaggtaggaatgttgacaggtccattttcacagatatttgctttttatgagactcttgcaagtttctaattgtcaaatcttttagtttgcttgttttgagacaaagtctcactaactaatgttggtagacttaaacataaggtatcttccacacctcaaattacctgatacacttgttttagcttcccaagtgtgccaccatacccagctctacactgagaagccatcactaccaaatgctcccatattttttatttctgaagagttaaggatttttagtatcccagagctgtgtttatattactttcttgccatggtgttctaaggtagcttaaatttgagactctataacttcatgtgctttactttgggaacttttccaaaagtgtctaaaggctatggaaatgactgtatgcctatgtgtagctggtcttttctgctttgtggatcctactttatcctaactttactgcatctgccacccccacttcaacccccatcactagattggagacaaaaaattataacagggatgaggggggatccttaattataatttttttcttcttgtttattcttgagcacagctactgacaaactgcaaacaaccccactgaatgaccagcaagcacccacccacctagggggctcttgcatttatgccctctgaaaagtttctagaattctaaatatcacacaaccacaaaaactatctgctgctggcaaaaccacgcctctgtcagagcccaagaatcagagtcagctgatctggacagtctaaggcagtcccttatccccgtatctaggattacaaccaaatctctttttttaatgttatttctgtgttaaagaaaccaaaattccagaattgtcagtacagcctatggctttttctccttttcatcttagaaccaatgggcaataagaaatttgaggctttgagatgagagagtccaattagggctacctacttcatataggaacaaagtcacatttcttcatgggcattagactcaccatggcatccccagtgtctcagtgggtagttgtgtgggatgccatgatatcaacttttgattaaatttggcttcaaattttatgtctctactttttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgtgtgtgtgtgtgtgtgtgtgtgtgtgtgtgtgtgtgtgtgtgtgtagtggtggtggtggatgcatgtgtccattaagagacctgaggttgagagttggttctttctgtaacacgttcagccttcttgtcttttttctccttccttcctttttttttctatttgagagagtctctaactgaacctggaattctatgtttaggtagtcttgcctggccaccaaatccttgagatccacctgtttgtgtccaccccctgacccctacctcatatcctaggcactggctcacactgtgcctggttttacatgtgttctgggatcagaagtaaagattttgtgcttgcatagcaagcatgttatccactgagtgatcttcctaacccctctactttccttctctcccaaaggagaatctcctctcctcttctcccctcccctcctttcccctcttctctcctttcctcttcttttcctttcctttctatatttcccctccagtttaggcttcatcaccttccagagctcctctctgaagactgaagccaaggaggcttatcttctgcctttaactcctttggagttggtcatttgagctctataactaccaccatattatccagtcgcattttgttattgtgcttgtattttagcctcacatggaaactgaaagagccaggtctgcagagccactgttgactcagtgttcccacttcccgactgtttgcaagcatgttacatgatgaagaaacagctgggatgctggccctttgctgctctgtgtgtcctgtgcagaccatccctttcccggagaagctactggcatctggcagcatcgcagatgcagcactcatataatctgtcactcagactgggtctgttctgagagtgaaaggggcactattaatagttttgcaggaacaacaggtgtacactgggactctccctgacaagctggggcatatggccaccttatgttatagatcaccttgagtgcttcagggaaatttgcacagctgctctcaagatactgatctttgagacaaaaattatcatcacatacaaaggcttttctccggtggcttaactttacaggtaataaaatgttgattttttttttgacattcttgttttttcagcattgtctgtggctctgactgcttgttataactgaagttagagtaggtggatgatctgaagattaggaaaggccttaatttttgtgaacccattgcatcccaaagggaacaaggagccttgatatccagagttttgtgctttcttctcttgggtgttattggagcacagagttcctactcccactgtagttggcaaggtctgtgaatgatgatctgtagatagtattgtgtcttcatagtaatgggtccctagtgctgtagtttagtactgtgcaatagggtttcaacaggcacaagataaacccactgcctcctacctcctttgtccctgaagcccctgctgacatgttctgctctgctcctctacagctgatgtggcagaaggccacctcctacagtagaaatggcaggaagaaaaaccttgagtgaaattatgtggagtgttctggagacctgggagagtcttatacgtatagagagcagatgtctctcacctgtgaatgaaggaattcaggttatgttacccaatggaaattggatgcagttcagttgagtgtggtgatgtcagctgacatgatttaggatggcagtcagttgctatgagaacagagcagggagactaggtctgaagaggccttgatgtcaggagagacagaaaagtgagagtaagaagggatgaaatgcagagttgcagctgactggacagagggcataagcagacacagctatgatagaacaccaaagggctgggtggagggtgacaaggacaagatgagtgctgccgacatgcttgatgtctggagaggtgtgtggagcatatcaacagggccttgcataaagattctctgtggacagagagttgaaagaaaaggaggcaggaactttgccttctgcccctcttctacagctggcagagagagtaatatttctaggagaccttgtgggatggggattgtttgactcttgctaattgagcaaacccaagaagaatgaaaaataggtagaagttgtcagcatcagacagaggaaaaccttgagctaggtaaaaggaagagggagagctgggtttggtaaggaggctaggcagagactgcagacgtgtttttccagggcaggaccagacagttcatcacggagaacaaaggaaagcttcatgatacaggaagtggtcctgtgtagggagagattccctgggtaggatcctcaggctgtctgcctacctcctcaccagcccatactgagaatactgtttatgtatgaaaaatggcctctgttcttttccaactgttggaaacaataggtaagcaatcctttcttgttaggagcctacccacaaactaactcctttaaacatttttattacctttatgtatttattttagtgtgtgtgtgtgtgtgtgtgtgtgtgtgtgtgtagacgtcagaggacaactttgatgagtccagtttctccttccaacatgtgagaccagagatcaaacccaaggcgtcaggctcagcacctttacggtctgagccatctcgaaatccccaagtagctcaagtcagttcttttcttggaaactctgctcagaacttcgacttgtttctttcatctcagccttcagttgtttagtaaacatctcagtttcatgacggcctggtatttagatggcattgcatcagttgccttactgaggtgatttgcctcagttgtattacatcagcttcaagaatgtcagcaaacagaagcagggttcacttagggaaatgccgtggcctggtgccttcttctgtgagatagaaggtgtaagggctggtgaccagcatgacatctcatcctgaatcagaatccagaaggtggaaggctctctaagcctcctccttcaactttcttgaacttgaacacagaaccatgatcctttctctgaatactttgaaggaaagggagaacgggttcccagaatgtacaaactgttagaaaagagcaagccacactgaatcaaagtgtttatgctaatttctcctaatccttttgtgttgactatagtataaaatgagtcaaggcaggagttacctgggaacagttttaaatgatctataagttgtattgtttatcctatgcaatgctttccacaaatgtttgaggggacaaaatatcccatatgtgtccacttttatatttctgccacatattgccttttcccttggctattatacttgtctttcttgtaggctccagaatagcagtatatttagaaagtggatattaagaatgggttagtagctaagagcactgtagtgtatcctcatttttttatctaatcacgtgactttgacatttgctgaatatgttcctgtgggcatcagcagaattgcccagagggccaccagctctccaagcaggcctcattcattgactgttccttccaggacagtcaaggcgcacaagatcccccacctctttgcattgcctctgtttattggagccctcatcaactacaccggtgctcccgctccatggtggcgctgcatgtcctttctgagatctgctgtggggtaataccctaagacatcattttagtagtctgaggctccacttaagagtgtgtgcactgcactatgctctacagaataaacaaaaaatctgaaaatagagaaaagataagaaatattgtggttcaccccaaacaaatgaagcacagcctcctactaatagaccagcactttgtacagccatctcctcaacagtatgtgaaatttacaatctttaggtaagttggggtgtgactgggctttacaaactcattgcgctgcctgtttctttggaaactatattgccccacatataactttttgtattttgcccttaacaggtctttttctgactgaaataatactcataattaatggggtggtaaacatttcaaaataatgcaaaatatctaaaggcatctcaccacactgaaaagaaaaccactagcgttgtgggaacacaccgcgctcacactcccatggtcaccgttcacacccatggttttcttcaagtgacgtcacaacttaaagtgggtttcatagtcactgctgtcgttcactgtgttatgtctaccctcgttgctccttgcctgttactcctctcccctttcttctctcctgactgctaatgttgaacctgtgggtaccttccacacatcactcagctcacacaactccaccaaacactgttagacccaatccatgcctgtgtcgattttcttgttgccattttataaaaaccagattccagactccgtttctataacttttctttttctcactctacaacacaatattaagatccctctgctctcccttttacatgactacatatgatccctaactgtaatgaatatttgtttgtttttcatatcaacatgaatttatttaagatctggagagaaggctcaattgataaagcatgaagatctgagttcatatccccagcatccacacagaagctaggcataatggagcctatcagggcccccagtactaggagagagagattggtggatctgaaggacttgttagccttccagtctatccaatcatgagctccaggtttagaaaaacactgtcagaaaacttaaggaggaaaatgattgaggaagtctccgcttccaggcacatgtatgtgcacatatatgcatacatgtgtacccacaaaaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccctgtggcctcctcaaagtcatgcctgcctggtccgagctcaccttcaagaatgcatgcctccttactgtcgtcagtctcacatcttctcctccgtgttcctctcttccccactcctcccctcattctccctcatctttccaactctctaagaagcttgactcttgtatcattacctctgagagtgcatgctttggcctgttgaccccctctccacatcattctggaagcaactcctttgactagtctcaactctcttcatgcctactttctctactgatagactttctaacaaaactaactgctttgctcccatctccctttaatacttttcctgatatcattctgagaccttgaggtctctgaaggcaataggcccccttgcactttgagataggccacatcttagattctgtcatccagaggatgctcagcaatctgttctgtgaaagaatgtctgtagttggggctcagcagatgaggctctctgggtgacagcaggtcctagagcagagaggacagcaggtaggacacgtggaagctagttcctcgttgtgccaggctgttctcggtatgagggaaagtcttgctccctaattccgaattcactgacatcctggatgaggcaggctgatcatcattttgatatgtgtgtggtttgatgtgtacagcctgtcttgaacacagtagccctgtggtttgccttttactaagaattgcttcctttttcttccttttctcagaaaaggctgggctcatgaactaaggtctttctcgtgagttcatcagccgtggttactgtgtgaatacctatgggccttaagatcaaacagccacccagcccaggtgatttgaatactaattgtactgactactgtcgtattgaccacatgatgctagaatgagatatttaccaataaaaccatccatgtggctggccctccctgctactgtgagcaatttgcctgttgtcatatgtttttgtttgagaatctgaaaccaacctttgcattgcaggagggaaagagcttatgcagacactgggctggttggcctgctgtttcctttccctgttctcaggattccacccacttctgacttcagcacctactcctgactgagagagcaagtgtgttcacagagttgaactttatgtccttcctcgctcccacttcctttctacagtttactctcgtgtacacggagcagccttcatttggaaaaggttggaattttgacctgaggcactgagactgggctcctgtgttgcttgtgaccaatgaccaggagacctggagttttagaatcactaaagtgagacaccctgttctgtgtggctcttggggcattacttctttctttgttcttttagaaagctcagttttttgtttgtttgtttgcttgtttaattaaatgcagtttttaggcattagaagttctctcagataacagaggagcacaagaaatatcattttctacaaccccatacattagaacccaatgcaaaaaagaggagtctcaggcttacatttctaacaaagcctgattgcagcctaataaaatcctgggcaggaaagttgtggagcatatgagtttggtgatggcacagcctcgcatcctcactactgtgtactggcatcgtgtggttccaagatgctggcaaagaggtcaccagtatggagactgagacctcatccaggttagcacacggccagatgccatctctgcaccggagcattctggaggacaagaactagatctctgcagctatgcacatcagaaggactctcccaccaaaataaaatagaaacggttaaggattgctgcccaaatccccacagaaatcttgtcaaagtcaaaaggtgtaaacttaaaatacaggtatcaactctgccaatgaatgatgccacgcagtgactttatgggctcaaaaaatagagatttgagtcaagagacgctgaggtcagctgtcatcagaggctgcttactgagggctttggaaagagtgaagaaatggtgactgaatgaattaagggttgagagtgagaataggctttgtcctcaggatcaggtgaaatgagagaagaggcaaagtgggtcagagtacaatcagaccatgaggatggagaccagtgggaggaaccggtggggcagggcagagccaggcgccctggaattgctgagcacagccctgcaagggatcttgagagaaagctaaaaagcaggatgagtgcaggagagaagctgcaaggagagcaaacgcgggcaagagaagctcattcttagacagaggaccagccgactgaacacattatcttttaatccactgcctttcaataggcagaagtttcgttcctttaaacctcattcataaaagcaatacagacttaaattaatatatttgctcatggaagcttagagagagagactcatggctgactagactacttcagatcaaaggtttcagcaaaacatacttggaaatggtaatacagggaatacaattttaagccactgataagataatgctcgatgctaatagaacactcgatattttctaaggaatggcatcgtctttttcctcaggcctgatgtcatcacttcctacttcatccagatcttagcaccagggtgagccccacagtctgccctccaaagccctacagcactccctttttgcttttctacttctcttatcctccatgcaaacagtccgaacatcccagcactttatccctgtccactgtcagtgtgtgtgccctgaagactccccggttccagaaaatagtagccttaaaacagtcactttttttttctgttcttttcccaacttcatacgaatatgggtgtgtgtgtgtgtgtgtgtgtgtgtgtgtgtgtgtgtgttcgcatgagtgggtatgctaatgcatgcactgtgtatctgtgcaagtggaggctaatgtcaggaaccatccttggttagtcttctaccttagtcactacagcagttgctcaatcaaaaccaaagcttgatcgtgtacctaggcttgctaacaagcttgacgtggcaatccgcatctctgccctccaggtggcaggcagcccacctggcatctacgtggatttctgaagatccaatctctgctcgtcctgtttgtatggtgtagtggtttgagtgagaattggttccgcaggatcatctatttgaatacttgatctccagttggtgcaactgtttgggaaggattaggagctgtgtaattgttggagacatgctgcaggatgggctgtggggtttcacaagcttatgccatttccagttagctctctctgcttcctacttgctgaccaagatgctgctgctccagcatcgcgtctgttaccatgatcgctgtcatggtggtttgacatcgtaagccccaaattaaatttttcttttatattgtctttgtcgtggtgtctttatcacagtaatagaaaagtaactaagacacagggcaagtgtttaactgctaagccatctccccagacccctgtatcttttctttgccatgcggtgtgctaccttcgtgtgcttttaagcgttctcaagctgtatcgtcatgttctgagtctacaacttgccacatctggtccgattcccatgactatttaccactccagagatcagatcaagtatgccagtgaaactcttgtgtgggaaggaatagcagggctacttcagtgatcttccagagccatgttgctctacctttctccagttaagtctctcttctatgctagaccttcttgctcccaccaccgtgcgtttctttgccttgctgaacagccacctctgtgcaacagacctgctattctgccttgccttggttggagaattagaatgttcagcttagcccaggtcttcagacacttctctgccttttctctcccaggtagttcatcttctccctgacatcctttcatgtagggcccacattgtaggctatccaaaactgtgtgtactgactagaattgctcccatgtctctccatatttccaactctaggttggttgtgctgacttgggacagcctagcaccatctcagcatatctccgtccctcctcctccaagctcatcctcccctgtgattgctgttagggcaccacctggtaatgtagaccagatcttgtcctccaacttcggccctcctggtttccatcttccccttcttctgtatgcatatatcccctcacagcctcttcttcttctcagactttatccccatggcctcctagatgggaaattggtgaagaatctacaaaaatactcactagtagaagcagaaacttctgggtcaggaccaggaaatcctaacgtgaatattaaaggtgatgcacctctgttgattcctaacctcgatccagttcatagacacagagctctttgagtgaaggggagacagaagagaccccacaatgctgcccacattgtccacattgtatgctgtaatctctcctctcccagtgttcttccatggtaaagtactacactgtattagaataaaggaagcaattacacactggcctgagctgacactaattccatgagacccaaaccatccctgtaacactcctggtagagcaaggctgcagtgcatgaaagctgttctactcagagcaaggccttaaaggagtcgcaccaagcagagcaaggaaggccatctggaggtcaagtggccactcacgtgtaatcctcttttgtgtctattcccatagagactgaaggtccacacaaccacaggggtttcctacacgctattcaggccaaagtatttctgcaaagtttgtattccctgcctgagaacttccacagctaaagtttcaaggaaaaggcctgcgttccttagcctgagagctagagactcctcaaagtcttccctctatcaggcagtcttggcttcaaatcctcaccccagtactcccctttccccacctccccctccctttccttctccccctttccccaaataccatccctagatgttgcctgctctctagacttgtatgcctggcttttttttttttttttttttttttttttttttttttttttggctcccttctctggatttctgtggtgcctgtttttagcacaaatataccatgttcccttgtaaaatgcttttccttcactgtagcttacaagagccagggaaatgaccaaaatgtgtggatggattaactccccagagttggggagggagagggtgtctttctatggatgggctgcgaacagtcttcataaacaaaagattgccttgtttataccttttgtcagagtcagcattttttaaatctgcttaaggtgaaataagtgctttttgtttagggaaatcatatgggaaacacagaaatatgaaatgttcactttgtttaatgtataagtctattccacgacaggtggcctctcaaagcgcacaaataaaacaaaattgcttggctcaaacctatcagagaaggaataagagccaggtggtggggccaggagcagatgggcagtatttacttagagcttcatattttcttcttgctaagtgtccccctggtcaaataccttccttcatatatcaaataaaccttccatgcctttgaatagacttttattacaaaggtatattcctacacccggtttctcctttttacaaagtcaagggtagaaaaaccatatggtgcccatagagtgtggagtctgggctagcttaaacattccaagcctctatccagacttttctttgaagtttccaaatttcacagtcagaattaaaatagcataagaactaaattgaaactagtatgagtcccaggaatttttttctataccaaataaggaggcgtctatcccgatggtctgtgtgaactaggtatagttgaggcagatctttacagtgaacttcccaaacatctgcacccctctgcaccaggcagtcattcagagccacataggtcttcaggaagcactgtggtcctctataagcaccagcccttggccatctttaaattcttctctccattggtctagaactattatggctctgatgtgtttttttttttttcctgatgctcagactgctgtgttcatgttttttccaacaaatatttatgaattttataggtagaaaacaagtgttcgccctccttctctcaacaattggatatatagaattagtttcttctctttcttacatatgtatctttagcatgtttttaattcttagcaattgcccattgctgtccagatacagtatcagtgctacataatgctatctcttcatgtggtccaagatcacataagggttgaagtaactctgagtccttcatcaagagagagagaggtacagtttgcaccatccaggtgcctcagacttcttctcagaagagcttctgccatcatgaggttagacacgtagacagtgtgctgtgatagaagacggactttaagacttactaggaaaggcacatcttcaaaggaaaaagaggtttccagtgagaactgttaagctcttgaaaaggtttacagagaaagctgtggtctcgcctttcctagaagcactgaagtcaatacatagcatcccgcagtcgttgaatgctgacttctgttgaggtgcaatgaagcctcccagctcagcacattcaacatcccactaatccatcttactgcatattccacaggagtctctttgtgacttacaagaaacaatgagacaaacatcatttttcatttttctagctcctttttttgttagtttttaaaataaaagaacctatgttgcttttttttttttttttttttttgcctctcatggcattcaaatttagcttttatataattcaccctctcccagtaactcagggtacatttgagagagacacatgctaaagccataaacaatgcttacttttttcctagaagatggtgcagcaggagtcctacagaagaaattgaggtgcggattccttgggactcaccagtgttctttacgtggcgtcatcattatttatatacttatttgtatgggaacatgcacactgccacatgggtgctggcctttccttctatgctgtggattctggagaaggaactgcagtcgtcattcccactgagccatctcacctctcccagagtgttttgaaagtttcttttcacaagactgtagtgctttcctgctctgtgcctcacatggtgcttgctggctgctgaaccgactgagatacctgagatgtgttttctgctccaaaagtgcttacaatcttgcacagaagagaaggtgtcattaaataactgcacatgctatgaggaagtgtgattctgtatcacaggaaggccatgagatgaaggatagctttgttgcagaaatatggttggcaatttgaatttttgcctttccaggctatggcgtttctcccttgctttatctttgtacctttcaaacactaggacagttatttattggtaactttacccactcatcctcaaccatctcatttgttgtcccttctctccatagatgcagatagccacattttatttcttgagtatatgtctagtgtctccttgtgctacacacacacacatttatatgaatatatacatatgtaagtattcatatatagagatatatttcttcttttgttctttcttacacaaaacaatgctgtttgttattcagacagcttgttcacataacagtgtattctcgagataggatgcccttcttttcttcatggttgatatgctgccttcatagcatcaaccttctgagagataccaggttgtatcactgaggtactccataatagagtggcttcagcgacagctgttttattactccctagttctgtgggtcagccagtagattttctgctggtcttgccagaatttacatgtgtggatacagtcataaggctacgctactcctacagccttgcttgttccatggttgccatggttgctggtagatccttacagcacctgcaatcagttctctcagcaagtttacttggaatacttcaaatgggcccagaaacaaaaggggactgtgccccaacatggaggtactgagaagccgccttattgccttgtacttgcttacatctcattagtgaaaagagagctaacctcagagtcagaggagaaaggaatgcagaatgagcagttccctggagtcattacagaactccatatagctagccagctcctcattgcagcaggtatagttagttagccagctccctatcacagtaggtatagctagccagctccccattgcagcaggtatagctagccagctccccattgcagcaggtatagttagttagccagctccctatcacagtaggtatagctagccagctccccattgcagcaggtatagctagttaaccagctccctattgcagcaggtatagctagccagctccccattgcagcaggtataactagttaaccagctccccattgcagcaggtatagttaaccagctcctgctcatggacacctggctatttcagtctcctggtgttgtaaatactgcccagaatatcactttgccataattcagttcatatgtgaacatggcaaatccccagaatgggattgttgggttaaagggcaaatgctttccaagttatctatgtattctgtttctctcgtgttatttctctggttattttaagcctgtgttttctgtcactgatttagggactttaaaactgaaaagagtttaaaattagttaattataaacttatctttagagataaagagacagagagacagagaaacagaaagagagacagagacagagattatgtgtatattacatgcgtgcgaagaggaaaggcaaaggaagatgttgggtgactttttctaccattcttcaccttatcctttgagatagactctctgactgaacctaagctcactaatgtagttaggctcactggccattgagatctgtctgtttttgcctcaatactggagttatgggcacgtaaactgatgccctgattttatgtggctgctgagaatttgaacctaggtcttctgcttttacagcaagcactcttactcagtgagacctctgcccagctccaaacttacctctaaaataaccaaacatgtgaaatctgtaaatcaaatgcttttgaataaagtaacatgtatgtaataaggagatatgcctcatatattgatgctttgggtcttgctcgagagttaccatagaggcatttaaattgcatatagtatctcagcaagtatacatttaaaagcctgatgatttctgtgacctgtcccagtgtgtatgttacgttatagccaggacatagacctagcaaactgtggcaaatttccccttaatggaatctcattagtgcaaatttgtgtttcgtatctaattcagcttcagagggtgtcaatttgcttgccttgctcactggcacatttgcaccttactggtggtcccacttgattttttccgtaagaaacttttttttattgaacatagtttatttctggtttctgattattggcacacatcctagagtttcgttttgcctgtgaactcatgtctgttaggtctcaggcggcccaaatgtccagaaatgaactcaacctggaccacaggagaatttctagcagttagataaaagccagcattcttcaggaacttgggaaaccagttccaaattgccaaaaggagtcatgtcccttatctctggcagaagagacacatggctccattggcatatacctgtgactgcctgtcttgtaagcatgtgtgcttccaggcactcacagtcccacaggtacttgttctacatttcaaagtcccggaaccagcatctcaccttctcacctcttcatctgccctcatcaccctgcagctattcatcctcctacagccatgtttttactattgtctccgtgctctctctgtctcctgctacactctttgacctctgtcctctctattccgcactattctctcctctctcacagatggctctggacatgctcagcatgccggacatacatgttcagtctgcttctttttccctctgctctctcttaatcacaataaagaccttaaccatacaatggaatggtcatgtttctgtacttgccctcacatacagtgtctaagcagagactcaactctgatctctgtccgctctgatctctgtccgcagtaaatcttgagaggaattctgtctgagtccgtgtgcctacttttggccttcaggaaggaggagttgttttttaaataaaaccttgtcccagccctcctgcagcagacgtgaaaagtacactgttttgccttttcttgaattcaccctcagatgttttcataggcgcttggtcacagcaaagtggtccctgtgtacaaaccgcccactctctgaagcatgattgattagcaaagctgctctgctcaagggcagtctgttttcccgagcctggatgttgacaggtccgacatgcacagattttaaaacaggtcgctcatgcaggctgtaggctgtgggccaacatgctggttcttgagagagaagagagggaaaaggacccagtttggggagcagaggaaactatatggatctggaccttaaaaaaaaagagggcagcttgggcatacctactccttactgcaaagctgctcactggtgtttggtgccaagaaaacaaaccctgtcagcagaggaaatgcaaggcaaaggtaaagatagggacggactggcagagctcactcaaataggcacaagctccacttgactaagaatctctaaacatcaaagagaggcatacatttaaagagaaacttgagaccaaatcaaagtagctatgatggccgtttggaaatgcagccaagcaatgacaccataaacaggaagaggcacggtttggatcgtgtctctgcttgttcgtttgctgcatggcatctagcagagtgtcttttacagggcagagcccacattaatatttagtcatagaatgatggggctgaaagtaactttggaaatgatttgccaagtctctctatttcacatacaagtaaactgagactcaaacagtttagttatggtctcagggtgtcttctccacaaccaggctgtgaattctagtaaagctagcttttatagacttacgcagtcagcatttgatccattaagtgagggaatatgctgatatagtgatccctcccccgctcaaagcccgagttgaaggcttggtcaccagcctgtggcactattgggagatggtaagacctttagaatttggggtatatagtatgaggaagatatgtcggtgggatgtgtccttgaataggatattggaacccctaatggatcctcttcatttccttgtttcctcatcaccataggtgaacagacctcccttcatatagagtactgagatgccacagttccaaagaaatgggccaaagaactatgggctaaaataaaccttccctcctaactaaattcatttatttgtggcattcgttagagtagcagaaagccaactaaccaactaaataaatttgtggttgttgttgaatgtagcgctggctgaccttacactcagagatccacctgcctctgtatccagagtcctgggattaaagggacatggcaccacacttggcctttaattatctgtgtaataaaccctatttcaaagccatgccttctttgacagtatgtgtaatagtctctttcattcagttatatatatatatatatattggttatcattcacccatgtagatctttggggtggtgggcatagagaggtttgtgaggttcaactaactttcgggaatctgagtttccaaacattctagttatattaagtaagtcttaatgtcagtgttggatgaaaatgtaggcttttcttacaataatttgttacatgctcaagatgtaagcagcttgggaaagaaaattctgcatgaagctaacaatggtctgttagtatactgtagtcaactgggtatcagtgtagcagtggaaccaaagatcttcagaaagaacagcccttacccctctgagtgttctcctctgcggcaccagttctttgtgcagctaacagaagatgcctggtccatccaggcacaccttgcagcaagctccccagtcttatatgacagccatcacgtgactcaacatcctatctctgtcatttttagcctttggctatcatgctaccgagaaagatgagaatacatttttataagtcccttaaaaattatgtttgtcagaatttattgtcccgaatcaattttaacaagtgacaaaagtgtctagaatcttcctgtctgatgcaaggtttgtaaagggtcagatgatatcatacctttgaggatgaatctgtcacttaactgctatacgtgttgcagagaacattttagtagcccactgtttggtatcttcactggtgcctcctatctggtttcctgtgtcataaagaaaaagctgcatggaaataaaggcagggatcctaacgcagtgtgggtttggttttgctgtttggtgcgaggagttgtgtgactctaactctaagaacaccggtagtggtgtctgcctgcattctgagaatttaaggaggtgaggtttctacacaacaaaatcacccagcctatctgtgaggctttctgcagagtgaaggcaaaaataaactccagcaaacaaaacaggaagagtctgaaaacagtaagatgtgtgtgttcagacgctcagaatccttaaagcttaggtgtggttctgcctacttcaaaggtgtgtgtgtgtgtgtctgtgtgtgtgatgtgtgtgtgtgtgtgtgtgtgtgtgtgtgtgtgtgagatgtgtggtgtgtatgactagagtatgtgactgtatgtgtgatgtgtatgtaatgtgtacatttgtgtgcagtgtggatctgtatagggggtgattgtagtgtgttgcagtgtgagtgtgtgtagtgtttgtgtggactatggcagtgtgtgcgtaatatgtttatgtgtgagggtgtgtgatatgtgtatagtatatacatttgtgtatattgtaggtatgtgtaggatgtgtgtaatgtgttgtagtgtaagtgtagagggtatgtgtggagatgtgtgtgatgaaggtttagtgtatacatttatgtgtagtatgggcatgtgtaggatgtgtgtatagtgtgttatagtatgagtgattatgtagtgtgtgagtatgtgtgtgtgcttgtgtgtatgtatgtgtgtgtgtaggtgtgtgtgtggtgggtatgagtatgtggctgccttgctttgtctggccttccttttgttagcacacacacactctcctagtgacttaaagccctcttcttacagcacctgagttctctccttcgacttgcagctactttattgagctacgaaagcaaacataacttcttacaaaataaagtccaaataacctaaaagatccgatggaatttacctttgaagcaatattatactaagcactttaagattttccatggagaaaatcccaacccaatggacagccttgcttaacccaaggctttccctggtttaatatttctcctctacccaccatctgctttgccaacaaaataatgctttccctgggtatataccccacctctccagtctcattaaaatgattttcatctgcatttaaaatatttgatgatgatttgacattcataaggataggaggttgaatattacattatcttatcaaaagattttcttctattctttccttctgctcctcccttcctacttcccacctccttccttctctttgatattctccctgaattgctatctgtgaagatacaaaaaactaactgtagacatgtctgacacctccagatgttattgcactaaagctgccactcctgaaaactcagtggttgacaccgggttgcagggctacagcagaagatgacagcaagagccaccttgggagttcttgagtcacactggtcctaaaatcatcactagcaggaacatggaaaatggtttgagaagtgggtgttctgagaatgcccattgtaggacaggcagctgagaacatccagcctgagaaggtgacaaggacactgaagggcaggttctagccatgtcagcatcctcctgaggaccctggaatctgcttctacacagtgtttgacagtcatgtgtcaacacgacatggtttcttactgtttcaggaaaacatgatttttgtctcaccagtacattctattctattctattttctgttctaagaaatcaaaatatgggcagaagataagttcaaaggaaatttgctacttctggtggctaaatgcagtcaaagatatctgatcatgatgctaaaatagtgacatttcttgtttataattctaaagggaaagtaaggtgcaggacaaaattgagatacaagaatctgagaaattcaagccagaaaacccacccatctaggatgctcacagttgttaggaatcagagatggtttttagcccttggccttcatggtaggcttcttttttaaattaaaatttttaaatttattttcaagtaacaaacattgtgtctagaggcttttgtacttcttcccacatgataaaaggccatgcctcctaagttaactaagcatattaaccacacacagtgagtggcttgcattacttttccataccctcgcttggctttgatcttcccattgcaaagccaagaggaccatcaagggagagaaatgagcacaccgtgtgtcctttcctctagtgtgggcagtcttcttagtcaagaagcccctttgggtaacccagggactaaataacacaaccagactcccccacccttcatcaatatttaattaatatcgattctttgtgtagcttcttcttacttcagaacctccacagataaactttctccataaatgagccttttaaggcatatattctaaatatctctaagcctcagagagcagtttttaaacaagctgtgcattgatttcctctaactcccacatatttcttgagtggttttcctgaaagattctttggttcatttaacaaaaaaaaaaaaaaaaaaaacaaaccctgtccctggttggtcaaggttatagggatctaggtaatatggaattctttctcagagatttcagtttcactagaggatataagacactccaacaaatgggccagagagaaacttgcacagtgcagatccctgcatacctacaggctggttagattacagttttattgaacgttacaagctcccacagctctcccgcatagaatttaaaagtctttactttctggggttataattatggtgactgaatttttccataccaaaaattaaaacccatggccggacaaaggattcttgtgccacttctaggtgtgagaccacccatagttagactttgtaaagtaggcattttcaggcaggccccataaaagtagagattcgttaagtaggcatgcttttagacttttcattaaaagcctataatgcaaacagtattttattctgtatctgaatcaacacgttgtatcctaaagcactattttatagccttaaggtatgtgttagcctattcataaaaaacctgtagtgctgcacattgagtaacgatacccaccattatccaggtggggcaaaaaggtccctagtggtctactccaggcctttaattttccttttgaagataaaagtcccctatttcactttcaaagctcaaggttttttgagccatgcaagtgatcgccactgaggcatgccagatgtgagcagctgtgagcagtcactcctgaaaggagaggaaggagtgactttttcttcctgtcatttctgcatgtgtaacttttcagaccagcaaggtcatggagatagatactgcccagggtgcagtagcccaggcagaagctcttgaactggggtttttttttggggggggggggtctaaaactgggtgtgttgatggtttaaaactgctgaaactaaaatctgcttgaccaaaatgaagtgacatacccaaagccaccatgttttggtgggcaagccaggttccaattggaagcttggtgacaaacacaggtccccctcccaagcaatgagctttcttcttccccagagtcactctagtgcatccccaactttgaagttggggacacccatacaatatgattacatcattccaaaccctgtgcttactgcctggaaagtacatggaaatgtttggcaaatgaaggtcttcaaccaacaacctctttggtgaggtggcttcagaggtgccaaggcttttcaaggccaactttcagctggacagaagccaagttcaagctgaatatactctgcttcctttcaccctaggaccaccttcttgaaaccagactatcacagtagagctgattccccagtctttttagtagacagtatccatcatttatcttacaaagggctgcatttatgaaatgcttatctgggtacactttctgaatgtagtccttctattaaagcatactaggtatgggtctgcactgttggctcaatgattaaggaactcaaagcttttctggaggactgaagttcaggtcccagaacccacatcagacccctaacaatctcctgtaacttaatcatctgacaccctcttctggcttccatgggcatacacacagtgtgcacgtgtgtgcacaaatacatacacacacatacacacacacacacactgtcaaaataaaaacaagtcttaaatcacacatgctaggttatttatccaactaacctccaaattcaacttaattcccctttccatccattccatcattcaatgactattttctgttttgtattaacatttatttacatgtgtatgcatgtgcacaatgtgtgtattataacttgtatatggaggtctgaggacaacctgtgagtcagttctcataccttttggataccagggattggactcaggtcattgggtttgaagcaagggctgacagcagctgaatcatgactatttattgagtgtgtgccatatagagggcactttgctggctatcaaagatactgactgcagtgaacaaaaagactaaggtcatagtccattgtggcttatgtgctaccaagtcgtattaataaatgtaccactctttttatatattagtcagaatttcttatcctatatcaaaataccttacaggaacaacttagaggacaaaggacttgttttgtttatgctttcagagtgtccagtatgtcatgattggggagtggggctggtgctgcagagcagatccgagtagcttacctcatagcagtcaggaagcagagagcggagttacactttttggctttctctgttttcttccattgcagtccccagcctatggaatagtcacttatatttaaagtgactcttccacacttagtttatcatctccagaaaatcttcaaagacacatcctagtgaagaggggtgcttacaaaaatctcctaggtgccttgcaatctagtcaagttgacaaccaagactgaccctctcactcagcataagaccacagctttgtttcatttgattttttattcccatgaaagcagagatcattcagtcttaccttcttcagggactcaacctagatgaacctagagcatgtggcagctgagtgtgtagctcagaggatgaaacacttgaattacaaggggtttaaaaagtctccaatatagttctagattatttttaataatgcaaaagaaatgaaaaccaggccatcttttatttttaatattccacactttgctttgaggcatttaaggatttctaattagttaaagattaatcaagtacaagagcccagctaagtagacccactgtgccgctcttttcaaactcgctttgttagtttggcatcttatttgctggcagcatttcagactctccgcataatgcatcagaaagctttagaatgtatcctgacccatgggccagcattaattttgcagcaaccattgctcatgtataatacctacagccagcgagttcaccagaaaacccacctcagatgctcactcagcgtgagtgtcatttcacataaaagggaagcacagttccacctgaggaggctggtgacggtgttgagcaccaatatcctgttcttgaaaagactggaactgtatacacaccaacaaaattctggttagaaaatggaatgtggttggagataggtctgttacagcagccaaggtgatttagagttactaagatacactctccagagtactttctttggttttcttgggctgccttatggcttccagggagtgggaaagggcttctggggtttagcctttagaaaagattttagattcttcccttttatgtgggttgtgctcttggtccctagaaatgagataatgattctgataagtggcgtctctacactccagctctggatactatgtgcctctggacaggacagtctaacctaattaattggggtggatgtagattgcactcaaaaactcatcttcaaaacttattttctttcaaatacaagagggactggtttcatacaattaaattatagaataaatcatggtataaaatcattaagctttgcatttcaaaccagtttcttatcttctttaatcttgatgatataactgctaatttgaaaatgattatgaagagtggaattagcagtcgtacacttgattccttttagggtgaatggtggaaaattgctcctgtttacatattatcctagcagaaaacatctgttcctttgctcagacccacagtaagactgagatcagcataaagacctgtggttttgagtcacaagctaagatacagcagacccccaactcaacctgcaatccagttccagggacatcatgagaaacatcagacatccaagaaatggctgttggtggggaatagggattgatcgcagactgactggtagtcacttactgaaggtgacactttgctgtgtgtggtagtgtgtgtggggtgagtataccaggtcttcctttcccaggtaacaggaggacatctgccacattgactcagtaaaatagtgtgtgtggaacactgatgcctgagcgtaacaggtagagaaacatttttaaatacaaataacttcaacccacacatctgggatcagcctggcttttcctcaccttttcttttcttttcttttcttttcttttcttttcttttcttttcttttcttttcttttcttttcttttcttttcttttcttttcttttctcttctcttcttttcttttcttttcttttcttttctttctctctatctcttccttccttcctttctttctttttcttttttttaaaattaggtatttatttcatttacatttccaatgctatcccaaaagtcccccacatgctcccccacccactcccgcaccctcccactcctacttcttggccctggcgttcccctgtactgaggcatataaagtttgcatgaccaatgggcctctcttccattgatggccgactaggccatcttctgattcatatgcagctagagacatgagttctgggggtactggttagttcatattgttgttccacctatagggttgcagatccctttagctccttggttactttctctagctcctccattgggggccctgtgttccatccaatagctgactgtgagcatccacttctgtgtttgccaggccctggcatagcctcacaaaagacagccatatctgggtcctttcagcaaaatcttgctagtgtatgcaattgtgtcagcgtttggaagctgattatgagatggatccccggatatggcagtctctagatggtccatcctttcgtctcagatccaaactttgtctctgtaattccttccatgggtgttttgttcccaattcaaagaaggggcaaagtgtctacactttggtcttcattcttcttgagtttcatgcatttagcagattgtatcttatatcttgggtattctaagttcctgggctaatatccacttatcagtgagtacatattgtgcgagttcttttctgattgggttacctcactcaggatgatgccctccaggtccatccatttgcctaggaatttcataaattcattctttttaatagctgagtagtactccattgtgtaaatgtaccatattttctgtatctattcctctgttgaggggcatctgggttctttccagcttctggctattataaataaggctgctatgaacatagtggagcatgtgtccttcttattggttggaacatcttctggatatatgcccaggatctatctgtctctctctctctctctctctctctctctctctctctctctnnnnnnnnnnnnnnnnnnnnnncttacagtttcaatacttacttacttttatgtgtatgtgtatatatcatatgcgtgtgagagcatattacaacacaacactttgcggaggtcctaggacatccttaggcatccgtctttacctttcaccttgtgtttcttgttcgccactgtgctatgcactcctggctagtttgtccttgaacattttggggttctcctgttttcacctctcctctctccaaaggggtgctgggattacagttatgccccattgtgctcatcctttctatgggactcaagctcaggttgtgagacttgcatggcaagtgttactacccagtgagccacaacctcagcccttgcttatggttttaaattgagcatccacataagataatggcaagcaactatttaacacagggttgctgtctcggaaagactttaccaatcagttgtactgtgactgcagactgtaccctctgggacatgtctaggaagacagagtcagaagtagcagatgtgaaaggctcccgtgacttctctccatacactattaatgagggtgacttttttaaaaatgtctttatggtacattttgaactcaatatttgaaaatacaaaatccacatatctttgacattcaagaatcctccctgcttgtatataaggctgaccattattgatttgttttctcagcaaacataaaacaaactaggaaacacagaaatgcctgtgtgggaaactggttcagttggtaaattgatgttatgtgtacacacacataatctgagtagtataaattaaaaataatataatattgaatgaaaatcataatcatgtatacattgtttaacatgcacgtggttaacttatatagatgtggactgtcatattagctagtttgttgttttgaccttaatttgcctattcaaacacttattcctatcgctcatataactaaacaccaatctgtcttagccattcactaatttctaagtaaatgcttgtactgttttccaacaatctgaccatagcagcagtcgccctggtcgttacacactaaaaccctgccatacatcacacgcttcttctcctacctcctcagaactttacaaatcctgaaagaagaggagaaaagacagtttccacagtctcctggaattcaccatagctgcacaggaggaaggtctggagctagctctcacacggattctgtccccaaatgtcatctgcccaaggaacggccctagttagtctttcagagtctgttctctggttaagagatcatttctgggttaagagttaagaggaatactcttgggattgttcattattgtttcagatttctagcatcttccagtcaccaagtatggaactttgttaaccatcccacactttacgctcaccaaaccatttgatcacatatacagagaactttccagctacttcctgggtatatttatttacctctgctggagttcccatggtgtgaacaccagctttattcatggggccaggtggagcttgctatctgaaaaccaccctggctttcagggtaggaccgagttcagctgagcaacgctgaaccattgtttgttttatgagataaagaacaaagacaaacaaaagagccaagtctgcttttagaatcattcaagtaatgtaatttttattagttgaactaatgctagatgtggcctggttttgatttaagagatttctattgttccacaggctgtgcacacccagggtggtggggtagcagttactgaaatgacgctaggaagccattgcatgccttgtgtcctttctgcttagcccatatccctccttctgctggttactgacacaggactctgttgaacttcttttgattttcttgactgagtaggtaagaaggctggacaagaggacacacaggcataaaataggtatccaccctgggtttagcaatggctttttggagaaaataactaatttgcatcttggagcagaggtgacaaaggtgcctgagtccctagaatggggacagtgtgtatagggcaggagtacagcaagcaaggcacttctgcacagctgcaggtctctggagtgggctttcatttctgcagggatattgaccacaaagagcttagttcttggttcatcctaataggtatgctggagaaacatttatagaatgaatagttttgctccaaaacatttccccaatgccattaatgatactgtaggtgtctatgaaccctttttaagatctctcttatctggccatgcctgtccttttttcctaaattaataccagtgaaggacacacctgaacagaggaaatctttagagactcaagtgaaataaagtggtaactgctatttttgaaacagattgttggtataatacccattttgcaaaacaaggaaagcttagggctccagtttctgtttttagtaatgaaaagggatagtcataggagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagggagaagaggaaaagggaagagaagggagaggagggaaaggaaggaaaggaaaattgaagagcaatggttcagactttggaaattgaagcaataggccaacagtaatgcatgaatatggagatcgctgagtgggtaagaagaatgtttgcaacactagtgtgaggatcttagctgcactcaggtaaaattggggtgtggtagcatttgtttgtaaacctagtgctggggggccagagacagatggatcctgaggactctctggccctccagtctggtgcctcacttccggttcagtgagatgtgctatctcacaagacaagatggagggagttagaggaagaaacagacttagagtcctggtccaaacacatacataaacacacaaacacacacacacaagaaagcatactcacacatatacatgtatgcacatgcatacaatgcatagacatagactaacatgtgattagtatctgataatggaagtcatcccatcgggcactggatggatttgctaaaatctaaccagtaaagtacatctctttttattgtcagcctgcttccattcttccagtaattataagctaaaggcaggcagtgccatagattcaaaagctagctggaaactgaagagattacctagtaaacggtaggcagggaggggtgcattagacacatgtgtataataaagatgataaatgtgcataagtatagctgtgatgaaatgtgtataaagacttagaactccacagaagtaagcaaagcataaatagatagcatgctcaggcagagagaaatcgggtgctattttagcacttggactagtgataatttattgttcagcctctcctgttgactcagtgtttatgcagtgctatatattaactgagaccaaaatagtctgtgcacatcacaggcttggatccattaccaagcgatcagcagaagctgcaccaaacaaccactccctacaagaaatggatttataatatttaaagtattcatcctaaaaacacaagctgttttgacaattttttgtctgttaatcagtatggtttaaaacatggtggtatggtatatcacagaaaaagatagttagtggttgagaagccaaagtgaaagcccgagattctgtgggttgagatttcttagagttgatgtgaagatgaaatgtgttccgttgaaacagaatctaagtgagatgaggggcactcaagctggtgtggccagaggcctgagaaagacttggtgcttgccggggcaattgtaattacctaggtttcaacccagaccagggaaatgactctagacaagctacttagccttcttaacttttccagatagcgcaggatcgcaggatcagagctaaggcattaagaggctggaccagagtcaagatgatgtcacaggatcaccttggcttgtggctgtgatggctacatttgattgtcatgcagattgcacttagattcaaccagattgatgaagtgagagcatggttatgagagtatttcagagaggattagccaaatctggggaagtacccagactgtggttcatgtaaaaggggggagaggcaggagagctccagccacatgctggtggttgcttctcccctttcctgagatgtcttctgctttgctgtgagctaccctccccatgaggggctgacacctcagaaacagtgagccacaatgaatcatcccttctattaagttattgttgtcagatacttggtcatagcaatgcaaaagccctcaatatggataactgatggatgttttcccaaggtgtcttttttttttcttggctctgactgacagtcgcatgtctgtgtctgtgtggtcctcaagacagtccgcacttgtgggggcagggccctagacgaagctccttgctcggtgaagtggagggctggtgctctacagcaagctgtcttcagaataagcatagtacaagaggaggatggttatcctggctaaaataaattattctgcttaatgtacacaagagatgggacatgaagagagcaaaggcattctctccagacaagtgtttactgctgagactgtctgattacagatgcataatgcctttcatagacacatttgtcctaggccccctcaccatgcagagggtgctgccatgatttttttgtcttaactcttgccatataggcagtgatctctggccatctcctctagagtcatttacttcttggttgctttgaaattgttttcattagaagctgcttcaaccctggaaggcacaactctaagttggtggctaaatacaggccctttctgcagctgtctctcaaaaggaaggcttgtcctcatatcagacagacagacagtcagacagacacacacacacacacacacacacacacacacacagagagagagagagacagagagagagacagagaaacacacagagagaaacacacacacacacagagagagagagagagagagagagagagagagagagagagagagatgcttatacatgctttttccatgtccccttatcctaccatctcttgataatggtctagctctagataattgctttctgcaatctaggacaagtcctttgacagtggccccaacagtgagcctgtgctcctcactggatacctaagaggaacagatacattgtctctgtccttttcctggacaggggcttgtctggagaagttattccctgacttctctgatggctgaccctaagaggatggatgacccttactgcaccgtaatctgccatggttttactcttcttcagcatttaaaggtgcatagcaggcagcaggtccatggcccaccttcagcaccttgtgtgtttactcacttaagaatcagcagaagttcatcactcaaggaagcacagagattgcaggcctttgtagatgcctttaggtagcttaggaagcctgctctggagccacgtctcccctgatggccatgctctatgttacataaggaatccttttgcagcaagtggttcttgtctgtaggcaaatgctccaggaagacacatgacgtttattgcactctgtcgtgtttccttaaggagacccgtgtgaagcagagttctatgcaaaatgttctgtcctttgcagggtatgaatgctgtgtgagcaataaaactgggagctggtgcagaatgagccaatgaagctagttttatggtcgggtttatgatacggatctccctgggagagcggtgtgtgcacagccactccttgtttcagaccattcgatgtacagggcagctgtgctagctgctcccttcctggcacccacccctgggcaccccctgatcccaagggtgcagtgtatgttctcccagaatgccttagcacaggccaacctaagatgtactttatccaccagtagttcagagctcttgctccctgaagcagatgatggcagctgtgtgagtagtgatgtggctgggttggacctgggcctaccccgggtatcttcgccatatcccgattatatgtgtatgctggtattctgaacacatccgggtgaatctcctccttctgcaggctgcagatgagaggtgttggaatgacagttccacacgtcagctgtgcagtagaaccaatccagagttccaaaagatcctcatggccaagccacggcccaaactactctgccactctccctgggcatgtgagtcagaacccactgaatgacttgatggttgtatgggtatgactgctgcacaggagagaaggcgagggatgaaacagggtaggaggaaaagaataaaatcagaaagcagagaagaaagcccagaactggccaggtaggcaggagtagggaggtacagccagcagctgcagggtggacccagaaagagtctccgattgcctctcctctgtccctgcctcaaatcccaggctgtctctggatgaagggcaggatccttggagaatcttccacatgcatttgaccttttgaaacttcacaagaagtatctcctagcagaggatccctattttagggtttacttgagttcttccaatgctgtttcctcttaaacaaacaaacaaacaaacaaacaaacaaacaaaccctgggtttatcatgaggatttagtagaagtatagaaggtgagactatgtcagaacttctgcaaatggcaatttaacaaccatagaattggaggaaactcacacttgtgtttcagtaaaaattcctcaactcttaacaggtgtttctatatactgtccccaaaggcagggattctgaaacactgacttagaagatcagggaaaaaaaggaaaataagtcccaatacacctgtcatttattcaggctctctgcctattccaacaccatcaagccttgagaccatttctaccagtaaggaccacagggcagtcagacctcggagctcaacactcagttttatgtggctgaaggagcttcattgcactctactgcttgttctgtgcttcttggcttctctttctaatggcatctgtcccacctcagcatgacaaggagggttatgtgagatggttagggacaggaaccaccaggtaaggtaattttgacaaggttccacctttcatttacaagtcaaactgagatgaactctaaatgtggcatcttctaaattagtaacctcacagaaggaggtgacagttttgcacttctgagtgtagaggcagaaatgagttgtctgctccctttccatcctcagtcttctgaaagccccaggttatcagctctgaagtacctaatgaaacatttctcagctcctatttgtgtctgaaggcatgaaaagtcccttggatagcaatgaatcaaagagactgttcattcacacatttccactggtctttaggagcccacagacccctgaataggtttactgcttattctttttgctatatctataataagaaaaaggttatatctgcccatagttatagctgaagctataggagttgagagtcaggaaccccatccctagtagggggtaaggaatattattaaagatccactcgcccagcattgtagcttcagtcctccctgctactcaggcagagttcccaccaaggatagcccccttgttggctggcagtgaaccactcctgttgctgtgatgggcctgggaaagtaggaaacaccatggagactaagcctggggtgcagtgggcggacagcccttgcctcctcctctctctgagaggaatcaatgaggccacagagcccctgtaggctcagagagctgaagccctttatttcctacttcacaaagggtagaagcattcctggtgcaatttttgcttaagagcaggaattcctagcaacaccaagagcttctcttgattagggtattttaacctctctcttccctgatcttgactggggtaccatgctgtgattgattcaaaaagcaactttaccaagtgatatttattgttatgctactaaaactcatttttcatagcctgtctaaggttccttaaatatctgctaggggtctttagtgaatttagaaagaagggaagaagaaaggggaatgtgcgtaaatgataatacagacttccatatgcttaccaaactgggacctggagccttttgtaaataaatgactaagattcatcctagcaccattttgacacatgccaagatgcagaaatctcagtgggaaagggtacaggaaagttaatgattagtcaaccaaggcatgagggaagcaatgagctctaacagctccttcatgcttcccctggtgtgctaaaaccatccgtgtggttcgctcatcttcacaaaagccctcaccaaggagccagctgctgtagtgtctcccaccctagaaatgagctagacttaacctgatgggaacctattgactttaaggactacttcttcgacccacccaaggatctctatggctattcacaagggaataaagacccgggacctatgctgatgcagttggggccttttcacacacacacacacacacacacacacacacacacacacacacacacacccgcccctgcttccctcctgcatcccatcctgtgcttctccaggcacaacacccgtgattagaactgacacagtctctccctctttccaggagaaaacacagcaggaatttctacttgttctaggcatatccggcaccaaagagctggagcaaacaagctgtgatcctggagggagccagactgccatctgaaagttgtatactctatagatctgataacctgggaatgctgggaaaccaccataccctgcgtggaacacactgcaaactctacttctacacccgtgccttgggaactcttgttcctagtctcttacccctatgtaagagcctttggtgggctctgatagactcccaagagtctgtcactctctcctgctctctgtgttaagggctggagaggaggcaaaacagccacagtcatccttgctgtggaatctctacacagagtttgccgaacaggctcaagaatagaagcagagaaaccaaaatattcttctgccatattttaatattattttaaaactgttggtgcttttccattttaattgaatcagatcccatgacttttgtgatccccagatcctccataaattctctgcaactggctgcctccacccttccctcctaaagccccctcctctccctgcctgggaacctgccctttaaatttgacatggctgggattttaatcgctcctcaaaggcacagtgacaatttcacaacaaagcgggggctgggggtgagttttgttttctgctctgattaagagagcaactgttctcgctttgtcccccagggccaactcttggcaccagactggggagatctcgaacttagtgttgcgacatccatcagacgcagcgagtctggggcccacaaaggtgaaccgcagctgtttgaataaaactctaaaatcttgtttagaagattctcagcccttcttttatagtcttttctttctggggcaggaaccaggaagcattactttcccaggatctcaggcaggtaattgttttcccaaactagattttaatctgatggaaatggacattctttctttactataagaaccttgcccacgccaatcaactgtttgtttccaccttgtacactgaagacttgactgcagaatgccccccctcctcccaggcacatttccaactccggttagaatttagcatcattttcatttctcaacagcacttatagacctttggtcttttggcatcatggagcatcttcctgtcttgtagctggccatgagcaggtagtggcccatcctctgaggatgacgattggcagtgattcttattcattttgtgtgtgtgtgtgtgtgtgtgtgtgtgtgtgtgtgtgtgtgtgtgtatgcatgtttagcctgcatgtatgttcgttcatgcctggtgccccagaggctggaacccctgggattggagttaaaaatggttctgagctgtcatagttgtgctgggagctaaacaaaggtccagtgcaagtgctgctaaccactgagccatctttccttccagccctctcagttccagtttcatgcaaagcagtgctactagagctagggtcagacactatgtcctggcaggtcaaacaagctagggttagttagttgccctcaaaaatcaatggtttaaaaaaagtgtttttcattattcttcatattgagaagggaaacaagaaatatggtgaccccttaagtctatcatctggttgtaacattctcattgtctatataaactttaaatagaaggcaagaaatatgaataatgaactagttctggtcagtgtggtcccacccatcattgacccatccttgtctgtcctctctagtgtttcctacaaggtggtctgataagttgccagcctcatataaaagcctttcctctttacagatcggcctctgcctggcaccaggtttcagacttttccaacacattcccggggcaggggttggtgggaattccaatcccctaagatgcctgaatgtttctttagaatggcctcattccttccaggcatagcagtcatagtagcttgaactgtgccttcttaatagtctctcccacgagctgggtggctcctggtctctgattggttcatcacaagggatcttgctcagctgttctgtcactagagctatgcatttagggaagtgactgatgaccaagtgtcatttcctgttgtgcgtagcttacagtcccatgctggctgtcttgatgatgctcttcttggtaaaagctatggttaagttggttcctcaacttgaaaatgagagtatacaggaaatacattcccaatgatggtgtggaagctaacagggccctgactctgcctccctgaaagaccttgtaggagacttatctctttagccaaaggctttgtgttttaaagattccttctgttgttttcattttgtagagttgaatcacacaaactgcacaaaggcatggttgtagagttagcccttcccctggtcctaggaaagtcatgtttgagacattctgccaaaggggacccagcaacttaagatgaatatagctgtttgtgtgcacatagtcagacactgtctcacttattgactaacgtgttcacatgttgttttagtcttcattctgtcagccatcaactagtaaaggttttataagcacacactgatgatgcactggaggctgccaagcaggtgatcatctcatcttgagcctacagcataaagttgtcatttcctagggctgcccacatgcattggattcctgcacttctttcttcttgccctggtatccaaaatgggtggagaaaacatgagagacatactgtttctcaaaccaggtctcatgttatagaaaatacttgactagtctacaaatgaatttattccatgagttctcaaatgctaatttccatgctgcccctgttctctgccctcataaaatcctaacctgacagtggcccatgcagatgcatggagcagagtatgagttaagatgtttcgttgatttagctctgcttgaaaatgccgtccatctttcccattatctcaggtcaaatctcctctgctggcatagggttgtgattgcagaaaagttgttctgagaagagccaacacttcagaaagcttgccaacagaagttgtctgactgaaggctgctgtggctcttgattttaagatttatttgaatacatatgaaggttttgcatgcatgcagtatacttactgcatttccccccaaagagtcattcactggactccagtcagcattgtgcattggccactgacaagttaggacttaatgagggtagggatcagaggtaggatgcaaattagcatttgagaactcatgggctgtattcatttgcagtaagtgttctgtgtgcacgcctggtgcctgtggaagccaggaggtgtcaccaggtccctggaaccagaggtacagaaggttgtaaactagcatatgggtatcaggaactcagcctgggttctctgaaagaacatcaagttcttttaactgctgagccatctttccagccctaaggctgctgtgactctttagaggatgtctaaagagatcatcccctgggatcttaatagctttactacctgatgtagaaggggttctaatttgaattttggataccagggtagtgggagaaagacacagcagtagttagttagaaatcctgagcttgaatctcatacccactcaataccagctgcctggaccaggccacttaccaagtttcctgcatctgggcttcctcatcttaggattgctgcttctgttcatgagtgaaacatgccttggcctggttgcttggcctggaggcatgccatgctgcattttacatactttgaatatgacttttggaaataatgtacataaaggagattgtagatgaaacaatataccattagacatttgattaactgagctccaggtcggtccaagtatagctcctatgtatatatttatcaactaacaaagttgtcaagtatgcttatatgttcaaagctcagcataggatagacattgccatagtatctctcatcactactgatatttggcacactgagcctctgcagaaggatctatatctggcccttacaaaatgactaaaataccacacattgtggccttgtaaggaaggtagtatttaaggaagggaacttcttgcaaaatatcagtgtcacaacatgtatccctcaaccagataagggttagtcggttgatctcttaggtaaaaatggcagacagcagtgttttaaagggtttgttgtatggttcttagaggaatctcatgaaaaccagtatgggggtacagataacagaggtgcatttgcactgagggaggactgctgctcctctttgggctgctcaggatgaaagcatgaatgtgcccattctttagttgagtctcagaaaagaaaaacctggggatatgaaatgccaggaaacctaacttcatgcagaatggagggggtaaaaagcaaccagagacctctgtgcatgtgcctactggaagtgccccttctgtttctcaatgagtagttactcagcttcagggcctcagcttggtcccttagcatttaataaataattgctgacctaagctgtaagggcctgatttctacctacaaaatgacatatgactcatctatctcttctaggcctcaaagtattatctataaaatggggatcaaaataatctctatttcatagatttatataggaattacatgattatatataaataaatgtctatatatatgtatgttcatatatagtattgataaacacatagtatatcttttgagaatgaaaatagcatacctcaatcccagaaagattcataagcataagatgtttagcctcatattgcttgagaatttatgaattaccccaaaacaaataaaagattcttttatccaggaggaaaagcccttttatgataaaatcccatgtttatttcttctctttaaaaagaacttccagccaattttaatttcagttggtattctatagtgaatagttctttatgctcactggtcagatatatgccggatgagaaaaagactgggtgcaaataagaaagaagtcttatatgattatgagaacttttaggaatagaattgggtttataacaatatgagaataaatgactctgtgatcagataccaactctaaagttagttcacatggggataaagttgtcattcctcacttgtgtggggtagaaatgtacctttctcttccactttgtttgcctaaatctatttagagcaagcaaaacaggagagcaactgcacgggtcctaaaaagcacttcctctgcccactttctgtgctctactctgggtctcgtgactctaacttctaaaacatgtcatttatttttattttagttcaagtgtccccttcaaaagcaccaggggaaaacatgcttagccccgctgagaaaacaaacgcgtttaaacaaataacatccaagatgtccaggtagagttggtgtttactgacgagactgtattttagcagtgagctcaggaaattacagcctgaaacatattttttcccttcatcttcacaatttcagtctctttctggaataaaacaaagaagttagcagatcatagctcttttattggagcctttagttgttctcagtggttactccaaagcaggcaatgtaatgccactgtcattggcttcattttgaatcgctgttcacagacaccctatgcagagtcagtggaaatgcagatagcagttttatagtatatcctatttccttctgtgaataacacattcacccaccatggagcatcacctaccctggcccagtagtaactgtggcaattaaccaatcactctgatagtcaggtctatgggaaaagaaagagaaaatggtcccaggatcctcctcacctggggatttagtctctacccaccacctcctgcaaagctacctgctgttcttgggatgtgctagagaatatataagaagtacaaggttgacttaaaaggggaactccttgatgggatgagactttaaggtggtgtagctgttttcgggtcatgcatgctcctgtaagtaacccttcagccatgatctgtaaatgtagccccaggaagctcactggctggccaggctggatgggttgagcactgtggttggtgccctacttggggtgatcagatgtttgtttatatctccccaggaaaagtgcatgcagcctagtgcagggaggcaaaagtcagcagaggaaggaaatgagccccaactagagacctgctagcacacactcgctccacataggtgctttcctgctctcgaggcctttttaggtcaaatctggtcattttaagctaattggatctttggatctttgattccccaaagatccacgatgggaaactagactttgattaaaaagcaagacctcatgagtttttccagccaagtctacattattcttgctcagtaaatggctggcatagggacgctcatccaatgagtagatgctgaaaggatgagggaggtgattgcctacaagctgctctaccttctctagacctgcaccctgggaagcctcccctcactgggatgttgctacttggggctttggtaagccccatatgcctgtactttgggagtcaacttgaataatctgcaccttctatttattattaaaccaggcatatatcaagcattccatccctaacaaatatgtttttatttactatgagtgaagcgtgtttgccatacagaactcacaagctttcttctgaagagcttttcaggtgtactttgtgtggtaagactatttgtaggtccacttaactagatccttagaaatattatcaattggctgcttactgtcacttacatctctcctcatcttctacttataagtactctgttgagtcgggtgttggtggcacactcctttaatctcagcactttggaggcagaggcaggtggatttcttagttcgagaccagcctggtctacagagtgagttccaggacagccagggctacacagagaaaccctatcttgaaccccccccccccaaaaaagtactctgtccttgcaaaacaattggtcactaagcattttcattacacagttatcagttctcctaacctttctgcctctagaagtaaattgccctcattcatactttgctagttgaattgaagtgtaggcacgtgggctgtatctattggctatgcacgtcttttcatttcctaaaatgttaaaaggtcagataatagaagtaaagatttgggatctcttctttttgaccagtatgctggttagttttggggctgcatatggtagatcagccaggattatacatagaaaccctgtctttgaaaaaaaaaaattaggtaactctaatactacctttgtggtgatcattgttgtctatatcttaaggaaaatggacatggaatagagttttacttacattcaatttaggaaacaagaccaagtggcttctgacagaccaattagaagctctcatgggatgagtcaattagagaatgactgctagtagacgttgtctacctgcccatagacctgaggagtgtccctgttagatgaagagtcagggactggagtcacacctgtgcatccaatgttgttagaataaaaagcagctttgattgaagatacttaattctccagaataaagactaatacactgagtgccgaatatgcagggcttaggtagctgttgctcagctgttcagtggtactggcccatttggctttgattccgggaaagaacatgcagtcaccactggtcagtagtgtgtatcttcagattatccctcatctttctcaacatgtagaccacctcaaagctctggcattccaggaagacttgggacttaactaaagaaaagagaagctttagaaatacacactgcagaagcaagctttaccaataaattgaacaggcttaattttcctcccattggaaacaggtcagaagctatagtgcattagaaaatgcataacaaagcaccttacagatttggggctcttgatgttaggtatgggttactataagcctgatatgagctcctggacagatttagcatctccaatagaattgcagccagtggcatcagtgatctgtaaccatgccatgccagcttgtggagtggggaatcagacctagtgttaaaagagaatcaactgtccttggcttgagagaatttaaatgttcttggcaatgaagtggggacaaggacacatgggagtccttgaaaagttttggatagtccctgctactctagcagagccacccagccatcccatccaggtgagaacaatactgttgccaaagactccagagaaggaactctgataccccattggcttctaccttgatagatgttttttgggagtgagacttaacctgcgaaaagaagattaagcatttaagatagataggtatggaaacagagaccaggaagtgggaggaaagtagagatggagcccacaaagatgcctggaattcagactccagagacaagcattagagtgcagatctaactttattgtttattacttaagcttatatatagctttttaaccagttaggatgtgtttgtgtattcaaggacaaactggggtgctgcctgtgttgtttcaccaaatctgactcacctgtccatgagcctgtccgtgagtctgtccatgagtctgtctatgagcctgggaacaattccccagggagatatctatgaagccaggggaaacagctaccactctgtccttggatcatttgttttgtgtctcaggagccatgtcagatcatacattgtaaacggtagatcaggactcttcaaggagtcacagtagtttgtggtgccttactctctgtaccacttcttccttctccaggatctccacatcccccacagataagtaggcaggtaggtagatggatggataacaaagagatagatagatagatagatagatagatagatagatagatagatagatagatggatgtaaatgaattagacagtaatgaacaaagggatgatggaagggagagagtcaatgcccgtgagaaccagctgaacaccttccaatgtgacatatttattgtggcagtgtataccagggaagcctctaaacgccactcaaagcagatgctacctccatccattcccctcatacccagtctccacagtccattgtggtaacagctcgtcatggtgccatattcagatctgtagctgtgggtgccccagctcaagtgtgagaagacaagggttccatcttatccttctgtgtagtagcaacactaggctgaacagtatttgtctcaacactgtgtagcatttggtagacattccctagcaggaggaacagaagaaaagaaggtcagagagaagaaagcaataaactcataaaagatagcactggcatgttgtgtactactaataataccttccatggcctagggctattatgtggccccaagttgctgcagtgaactgcaggatacccactgaatcactttcactagtgagtctatttaaacaccttcatttgccagggcttcctgattatcagggcatgaattactatcccaccctctccgagattctggtcactcaccccagccagaataacatccatactgcatccccaaatgcagaccctctttgcttttaaagattatcaagttcctccctttcacatgaaatcctttcctcaacttcagcaggctctttctcctcttgatgtccttcttttcctgattaacaatctttgtctgggaccctgaacatctataaagtcatgaggactttcagtgttcatggctctctgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaatgtcatgttggactgttctagactagacatgtctagtagtgtctgttctcaacattgtcacgtagcatgtttgtcatttggatgttcccttgagctaaaatattttatattttcctcctctagataataaggcctttgaggacagactcttgactaatccttcttgtcattctctccatatctgggccattgtcattcaataaatactttttgaacaggtaaacctaagtgtctgggctcttaacttaaacatgcaggacttgaccctgagtgggtgacaagaacgcaaagaaaggacagacatacatacagaaaggctggatccagtgggatgtgtgcccttatggagacatctaacaacagcttagaaaacaggtgactttattttaaaaatctccatcaaagagatgaggttaaatatacaactgaacagggaggcaggttagctattctctgtagaatggcaattttagcctgtaaacatctggaggaagaaggtgagctggatattttcttcatgtgttgctaacaatctgtacatggaccagggaaaggctttgccattcccttggatctgaggctttaaagtccttggcatggctgtgtttatgttaaacaatatacattcacttgggacatccatcctctatcccccaaacccctttgtcttgatccaagggaatgaattctcccctgagtctttctcatgtgcagcacaggagagagctaggatctcgacacctcactgacatgaatattgaatgtggatcaggccaatagggataggtactggtgagggtattgttggaaagatgaaaagagaaggtcctttgcctggaaggtaggacagtcttctgtgaggagcctgggacacaaagcaatctggcaatgaactcagagccaaagacatgaaaggggagtgattcaagcccatggagaaatacagaaacccacagagttgtaccacgtggtgttcatctgaaccgaataccctaccgatggtgtcctgcctcagggttggaatctcccccacagaagagttatgggttacccatctttgtgtcctcaggttcccccatagttcctgatgatggtcctctaactggaaccaaattactggaagcaggtcctgcagcatctcttggcaatctagccaatggtctgccaaggtgttgattaccttgaacatcataaagttgcttcctttgatccaacaattctgttttgacacagttaaagtccacttctctgcaaaggttttcaaatgcacagggtgacttttcagccatcaagaggaaggaatgctacatatacagcctggatctaataaagccagatttttcaaaaacagctcttagcatcttctaccacagacactagtctgggcagagctttttattttattgaatccagctgaatagcttgactgcattaataatggagcttcgtttccaaccgctgcctcccagtctttttccccctaaaagccttatggttagcttaagcaactgctaatatatgaatgattgctggtggcatcatttcctgccatggtttgaccaccaggatgagggttttgctctattttttgttttcctggttcgtaatctgaagttctatatgtgtggctgactgatcatttttaaagtatagtaacagctctaactgcagtcagtttctttactattaagctattaaggatttggaaagattgtgttagcagcatatcatttgcctgaaaagagattctctaatgactggcccagatcatagtggtgcttctgatgagaacggataggtagcactaactccggatttccaggctagacaatcagatttttcaaaaacctcatacatttaaaagaaacttccattcatttggctctcatgatggcatacttcgtgaggatgccctggaaatctttctcgcccttggttttcttatcgttggacctgagtttgagtgacgatggcttttgtatttgtaactttgacaaggtgtttgtgtagaaagcagggtcttgtttgctgccataaataaaagcgtaaaacacaccctgtaaaccttagcatagcaaggctgcgacaagtacatgctgggccagagttcctacgtctgatgctagctggccactgtcttctttatgacttctgataaattacacaatggacctcagtttcctgctgtgcagaatggaaataattacagtacctattttgttgggtcgggataaagcttgatggataattatgaaatgtttgcatgcagtactacctaaaggattcttattggctgagtttgttatttgactgaatgcacttagcttctgctgggattaaaaagtagagtttatctattggatagcaggcaaccagacttaacagagggcgaaaacttcactaagaccttgcatattattcccttctggcaaaaatcaagtattattctcctgaatctgaagcttgaaagtttatcctaatctgacttggccattactgtgagtctacagaggagtaaagaatagaatcactatgctaccacacaacaacaaaattcctttgcaaccaaacatgactcattatgtagcaacaaaactggagatcagatgggataaagcaatgggggttgatggaagaagttagatgtttgggacagtgcgaatggtgggtaaggatggtctcaccagtgtttctcaggtggaataggctgcccacactggggagatggagcaagagttaggttatgaggcaccaagaaggtgaagacagagagattagtgaacgcactggggtgatgctgaagtccctttccatgtcctcattaaagaaaaagtggacatgttattctgttattcactggacacaaactgcagaattaacttagtagtgttagaagacaaggagagaggggacagatagcgatggtcttcacaaagcaggcaaatgaggtaggatctggttcaatagaaaatgggaagtgagaaagaggcaagaaacactctctagagtgcttggcagctgtgtcttcacatgtcttcctacaacagcttgtccccaaacttgggcctgatatcatctatagtaaacaatgaaaaagaacaagttgggaaatacaatcacagaaatacacctggactaccaaaggttccaatggatcccagggatgagggagtattcattggtgggttgtataccatatgtggttgtataccaagcctacccccattagagctacatttgtacatacagaaatagacagcacttaatttttatgttcatggatccatatcctgttagatttggaggcattttctcagtgtgtccaatggctacgaaaactaaatgtttttcttatttcctgacgtttgggtgatgtcctttgcttcctcttctggaaactttccaagatctgagtgtagagctggcagcccccaggcagctcctttctgtcattgctccctcctgttaagtgaagggaaataaacagtgtgtgggaaggggaatctgtgttctaagaatggctctggtttacacatctacactcaaccagtactgcgggtcacatgtagcagccaatgaaacagcgtgagtcacttttcagttatccatagagaaagatggttctgaaacccagcgttattggctgacacatggagtcccccatgccagctgtgtgcatgacatttcatgtagggagaaaggacctctgtgctgagcaatggcacaatgtgtgggctccatctgcaagaccagctcacctcttcctcagtgacggtgggtgctagggacaaacatgttatttagccagacctttgtgattggcactagagctttcgatgaaaacctgtaatagcattccagtaagccttccgtacctaaaccatggccagagtgtcagctgagcatgagatcaggttgctggaggggcagagaacgagctcttggagcatctaggagcagggctttgcttaagcctaagaagccttaccttaaaacaaagagaaaagaaaactattttaggaccagtgggtgtggctctgtatgactgtaatccccacactcaggagtccgaagtagaagaatgtggagttcaagaccatcaagatcccaggaaagatggaaaagtaaccagctaaacaacaagaaaccataactgtcaaggcagcaactgcattccatctgtcggacacctaaaaatgtgacagaaaatacagccgcatatgtagactgcaagagaaccccccggcaagccagaggcagtgctcatgagagggatttcacccaatgcaaatgaacagagagcaatcgatgtgactgaaaataaccgttatgctctgaactggggaggatgggaggcagggaggtgacctttgcaagggttgaaagttgtaaacttttcaaccacattgttttggttgctgggtgaaaggatcaccctgggtaccattttggaaaactgactttttaacaaaactactgcctgcatgggatttggtgacatattccgtgtgggttttgctgcaaagacacacaattcagatgtctatgaatcagctcagtctttgagaaggggccaatggcaaggagtctaaaggtacctggctctccctctgcagaagtttagtgctgacaagaggatatcaagaagtgtgtctactagacccagaataccctcgctgtaccccaaggctgtacatatgaccaaagtttcctcccagccctaccctctcctggtgatagaacacaaggacagtggcatcctaccaaaagagacaaatgcaggtacaggggtgtgatcagtccattttctcctcatcccagtagctaccctgggccagccatttcctgaagggattctctgaaatctgggaaacaggaaatgctcagaaaacttcttatgtgcctggtcatgtgagctctgatttcagtgttgcaacaggcttttgggagagctctcagggttgtggttgggtcttcctaggcagacagccctcactcctgggagagcagggcccatctgacgactcagcctcaacttccctctttctaaacatgtaaaccctgatgctcagaccagaaaagacagccagcatctcagttcggtggttgggtgccagtgaggcttctctgcacacgtcctcactaccttttcttatatgctgtttgcttagatgatgaatgatagctgcctcctaccttttccaccccacccctaaacacactgagaatctccactcataagtacttagatgcaaataattttaggacacaatggctttgagagatttgtctcttttctctctctccctccctccctcctttactcccttcctttcttcctctccccacaaaaccccacctccttgagacaaatccgagtggaaatgcctgcaagcggcaagaatctgtgtgcttctgcacacttggatgctggtacctggagtctagtggttggatgttgttttctgacaagtcagtctctgtcatggtctcatcttgaaactagagaggaagggaatggaaggctgaattgctaatatcagaagttctggaaattccccttttatggtacacgagtctttaagaatagctctctttcagttgtgttttcgtgatttaggtgacaagccttatgcccaaccctccttctagtgtaccctatttacatctaaacatttctggctgtctttgggatgctggctagaaatggggtggggcggaggaagagatagcttgaattgtattttttaggagaaaaaacacagggaagaatttttttctttatttttctttattttgttgtcttattgttttaaaaaacataacctggacaccaatctctactcccatgattttcaataattaagttgtttataagtattttccatacgctgataaatctcacatgaattaacagcctaccttgacttaagtgtgcagacagaaaggaacttctatgaatttctactgatattttacgtgttattatatatgatcagttccagtgacagatggcttcggtgatgctctccaggtcaataaatgagagattgttttaaaaaaaaggcttcctcactacactaggttagaacgggccatattgaggatggacacaggtctggaatgacagtggggatctgggagactggctgggtccagtggactcactggtaagtaagcaaggcctgccctgcttgggcagtgccagtggagaaaggacctctggagaaggcagatcatactgctcccagcctggctggctgcatgggcaggctgcctgtggtctccttataggctgatgtttggaaggtaggagagcatgtgacagccagtctccagcctgtacacttagagagagtatgctaattagcatggtcactgcttgggttaggtagaccaggtaaactgtatcaggttctttctgagttggcagcagagacgggactaactgctttcattatggggttgttccgggcagtttcttattaactgtactccaggcatcaggttagtgaagaaaaataccccctttatggacactccccctccttccaactatctcctccctgctccaacatccttatagtctacccttcagcctgggaaactcctacctggagactgacccagaacaagtgtggcctccaggcccctggggggtagcctgtttcctacccagttggagctttccaaggttctaggccaggggagtgtagagctggacaaagattttcataaaaaaatgttttgacttttgagtttcttttttccttctgcaagaagccctgtaaatgtttgcttttgttctaattttggctaaagagaagaaaagagagagagagaaaaaaaaaagaatgtttgggtacagcgtaaaagttctctcatgtccagactggaaactccctagttgttctgaaaccggacaggctgagagtatttgtttctctgtcaacaaacagtgcgtgcctggtctagacttcacctcagcaggtagtaggagtgtgcctaggcctgtgtcagggtttcaggagggctacaaggcccaagtttagaaacaaagccttcctcccaccctgcgtttttgatcttctaatgtgggccacactgtgttcccttcgtggtatttggatagcatatgacataaacacaggtgtggcctctatccatgcactaaggtacaatacaattcgagttagtgagacaagataaagccagctggagtttaaggttgaagctgaaaacagccaatgctgattttcactgaaaatcgtatcaagagaaggaaggcataggtgtccctccaggggatcctgttcaatatcctatggtgtagttctgtgtgcaaagggctcgcatgaagtaaaccattgtttgcagttcagagaaatcctactgtcaaattctgtaaggactgtgtgcaggcctcccaggagcatgcccctggtctctggctaggtagaagcagaatagggtgacttcccttagattaaggtactgtgacagattggccctgattttgacaatggctgctatgtcacttctttagggcttagagtcctgagaactgaccatattccatcattttcttgccttctgctgctcagcctggaaacctaaccccaaatggtactttaattcctcaggggaaaaatatttgtcaaacccacaattaacttaattgtttatttgtgcggaggctttcttgttcagtgccaagacatgaaggagggtggctccagatttgtgttcatattctggctcttactcactgcacgtccgctcagcagacacaaaatggagaagggagggcagaaatggaaggcaggttctgtccactgtaggctgcttttggcgagcatttcttcctggacctgtgcttgtctgggaggtcagactctgagtgttgagtccttttagtagttatgggattcactaggctgtagcttctaggcagaacaggctatggctctcaaacctagacgtgggaagagattcttgggtttctttcgacactcatgtttttgtctgtgcgaacatcaacaggatgtacatgtagatgccagctcgtggaattgttgtagtgcccaagcaaaggtatagatatatacctttaaaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgggatggtcccgtctctgactccccaatgctggcattaccaactctggcattataagcctgtaccaccgtgccctagcttttgaaaatatgaattttaaggagcaaactcagatcatcatgctaaaatggggagcattttactaactgaatcttccccagccctggggacatttttagttgccatccatagacaagagtttgtattagcatttgaagccaagaatacagctaaacatgcaggaatgcccaagcccttcctctcccccattgaagagccttttgactcaaactatcactgttgcaagtcctaagcctagcagtatcactgggctgatatacatacgaaaggaaatttgcaattttcctttggggccttctgcagacacttgatgctgcttctctgaggctggagaagccttgctgtcaactcttgctctattcacctctttctggtgccttctcagctttgttggtggagcttgcttctcaacagacctcgtgggtattaactgagtccttcaagacttgagaaatgtcttcaaacaataaagagaagagtcccagtccagtccaacccttgctttgattgtcccagttctcaatggctggacaatgagcctgaaatatggaagatatacctctgacctgccaagagaacaaggctggggatcccagaagggataaggagtgacaagcattctaggatgacaggggatcaaggtgaccccaagctcagggcaaaagctataatggcttgcaatttccatagtgctcagcatctggctaaatagggcatctctcttctaagcctccagctctcagaataggtagctgaacttcttggtccccttgttgccattgcccattattgctcttttcacttcacaccaaaaggggggaacagagagcagcaggctagtctcaagcataccaaccaccttttagccattgcctccactgaccctagcagactaaccccagataacttcctttcctacctaactcaccatcactcagtgcacagaatgcttatgtgaaaatttttttgactcttcgagagccctaatatgatgcacctatcatatggcttctcaactttgtgagacactggctgtccctgaagccaaagttatactgtctcctagtctagtacctttctctaagtatttaatttactgttgtttttgatagaggaaccacagtgccttttggctcctgtctagtctgcaaactcccttgacaatcttaccctgagcccgtatatctttgtacactctacaaagttatccctttgtagagtatactgagggtcaaagatgtcttgtggattgaccaaggtaaatctgtgctatggtgactttggaactcagttcaccctcccaggcctaaagtcccagacagtgttgagcctcttttaaaatgtgtaacatatatatcttccttgagcacaacacatttgttatggacctgtttgagtagttttagtttgtattctttttgccattgtgtaaacacacagcttttccaatgtacccagcactgttagatcccagcaaaacagacagatgaaatgcaaatccttccctagaacaggatacaggcaggcagtaatgcacataaccccttaaaacagagtggaggcacagtgagtaaacatcactactcagttgatggagagcagggacttgaaccagaaagacgtcctagaggaagtagcctttgaactgagtccagagtgggtacaaagggaaaggctggccttcagctaaaggtcatggcttcagtagatgcagtcataaggagtgtaaggcacacattgggactgcgtgtatggagtgtaaggtacacagtggaactgagtgtagtcacactcctgtaatcccacactggggaagctgagacagaaggattgctacaggttggagggcagccttaacttggtgtagtgaggtaacaccttcctcaggactgggaacaggctggccaggtaataatactccgttatttcttcatttgattccctccccttcgataactgtaccttcagccaagaatgcaagaggcaagtatgccctaggaacaccaagttcagaatcaagtctgactggttctcacctcattctctccatctacctctttcttcttctctccccctcccttcttccctccttctcccccagacccaaatttctcccaatgtggaaaaggaaggtcacagagtcaaaggccaagtaaaatagtttctcaactgagaggaagcaaacaggccgtggatatttgtgctccatttgggcaagttgatgaaataacctttcattttagaattttctaaaaacaggaatgtttttatatttttgagcacctcaaattgggcaaacaaggtgttgccaggggacagctctactaggtgagtgatgaccacatcaaaaccctggttgggcgaggtgtacagattctgtgctctaaacagtcacactggtttggtgtcaaatgcagattctaagcattcaaaccttattttctcttagataaacaaacaagttgatatctatttatagctattggtgatgggaaggaggtggcatcatgtgcaagcaatgcaaactaattggaacatgaaggtgaggtttgcaggttggccgcaagcagagcccgttctgatcacagtcctagagtcccctacccaaacccttgcttgaagttctgaattagtagttttctgattgtcatccaggctgttcttccaacttctatacatttcatacacaagttaacacccatattggctgcttcctgtgagaagaaaccctgccttgacatcagccagtgagtccgtttagccatacccccctgaaagcctccagctaacagaaagccagtgtgtagtgggcatttggttacaacttgcttgtgtttgaacatttatatttataatagtgctaatctccaagggacttaaatcacattaagaactttatctggggctgccaaggaaattagcaggatccacatgactaggatctatgagaaattggggttggactgacagaaatgtaataagtaccaactttcatctcaattatcttttccatgagaatttgtttaatacctaaatgtcaggctgggccactagcatcccctgtgcatacaagtacccctgcctctgcacacaacttccctgtgcacacaagtacccctgcctctgcacacaacttccctgtggacacaagtacccctgtccctgcacttgtatggcaggatgttcttccttcccctgcccttctgacctcacacgcactagtctatcaccagacggagaatacttgtgtttccccttatgtccacccccggggatcggtctgtataacacgcccattagatgctgctggcctgagcattagtcagtggagaccagatggtgtgggaaagtggaggtgagagtaacttagggccacatataccccgtcaagatgaggatgggagttttggggggaaatctagacagtttaatttgactaatctgtgtggctaatttatagaaaatgcacaggcatggggaaaagctgtcttggcaatggaagagatgaaagtggcggggagtgcccccgtgtcgccctgcagaagaggaaaccaagatgactgaaggagtaatttatggaaactgcgcagagacctcagtgtagtcaggatgagcagcagcctgtttgcatactcagcgaaccctgagtgttgtcaaactgaggacaggaattacccagggcctgctggggagcccagcccagccctcccctcccctccccagcctggtaactcttctaaagcactgcatttccagttgcattctttccgtcttttgtttgtttgcttgcttgcttttaatcacactcactcacttgtgtgcactggggtagaggtgtcgcttaccttgaatcccaaggatcaaactcaggttaccagatttgacaacaagcacacttatctcttgagtcaccttgctgacccagattcaactttgttttggaattttacttaacctatctcttcagcctcacacagagacagtgggtgagtgagggtccagcagctccctagaaggccgaacaggagtttggttccagaattcatggcagccttgggagagggggcaaagagcaggcaggaaggcatagtagtgatgttttgacaggcaagggaggatcctaattccagaaacgagtatgggaagaaagaaaaatgctaagaggtaaaatggcgaagcaagagaaataataataataataataataataataaaagaggtgaacattgaaataaaagaggaaaatgaccccattgcccagtgggcagaaaactcagttttctttcactttgtgccttacggggtgcgtagcctttctttgaattttcttcctcgtttaatttttcccttcacaaaaagtgcaggaagacaagaacacaggactttgtgagagaaactcttgatgtaggtcctgtgcacaactaagagcagagttcggatttccccttctttcccttttaggttgccccaagtaaacgggctgactgtatctgtgtacaggaaatctctctccctgaaactgaagtcctgatgtcaagggggccctttgcacagacagccatgcaagcagcccttgggctagattccaaagagaaactagatagaaagctggaacttggaattgccagtcccattcccctcccccttcactgttcacccatgccaggtcaagatcctgtgatttttcatgcctgaatgaaaaactggagatctcatcaagaaaaggcttttaagagaaggctgggttattaatatgctgttgtttagatgctcactgttaacatataaatgatgccagctcctttccacatgggtggaggtggcagatgactggataatgggcacaggcagaaacaagagtaaattctgcaatgtcatcccacatttaggatataaatgagttttctttttcttgcaatttaaacttatcaaatagacagagatgttacaactaagcaggtaacctctgtattcaagttattcacaatactttggctccaaacaagcccatttatctagatattatattgagggggaccctgttatagaatgacttatgggacacagagattatgtcaagactatgagttcagttctgggtctactattagcatgtatctttgggaaagacatattcttgttcatctgtgaaaataggcaaaaccatagtggtagcttcctactgaattgttggctgttactctggcttatagatctgaccatactttatcaaccacaacatggcatttatctatttctagttataataaatacttttataacaaagtaaaagagaagattatctgtcccacctctggcatctgttcacttttatttaatggtcattttggaatcctaagttctaggcaataggtctgcaacttgggagctcagttgccacttagtaggatagtattgccacttagtaggatagcatgattgcattgctgtggggttttctcttgtccagtgccaaatgcaaatttgggagcagggaaagccagcaagccatataaggtggtgcacaccattagtcccggcactggagatgcagaatcaggcagagctttgtgaatatgaaaccattttggtctacagagtgagttccaggccagtcggggttttgtagtgggaccatatctaagagagggggcagggggagagtctaagagccagaaagattaaagaacaagctaatttctaaaataacaagtcctttcttatattcttatttcatttatatggtgctggtaatttttaaaatttggtttttctctgagtatttcatactaaaactgataccatttctcatcctttgtagttgtatttcttttttctttccatttactatgactttcatatcacagacacctttttcctggaatgttaaatgtatacatcatccagctaaagggaaaaaaaaatctagtcttgataaagctagaaagagggtgtgtgaatgatccttgttttggttccaaactaggggagcctggtttgctgctctacccacttgccaaggttgatgtaatggatcccaaagagttttgagttattgaaaatggaacaacaacaacaagagaaaagacagttccataatcttttgaagcctaaaagagcaacttgtttcactctctgtcatgtctaagaagagacaggcagacatgggaaggctcatggagaaaacatgtaaggtttcaacagaacacagtgttctactgaatgtaagaaccgccttcaggccaaagccaaaaaggaccctgtaagtatcttgataatatctagttctactgtgtgaagaacgggaagaatccagacagcatctctagtagatggagtgacttgccaccaaaagttagcagcactgagcttataagtaggcttgcctgacacgtaggacacatcacaggaactaaaggctcttctagtttttcatgaactcatcttctcagtgttgttgaaatatggctttcattccatttgaaccggaatcttatatagctattgtgtaggttcttatacacaaatagctaggggggacttggacaaccctgccagggattctaatgtctgttcctgaaggtacatcatcaggatatttataggagctgagaaagcagtggtctccagtcagaccaatggcttgtgcttatctggagcacaggattgctggggacatcaggttggcacatacagtcatctacccaggatagttgaaagaactgccaagcctggacagcacagtgaagagtcatgctttgaaaggcagtgtggtggctcaaacctataatcgtagtggtcagaaggctgagacaggaggactgctgccaggccaggaacacatagctgaatcctgtttcacaaaagaaaaaaaaaaaacctacttgattaatcaaaagttgaaaaataatgctttttttgcagacattaaaactttgggtttcttgttttcttagcaaaaaagcactaaaacacaatgacagtgatttttttttaatttagagtaacttttagaaaaataattaccttttccaaatgacatgccaagttagtgaaacatacttggttaaacctgtcatcatcaactatgggcttatgtctcaagggggtgtgtgaaactatcactccgaaccctcctattccacacacacacacatgcacacatatgcacacacacacatgcacatacatgtacacacacatgcacacacatatcctcacacaaacatatacatgcacacacatacgcacatacacatgcacacacatatgcacatacacatgcatacacatatgctcacacaaacacacatgcacatacatatgcacacacatatgcactcatacatgcaggaacccatgcacacacacatgcacatacccacacacactaatgtacacacatctgtttcccaggtgtttcaggagattgggattactgcccaggacatttaaatgatcctgcaggttcaaacggatatgaaaagcacatgaaattgtaagacttacagttttaagaatgtttcaggaatgaaaacacaccaagaaaacatgagacttagcccattttgttactctcctttatccaacaaaatccctctcagttaattacagtaccaatatttaactctgtgaaggctaaagacagctgtagaataaacttctagcagactgagcctggctcacaggctcagcgtcatgtcagacttccactgtcaactggcacccatagtgcttagcactacatgtctttcatggtaccattttctgggctgtcaagagtgggaggcatcaagtgcagcccaagttctatgtcagtacccactgccagggtcctcctatctggaagagggctgatgtcccaggaaggtaggactcagcagttcttgggactaaagagatcttatttgtgccaagcagccagtattttggtcttttaaatgaggaagggtgaagaatttctacctgctaatgtcagagcagatccaaatagaaaatacgtgaaagaaatcaaaatacagaaaaaaattttgtttaaaattcgagtcaaggatggaatggaaaaacaagtgcagaggaggagactggaaagggactgagtggggacacatgcggtataaaagcgatatcccatctgaacactggtagagcccggggaaggccaagtctggaggcctctgagggcccacttgggtcttttcatctagcctctattgtgtcccccacacctgtcttttgggtcaggaacaacccgcaaaaggggattcagacccctatcacccaattcagaggtggagtgagactcatggccactgtctacataccaatatgtgccagccccaaactcagcttcccacttctctcctcagttgggtgcattagagaccttatgctgaacatgttctaacacgcatgcgactccagatacggctcattaggtctcactgcttgaatcacagactggctcctcaaaactcgagcctttcagaaacaaacctagggagaggtccgtgaatataggcagggtcttgtgaacggctgtatgcctagggtcttaggggtttaaaaacctttgcataataataaaaaatacagaatagtatttcagtagagcagacttcctcatctgagggctacatttccagaacgagagctgctggctgggtctggactgtggcaaggcagtcctctacatgccttccttggagcttatagaatggaagttgtcactggttcctaacatggtggccacgattccttttgattctgcagaacagctgaatggattctcagaaaggagtaaactccagttgtcactctacaagttcttgggccagctgttttaatattctaaacaagtctcaggtgggacttgtttttgtgtctcaggtgggatttgtttttgtgactcagggaaattttgttctcctccaaattccagaattccttgtaaagcagccctgtagcaggaaggctttccctgaattacatgggaagaatttttcctttgggattggagtctctttcagtgtaaacactcttgaggtgcaaggtgacgcgaggtctgagccaacagggccagaccacagaccagagtgcaccacacacattcccgtgggatctagttctgcagtgtgcacgggaggccccatgacttgtggtttcccgtggtcacagggtcctttctctgataatgcagccccaagggataattcctccctgctcggcttcggatatcagctagctgtctttggaacctgtctcaggacaatcccaaacccctgagttgatttcatgtcctgaatatcttcagctttctctacttgacttttttccttcggtgctagggattgagcctagggccccacgcatgctaggcagagctagcactgagctacttacccaactctctttgaactcctgaaggcatgggtctgccctgctctgtcagtcttgagcccccttagcttcctagtttcatttgttatgcatctccaaagggctggctcttgtacatattttttcccctccaacacgaaaagcataatgaagaagcacatctatgtgtagaacttgtatggccttagattcaaatctcactgtaacctgggccaagctgaggggcctttctgatgttattctcttgtctcctgttgtttataaaggctactctacggggcctggcacagtagttggttctcactccaaatctcagatttagtgtctggccagaagtagacactagataaatgctttggtgcgtgctctgactccctctgggttgcttgactccgattccaaagatagatcaaagggaggaggaccaggcttctttgctctgcaaaaagcctccacaaagtaggaacttccaaagtttacaccaattttcttatgaaaactacgttatatatgaataaggtgctgctcgctaaaaatgacaatctgatagacctagtgccccccactaacgccttcacctacccaaacctgaacttctgaggcctttagggtgaagtgctccagagtgggcacgtgtggaaggattgatatgtgtaatgagtgtagtgttgctgtacggttcaccgtcacacaaagccgtggtcactggcttcccctgaagtacgaatacagtgttgtatacaacgacatttagtaaaaattgcttcactggctactattttagcagtccagcgtcatagtttcagtagatggggttactggaaagtctcaagtaggaactcgggtgttgacaactgacatgccagtccagctcaagaactttcagctctgactgaggaatcactggtgcacataggcccagagacatgactcaactctcattgtagtctaatcagcaaatacatgcagaccttctgtaggcttcatgctataaaatgcaagaggacaggaacagtcactctagtaagtacccaagagcacccctcacactggtgggctttgtacagtgagtggacccatgtggtttcctgactttgctcatgtccatggcagaggcagactcacttcactgcaggatagtggccttaggtcagtcagctgtcaacatgccctagaggttctgcaaatggagaagatttcggtcacccacccatctttctcccctcccctttcctctatccttcattccctctttccatatatagccatctagttttggcaagagactgcacactgaccaagaactgctctgtaaatggccacaccagcctatctcatccctgtgttaatgaggttgaatccagaactctagccttgaccctgcccagtattcacacgcttcattactaacaactgttgtcagccacagacacattgcattttccttgcgttagagtgggctgtcctttctggcctcgggaagaccatctgaggaaggaagaggtttgtcagagagccagccagtgtgccttgaaatgcatctggttttattcatgctgagtctttccaggtgaactgagctaaatcataaactacaaaacaaaagcagattttcctgagcgcacccacatggaacacactgagtttaccaccgtgtatcagcccctgactgagacagagaagacgtaatcacccttctttttactgatggctggattgatgggccatcttggtcattttgaccgtcacagagtgaatgaatggttccctgggctgcagagtaggaggctgggagtaggttgagacttgttatgtcttaagggatactttggagtgggctattaggctttcagaagagtgtgagacttatttgtcctagaccaaaacctgtaggaagagcccatcctgtgaaagccacagctggtctgggacagatgttccaggtgctataggtcttccatgaaagcgttatggagccaatatggcgtggaatttccagaagagacatccagtcttaagagacacttgcaggccaggtatggctgggagctgccagtgcctagcaaatgtcccctatgggaagagcatctcctttaagctccttactggaacgtatcccatcccagggttgaactcattttcagcaaatccccattaggaaactcgggtgctttgtacctcctcccaccatcctcagtcaacacttgctgatttaaacacgtgaaaaatcaaacatttggctcccagctctggtcctccctgtttaatcagtgaagagccccctcttgtcccttcccctctccccagcagcggtatactgatgacagtgattaggccaagctgcagaacttcataagcatgcgctttcagttcccatttttggcatattttcatgaattaactcttgcagtgacatgctaggccatgccacgtgttcacaggccccatggcgggtacagtggaacactgcatgtgtggcccaagaaatgacctacagggtgagtgtttccagctgccactggttctgtggagtatcagcagcgcttgcggtcactctcatatacaaaggtagacactggggcttgtgggatgatgccaagagacaaggaggtgagtgagcacacagtagccacagatcccaggaaagtcagtggtgggtctatcaaaatgctaaactgcacatgaggcacggagaatcccatctggcacccaggacaagcagagtttcacacttttctcccagtctgaggcacaataattaaaattagcatgaaggccaggcacaatagtgaatgcctgtgatcacagctacttggggtactggggtggaaggaccacttgacctgacttgagaccaacctcctaacatagtaaaaccccgtctcttgaaaacaaagaaatggtacactaggtcccctatagaaacatagggtgtggggaggctggagaagagctcagagaatcactggagacagggccttctcccacaccaaaaggtcagaggccctagcagaggggcctgagcccagggagctctgagaggagcaggggcctgtggaagcagagtgcaatgcagatggaccactctgagaggagtctggaggttactgcctgcaacgttatactgacatatattctggcatgcaccagcacatcccaagccatatccccaaggatgcatgagaaacagagaagatcttgactgtgcatatccaagtagtgcaacagtttgcagaggaagggaatgtaaggcctgcacaaatctgagcctctcacctcatatcgaagaatgctcagctggcctgaatcctcacccagaataagtctgttgaatgaagcatcctaccacagttagcttggataacactgggggagacagtcagaatgaaaggaatctccctagcccacaaaccactgggagcagagctagagaatcagacaccctgtccaattgcatagagtgtaaaattgttaactatccccctcatggattgtaagaaagacaggtttttaaatatagttcacatgccaggaaattccacttgctatgagcaattcatttttttttagaatattcaaaaggtgttacaactattacactaattccagaacacattttttttatcaatctaaaaggacttctgtacacattgacagttattccatagtcctccctctctccaactcctgacaacaattcatctgatttctgtctctaaaacgtaccctttgggacatttcctataaaaggaattatgctgcacttgaacctttatgttaatcctttcatgtttagcttttgcttcaaggttcacccagcatatagtacatagcagagcctcattcctttatggataaataatattgcagtgtgtaggcccaggatattttgtctattgatcagttagcagatagctggactatttcttctctttggctatttcaaataatgctgacgtgaatattcatgtacagtttttatatgagcatatgctttcaattatattgattatatactaaactcttggttcatgcagtagctcactatttaaagatccatcaaactgttttcttccgtggctattgccttttatattcccagtgccactgtgttaaggctccaacactctacaccctcatcaacacttgttactgtccattttaggaattacagtcatcttaggagttctaaagtgccagctcactatagtttccacagcagttccctaacaacttataatattaagtatattttcatgttcttattggtcacatcagggtcatttagtccattcaaagtctttgcctatttttcagcttggctagctatctttttatgacctaattgtagtaagattcatgcacatcatactttcttaaatagtacaataacgtaaactgatattctcccccaaataataacatgttgtaaatccaaagctagaaatgatcgcattccaggaagggctctggccaaagctgaatgcagaaagggaaatggagagccttttccagggccactaggacgcaggctacagtgggcagagtgggtgaaacaccctaaaaaaggctactctggtttaaatgtaaaacagcccacagaaactcatttgttggagcattttgtctccagtgggtggtgctgttttgggaggttgtagaacctttaagaggtagggcttatcaggagtggagacgggcctccagcccactcggtgccttgctctgcctcttgctctgccagcctgttagcaagcagcttcacactcctgccaccatggcttccctgtcatgatggacagcattccccaactcatgagtccaaagaaatccattctctgttccagtcaggtaacttagcacactaacaagacaactggcaccagtgccttccactgaggccctgcagcatgttgtaagtctcctggccaagactctgcagggtcagtaggcctacatgcaccaaaagctttgagtggaaagctaccctgaatttttagaatattaccaaaaaactatacgatagagacaaatcatatttaaagtcttcttagtgccttccacaaaatcatgattggtgtcgaaatgaacaagcaggctgacgatgagatgccaaggctgggtacagatcgagccttcagtctcttttgtgattaacttggtgaatggaaggacatagctgtaactctatacccatttccatgtgtgcctttcatacctccccatgcaggagggacctgaaccacagctggatgggttgttcttcctgcagcatctgcagagctggtgcacatcacaagcttgtatctgtgcttctccccgggtcgtttctcacccaggcaagtcaagtggtgggtgagccaaggaacccttcaagttcctgcccagggctttggccatgtctggggtgtgagactcctgtagcaactggatatgtctgagaacacccttggacctggtatcctttgaccagccttttggctgcatgatctctagtacctcacagatacctttgtaagttactttcaaactgttctgctcaagaaatgaggtggtcttcacatttctcatcttgtgccctctttggctcctgagatccacccgttcatttgcatcctacctagattttcataacaaaatatcttccaaacttctctggcccaacccattgcaggcagttttattgttttttgtatttgggcttttcatctcttgtcatttgtccagcaggtttcaagttacaaccaaatgatgcttagattaggtttccttgtatgcatgtctttggcctatgcttcaaagagccctgccttccaggcccagagcctctccaagattgagttgcattgactgagcagtggcgactctgaggaagaagagtggcacttctcatgcctcgccaatgcgttcctctaccgcctgaggccaggcagctgtgtggacttcagctcggtgttcacacgctgtttttttcctttccttttccctcagacctgaattcagtattttgggagaatagggaaggctcaagaagcaaagtcacagggaagcaagccactgacaaagctagccttttcttcagagggaaccctcagggcccagttagcacatgtggctgcagaggaaatcctgctcagccaaacgataagaaggaaatggagtcacttcctcaccagatgcttcactcaggtagaaaaaaagcctccacttccttgtgagtgcctgcttctgcttccgctcagagccaaacctgatgtcaaaacaatcacggcttccttgtcctcagggagcacttccggactctaccaatcgatgacttgtgttcttgctgtcatctttatcccttctctcactggcatcctcttgagcccaacagtttaatatcagcaaatagtcaatgttggatttgcatgtctcctaagattcagaagcgccaggcttctatatgtctgcctgaatgtccagaaatagcctagttttatgtagcaaagacctcaatggcctggattgttgtgcatttgtagagagaatcttataagtatgtctttccagtgtgggtaagacactacaggtgtccccaatggagggcaagttgtcaaacgctaccctggatacctgcctcgcagaggttcacagggaatgaaggaggaagtgatatcatgcttagcaaccatgcagcacagaagctgaccagagagtagatgatgtgcagtgcccttgtgagctggctgagcccctcctatgggaaggaactggaggtgactgcaaagaccagcaagttggccttcacatgttctttctcttaaagatgcccattagattggatttggaagtcttgctatataattaaagaaatcagtttcttccactaatgtgtgtatgtcaaatggctagtgggtgacagaccaccagggatccagagagaaataaaataaaaacccgcagccccaaatgctaatggttggatgagacagtcatggaaatagatgatatttatgccataggggacaaggaactccttcagcttagtgttgaaaatgtcttttctgggtctctgaatgagcaagtgtttgctgaaaagcagaaggaactgagaaacagcggcctgggccagagcctagacactggacgtgaagaatctgatcttagaaaatcagcacggaggtgaggggtttgtaactagatggctcattctggctacaggaagcaactgtttaatgtggagcccaaggctggaggcagaggacgtggattggaagccacaacagacttatgagaggcagtgatggagacagaagtttgtgttggtggccatcagtgttgaggccatcagccctccctcccaggcctttcccctgcattggtaactaacttcacctccagctcccaccacatgaagcctatctctgcttgagagcccacttcacccatgtgcaatgggttggaagtgctatggtactgacccctgtgtaacgcaggcacagtctgcatgttctgcacaccaaggagctacggctcaaattcccagctcactggtccacactggttcctaggtctctccagcagggttaatccctaaaaggatggagcctctcttgttggaagaggagcttctaacttggccgttttccctactcttacatcctcctcagttacagtgtcctgggctcagctcccaggtagactgcttacactcagtttttggctttgagtttgttacggggaaacccaagctaacatgtggcatgtgcaccatgatggcaggaagagggaacgacttcatggagggaacaatggtagactgcaactgtggaggttaaagagatgactcagttagcacagtgctagctccacatgcaagagggcctgaatcattagcatccacataaaacctaggatgacctcaagtgcctgtaatcccagcagaggaagcagagacaaagagttcctggagctcaatgcttatccaggaaaaaattaggcagaaaacaactgaagaaaacacccaatgttaacttctggctttcacatggttgtgtgtgtgtgtgtgtgtgtgtgtgtgtgtgtgtgtgtgtgtgtgtgtgtgtgtgtacatacatgcacaccctagatgaacatacacatataacacacacaagaaagcaactggaatagaagctgacagcttggatgagaatagagaaatatataatgacttcagagacttcatcacagacgtggtatttaagatgggaacaggaagaagattgacaaagagggacagtaagctgggcagaagccagacatatctagaccatcttaggaagaggtgcccatgaaaggtacagcaaggaaattctccaggaagcaagaggagccccaaagaatgaggagcatgaatgatttgagtggtcaaagacctttgtgcaatgctacctgacaatcatgctggcaattagccacatagcaggtgaggctgccatgaggtggcctcagaggcataggtggaaataagcaagatgacagtaaaaggaaggtaacaagaaccaaagagaggaactggtggcgtctggaagggaaaagaaagcaggtagggtagatcatgtgccacccagacagtgtgagaaaatcagaatgtctgtatactagggaaagggggcagaagacagggcgaagctgacatagcgctgcagagtggggacagcttgtggaggaagatcccagaagccacagaaaacaatagaatcctcctggagggtggggatgagttcccaggagctggatttgcaggcagttatttgctgcctgacttaagtaacgggacttgaacttgggtcctctgctagagcagcatatgccccaaccactgagccatctctccagcccctttgttgttttcaatacataaaataagcaaataggactggagagatggctcagcggttaagagcactgactgctcttccagaggtcttgagttcaaatctcagcaaccacatggtggctcacaaccatctgtaatgagatctattgccttcttctggtgtgtctgaagacagctacagtgtacttatatataataaaataagcaaataagcacttcaaatggatctcatgcttgaacgaataatgactggatgttcaaataacttcagagatctcccttactgggatgtatgagaaagcaagattctctctagaaatggctcttcagaggttcggttcagagctcgcagggttcccttgcgatttggaattacagaggacagggctttggggccttgggcaatctgcagggattaaatgattcaccactgccctgtcctgcaaaccaatggactagtcatcaacacaggacaagcagatatagctactcccacttccgtcttcagaactaaagctggctccctagggagctggagcaaatgggcattaccagaggagggcacaggcaggtggatctgtgcagagctaccaaagggcaagatggaggacaggcaacaggacacattgctatcgctgtgtttgttcccttcgggaccacactgacagagggactgcaaggaacataggctactctttacagctaccgattgtgcgaccatggggaggggggtaaataaggttcagggttggataatttgtttaaggacacaaactaaaaaaatttcaaagctgaggggtcatgcagatccttcagcaagtttagaggtctttcaagacccttggggcttcaaatcctcactcacacaccccactctttcagccaggaggtattaatctagctcctctgactctcagaaagctgtttttctttacaataatgtaaatggcccttgggatgctgtctgagactgttggtgagaaagggtgaaggcataaagggactacccagctccaggaagggaagggtctgggggagacatttcttcagtcccctagctctatgtactaagcaacctggagaaaaaaactactctccccaccccccagacttgtctctgcttctgccactttctcaggaggactaggaaggtcacatgaccaagggcttaatttgttttagattttgccacagaaaactgatggaattcaagaaacagcctgaccctctcagtggaaagcttgagatcaaagatgccctgaaaaactagggtatctttgactgggcctttaggggctcacgcactcttggatatggaaaagatgggagaagaccactggatgtggcagctgtctttcttctacctgtcaggtggtcctccctcaagcacagggaaggctacttcttcagagctcatcaaggtggaacctcatctgtgacgaagagaactgtgcatatatttcatttgtaccctttgctgtcttttctggaactcaattttagacatcccccaacaatagatacataaaaagaaatcatctgcgccccctcctggcaaaagttaatctagccccaccagagctacccaacgtttgcctagggccagcaactccgtccattgctaatgtggccaacatcattgatgttcacctaggctgcttgttcttttgtggcccttggtctaagggtgtcctgtaaagtagaccttctcagcctccgtgtcattggtgtctggatctgagtcatccttcctagtagaagctactcataccttatgggatggtgacactcctgaagctacccactgaagccaataactcattcgcctcaaataatgaggaccagatattttcaaacatccctaggggacaagatggtccttcatctgaaccagggccttaagccattgccactttgcaaacagtgctttgggtcagaaggctgtcacgagggggcaagggcagttcaggacaatccctccataattattggtaattattggtattaacggtgttgatgcattggcagtagatttctgggaacttattcttttaaaatatgaatggataaacaccttatacacaaaagaatatcttaatattgctttaattctgcatgaaacataaaatgttgtttataggatcgggtacaggatactatgcattcacgaagaagagccatgtgaatagatatttagcaacgtgagcagctccttcagttgtgcatttagcctcccctttaagacttcttcagaatcctctgaggcagttccatatagaaggaatagattaataagcacacagagaaagtagggcaaactcaaaacagtgtgagggctgagaaaatggctcggctggtcaaggacttacttcgcaagcatgaagatatgcttttaattccctgcattgtgtgaaaagctaggtgtggtggcacccagccagaatcccagtgccagagagcacaaagcaaagtaaagggcattggctcgtttctgggttcgaatcctggctctaccacttcctgcccatattctttaactcctaacaaccccctactcagtgaatccctacaagtgagctagattggctctctccatcaaaactgcagcctgtaatctgggcagttatgcctggctcttctccctcacaactgccctgtaacttgactggcagcccattacaacaggcaggtgagattgccatcttctaaacaggaagaacgaaaatgattttgtaagatcggtatgaaaaataagataatgtatgttaggtgtctagtacagtccctaggatacagcaagctcacaataaaaaggaaatgtgtgagagacattgactgaactgtgctttattgtatttatgaatggctgtgcaagcaaaaaaaaaaattgcaaaaccgccaattttcttgtctttactgacttatcctgaacactttcctatccattgccttccatgatatctcttggggtgagccctgtttcacaagtgctttgtacaataagagcttctagtccactttttgtcattgcctccaaagagtaggtttgcattcccctctgaggtctgaagttacctggcatgcaggggcacagggtaccgtgcctctgccctgctagtagggaggccatgatatctcttggtggctaacagtctttctttgtccttctttctctttccctctgcaggatgcctttgtggaactatatggccccagcatgcgacctctgtttgatttctcctggctgtctctgaagaccctgctcagcctggccctggtcggggcctgcatcactctgggtgcatacctgggccacaagtgaggtcgacaaacctgccccaaacaaatatgcaaaaggttcactaaagcagtagaaattatatgcattatcaatgatgtaccatgaaacaaagttgtgatctttttttaaagcagaacacacacacacacacacacacacacacacacacacacacacacacattcaggcaaatggtcgaatcagctatttactgccaaagggaaatatcatttattttttacattatttaggaaaaaaaagatttatttatttaagacagttccaccgaaactccaggctttgaaaaccgaaccaggaattgccaagaaacgtgtggctccacctgctggcctgtgcctgtggtcatggatctgttttcaatattggccaaactggcccaccatctaaagagcaagtggcacaggaccctgacggctggggaagcctgcagtctggctgctagaagctttgaagaaggcttcaatgtgatctctatatactggccctgggggccaggatgctagaaggagcaggtgcctacaagaaagcctggtcttccatggactggagaagggacttttgtatatgactcacatggtacatacccagtcagaggacaaaggctggaaacttcagatgaacttggtacccactgagacttccctgctgaaagacagtggtgggaaaatgcccttaatcataggaaattatttttttaagctaccaattgtgccgagaagcattttagcagtttatacaatatcatccagtaccttaagccctgactgtagataatcatatattttggatacgcacaccccctcctccaatactcactctgtctgaggaggaaacaaaggcttctggattccaggaagtggatgtgtgacgacttcttcagcatcaggaagaatggggtcacctagcgcttcaggcagccacaagtgcctgctttatggagaccaacatctgcagaacctccctgtggctcagcaacttggcctgggcagcctgccctgagtgtggccctcaccagcctcctcaccgggtttggaacagagcagctggtctctgagctcagacttacccagtaagaaagagcaatataatagagactcaccagggtctgctaccctcaggccctccaggctgggcctgtctggagcaggagaactgctctttctaagacacttgccactgtagagaggagaacgcaggtagtgcccatcctgcctgagggcatagtgaaggcaggaagaccaccacacagaagaagaagcccggcggagctttaggtggccacaggtacctgctggcagtgctgtcacatttaaggcaaggctttaagttactttggccaaaaatcctaaggaggcagtgaagcgaggctcacggagtcgatgacccgtgtctatggatttacatgtaaaacattatcttgtagtttggttctatttgaaaatctgacagagagagagaataaaaagtttcaggaatgtatggaatgtggagattatctatacatcctggggccaaaaaaaaaaaaaaaaaaaaaaaagatggtatattatggaggaataacaaaagaagtgatgaaatttccagctaatgaaaggggaaccactttttccccaagttcagaattagcatgggggtatttgtggaattacctttggggcattatcacaccctgtaccattcatctgtattaacgttggaatgtacttcactcaatgtttattgctgtggttgatatttcaaaagctgctttcaaaaagaatccatgcatctcagcattgtttaaattgtatttagttatgacctctagaatgtttgttagtcacacaaacagaaaaagatactttttccatttgaggtatttgtctcttgattcttcaaaagcatttctgaaaaggtgggaacagctttagagagatgcgagggaccgatggagctgggcttgcctgttccctccgctgtgctgttggagcctacccctctgccgggacagaccctgggattgcttatcatgatggatatagctgttgcccactcgaccttgtttcttccaggtttacttgtccctggacgattcagcatttaactcaagttacctaggatttcatgcatgtttggttaaacccatgatgttcattcacttagaaatccagatgggaagcagagcaaggggttaggacctggctctagcagctgggccttcagagggttgctttgtgtggcctgttgggcatagatgtgtcaggactcctcttatcccctgtcccccaggcctgcctccctgtgcagagagagagagaacaagggagagagcaggagagccagaactccccagtaggtctcagagaacaggatgatcagaacttttcaagttattctagtttttaagcgaaatattatcctgtgaaaggtttacattctccacgcgatgaatatggaataagaaaccctgtgctgctatcctgccaagatcattgtaatggaggagtcggtttgcagtacacaccaagtgaccggctccttcaagctgcttcttgaagtaacgatgaagaacacagacatttattttaaatataaaacctgtttctcttttgtttttgttgctattgttcaaacttggatttgtagagtatttgaaaaaaatgtatatacatttaaaagaagaagcagcagcagctcataggagtccttcaggtgtgggattttgttttctgatttgaatggcaaattctccaagtccctggaccctagaactggacagtattgtggctgcatttgctctaaaagtagttggtgatgcaattttttttcttgttaaaaacatgttagaagcaaagagtatacatagaatctgacttgactagcctttttcttcctctttttttttaataacctcaattattttgcaatcagacaacagagagccatctgcatgtagttcatatttcagaagggcttcacacccaaatctcacctcctctgtaagctttgaaatctctccatcaatcaaagccaagcagacgtagaagtgggctgagagactcagagagagccatcgagaagagcagcccaatgccctccagagccccagtacccgcccaggctctctgagagatggcaaaaaaaacagagaggttgatcttcagtgattcctcagggcctgaacttgcgtgaaggcttgagatgtccatgagagccacagttaagggagcactttcatgtagttcaagtaaaaccctccatcctgtccagctcgcttgtctctggatgtttgggtgtggcctttattcatacatacatacattttttccacaggcatattcttatttattacatctaagagcattgctgggtctaggaaagggggaagcagggtttaggaagtgctcataagccaggagggattataataatcaggactgaatgtagataatgggtggcagtacccacatgtgtaggtcccacactgaatagaataggcagaattgtgaatagcccgtgtttgtaatggagcctagactaaaacaactcataaatgtgagcttcaactctaactgtgctttgaaggtgatgggtgtctctatacttccttatcagttacagttagaaatgtacacctaccctatcaggaaaaaataacaggaaaaggttgaaatataagccagtctaaggaaattagggagccactaaagttctcttctgagcttatactatggtctctattgcagctcagacaaatatgatcacacactttttaagaaatacaattctccattgtcgggcccatgaaggctctgatctgatctgtattgttgcccaatttgggtctttcagggatttttctatgccattattatagggacaaaggacacttgttatgaggtgggagagatgaagaattcttacatgagtagaacatttcctagattgggccagggtgtgaaggtcttcagcaaaatcaaggctgtgagaagtgagggacctttatgggggtcaaagttatgttcgcctgaggactttttgcaagaagcaaggaagctctatggtacatttatactccagggacattgacctagttcaaagtctggcttaatatggtcaagcaatagcatatgtttcaagttggatatggctaatgagtgtttaaacagtaagtttgacattttaaccaacagggtatttaaacaacaactttccagttggtagggacatctgtttctctctgtttattatacacaacatagaaaaaattcaataagattgaattaagtaaaacattgtgagactgagttaggtaaacgattgtggcagtcccttagccttggccagggaattattcaatccgctatagacatctgtgcactgtgcatctctccaggcatgaagaaaaccaggtagagggcagatggcacctgagcacttcatcctggatatctaagaagaataacataaagccagtgttccatgcaccaagtccagtacagaagacaaaaagagtcacagaagatggaaaagctagctaatcagaaatcctgggaatgttaagtgtgccggccatgtggctatgcggcaatgcctgtaccttcccacttgggaacctgcagtgggccctccagctggctcccttcatgaaatcctcccctccgagataacatctgaaggattgatggcagattcagtttccattaggagatattttcctttggagacaggggttctctattaaaatatcttcttaggttttcagctaaactttgctttggcttcagctatagtggggttctttctaagtaaagtaatgttcaaataagtgttttgtattggaagctttgttatcaagattttcatacttatatccatgggctgcttttaaggttgatacttttaggcgtggctgatgcctatagcactgtacatacaagaaatatataagtgtatttggcatacttaaggtaaaataagtctccagttggctactgttacatataatggctctttgtttgtgttgttagaaaacattacattgccattaactccccatgtctgtctgaaaaaataaaataaaatacagtgagcagcaccagttgtcctctggaactgtttataacacgctaacatggttgtgctgactattcgtcattatcaaagaaacctttggaaagcctccctaacaagctactaagaccatcatgagcacattctaatgaaggcctgggagacaaggcatgaattacattgcctgagagaattcatattgctatttggtgagttatttcatatggatggagatctcagccttcattcctgttactgtaatatgatattctgacagaaagcaacttaggagagaaaggcttgaaggtcacaattccaagttataatccaagatagcagagaaaagtcaaggccacaagaacttaaaacagctagtcacatcccatccacaaccaagggcaggagactggatatgcgcatgcttgtacttagctcaattttttttcacacttacacagttcaggaccatctgcctagggaatggtgcatcctacaatgagctgggtctcccagcatcaaataatttaagataatccctcatagacatgtccatagaccaacccattatagatagtccctcggagacttcccagttgattctggattgtgccaagctgacaatcaaagctaaccaccaacatttcagtatgaaatgctatatgaaaaggtgagaagctgaaggcttcttttgaagctaagattataagacaaccaaaatgaacacttgctttggagtgtatatactcttaagttataagacactcaatattatgtttcagttctgatattctaagcctcaatcacacaagtctctgcccttcaacttgattcaaaggcctgtgatagtaacatctgtctgtttaacatcctctggatataaaaccatgtaaatactgccagctgttctgatacctcagaaggtagacattggcctcttttattctataggagacgactgagatgcagaaggtgaaaagcatgctcatgttctcagtgaccacaaggcaggatcctgattctattcatacctgctgggggcctcaactccatcctttcttcctttccaattaactgatctccacacagagccatgatatggcaaggcccaactttgagatgtttacaggaattgtcacaccatggcttttcttcataaaagtatctccccaacaatagccccaaggccagacaggttctcacccacctccccaccctcaatcttcagccactcaggagacatgccattcatctgctctcctttaaccctcccctgaggtgccccacaccattccaggcaggcaccttttatgcacagctacccaactacaggtcacaaaccttcagatttttcctgtagaaatcttggtattgatcaatttaagcttatcaattgtaaggtataccatactagtgtttgggctcaaactcaggacaattggctaacagaggtgcccactaacatattaaatctgatgcttgtcccagcatccctcagtctcttatcaccttcagtgcacacctggctggcataacccaccccctaccctgaactccccaacccaggtatgacctgggcttcgctcctgcagctcttctagcctctatataatgcagacattttggctatgcttagtgtcttggctgcccctcttggctaacaactcgcctctctctcctctcccctgaccccctctctcctctcttccctctcccctcctcctgtcttcccttccatctcctcagggtcaggtccactctggcctctcccagatattcctgcctctggccatgctcgccctcatatctacagtaaatcgtcccctccaccatgctcaaccgtgtaattacctttttcagttttgcttttttcattcaatgaggatatactgactttgaagagaaaaggaaggaaatataaatcttctaggcataaaaatttatttattttgtcttgttttcttgcacattatgttgaatatcactttactgtggtatgtagattctactgtatataattttaaagtgatagaacaaatatattttaaaatgtctgggtaaggtttgtgttagtatatgtcaaaaattcaattttaaaatggcctcccagagaatcagccaactcagtgattctctctttaaatttatttttattattacagtttacgaatgatgggggtggtatgtgtgtgtcctagtggatatggacgtcagaggataatttctcggattaagttctctcctttcttgagtaaattatttccaggaaccaacctcacatggtcagcttgtgagtttgtccgctgagctatctcactaaaccaattcatcaaatctcttgagaaaaggaaagatagatggctggaatgtgggtgacagggttttggtggtgtttgtgtgtttgtgttttttctttgttttgtgtctgtttatttttagacacagcttcaccatctgttttatttatttgtttattctgcactgtatgtatctgggtgttttgctttacatgtatgtctgtgcaccagcatgtctggtagccacagaagcaggcattgggtcatctggaactgtagtcacagatggttatgagccatgtgggtactgggaatcaaatccatcacctctggaagattatccagtgctctgaaccactgagccacctctctatggtaacaatttccacaacccaaatgtcccaggacttcttaatctctttacaaactccatgaggaattctccaagtacacttcactaggaatcattatcacgtcatgaaagagctatacattacatcatctaagaaagttctgacacagaatttaggtaaatttccttgtttgttttaacttttaagaattaattatatatccttgccaactatttacatttaaatttcaaaaattaagtgtcaacctaaatgtgtggtagtgccttttgccttgctaacttccttaggtggcataagccagcttaatgtagtagcccctccctgcaagactctccctgcaagaccctcccaggaccttctgcactccataagaagcctctggcagaaaagactactcatcaggacttacctgtgtaactgattcaaccagcacccagaaagcgggttaccagacaatagtaattataataattattcaagaaatgtagagataacatgactaaaaatcacttaaatgaatagaatcaacttttattgtcaaaaatgtggaactgggtgtggtggcacacgcctttaatcccagcactctggaggcagaggcaggcggatttctgagttcaaggtcagcctggtctacaaagtgagttccaggacagccagggctatacagagaaaccctgtcttgaaaaaacaaaaacaagaacaagaacaaaaacaaaacaacaacaaaaaaaaagtgagacactaatccaatgtaaatgttagcttttttaaaaagctaaattttaaaactgtttatatatttctcattttaaaggggattggagtcaagtcatacaagaattaggtcctttttatgtgcacataaaaattattacattttattcgtgtgtgtgtgtgtgtgtgtgtgtgtgtgtgtgtgtgtgtgtgtgtgtgtgttagattgcaggacagcttgcaggagttaatttctctcttttgatgcatatggttctgaagaattaaatgcaggttgtcaagcttggcagcaagccccttcacccactgaaccatttttccaaactattatttacattcttacagtgaggatatttgatatttcctattatacactcacaggaagaggtgagaagaggacagattcagggtggtcctccaaatctgcatccacatgcaggctgaatctcagatctctattgggctggtaccacaaataggtgccttgctagataaaactgttctgggccatatctgccccctaacaccagccgtaagtggcattctaaacgacagtctatctgctctgatgagttctaagaggaccactgatccctgatccttcagcctgagcagcaggctagatggtgctggtggtgcttattgctctagagaaagagaaatctgagttggatgagcacaagatctggtgaaggttagtcagtagcaaagtgtcagctggatttagtgacacacacctgtaaatcctagcatgcgggaggttaagacaggaggaacacgaactaaggtctagcctgaggtacacagtgagatcctgtccaaaaaaacaaactatctgtaggttgataactccatcctgcattgttctctcacgctccaaacttatgtgttcaactaaatgttcagcatctactctcgattaaactttaagtgtgtccattttaatatgacccaagcaggattttgatcttagccagcaggataaggacctgtagttttatgacaaatggagatttttaaaagaagggaccaaaaaagaaaaagtatggccacagccttgttttgtggtgtttgattatgatgattataacaacatcttcttcaaatatgacaaaaactcataaagcggatgtcattatcaccaatgtttttggtgtaattcaatattcacagtattgacgctaaaaaggcccattagctaaagctgatgaaattaggttgcagttacaaggaaccttaaaaatatggttttttattaatcattttattcatttacatttcaaatgatatccccctcccccttcccggttacccctccacaactcccccatcccaatcccccctcccctttgcctctatgagggtgctcctcctcccactcgcccactcctgcctcactgctctagcatccccctacgctggggcatcaagccgccacaggaccaagggcctcccctcccactgagatcagataaagccatcctctgctacatatgtatctggagccaagggtccctccgtgcatactctttggttggtggt

SEQ ID NO: 1952 - DNA, 711 bp, Mus musculus
atggcgcaagccgggagaacagggtatgataaccgggagatcgtgatgaagtacatacattataagctgtcacagaggggctacgagtgggatgctggagatgcggacgcggcgcccctgggggctgcccccacccctggcatcttctccttccagcctgagagcaacccaatgcccgctgtgcaccgggacatggctgccaggacgtctcctctcaggcccctcgttgccaccgctgggcctgcgctcagccctgtgccacctgtggtccatctgaccctccgccgggctggggatgacttctctcgtcgctaccgtcgtgacttcgcagagatgtccagtcagctgcacctgacgcccttcaccgcgaggggacgctttgccacggtggtggaggaactcttcagggatggggtgaactgggggaggattgtggccttctttgagttcggtggggtcatgtgtgtggagagcgtcaacagggagatgtcacccctggtggacaacatcgccctgtggatgactgagtacctgaaccggcatctgcacacctggatccaggataacggaggctgggatgcctttgtggaactatatggccccagcatgcgacctctgtttgatttctcctggctgtctctgaagaccctgctcagcctggccctggtcggggcctgcatcactctgggtgcatacctgggccacaagtga

SEQ ID NO: 1953 - protein, 236 aa, Mus musculus
MAQAGRTGYDNREIVMKYIHYKLSQRGYEWDAGDADAAPLGAAPTPGIFSFQPESNPMPAVHRDMAARTSPLRPLVATAGPALSPVPPVVHLTLRRAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWDAFVELYGPSMRPLFDFSWLSLKTLLSLALVGACITLGAYLGHK

SEQ ID NO: 1954 - DNA, 217409 bp, Homo sapiens
  misc_feature (1)...(217409): n = A,T,C or G
aatagcatattttaaacactgatagatacagaagaaattattatttaatatataaattgcttggaatgatttcattgcagcttgtaaggatgggttgatgccagaatggtttcataaatctttcagtcttacagagccaaagtttgcagattatatcgagttgcgttgtgcagctgctaaaatggaatcatagctttttataatttgcagaaaacaattgcattaatgtctggatgtttctcagttttattcttttctcataaatgttcctcgaatgttggcaccttctactgctgatctatattagaatctagtccaagaaagtgtctgatttaataacattaaatagttatttcaatatattttttcaaattatcctcatagaacctgttgcctccagtgagatggtaatctactacccgaataaatttaagagcacctgttgagagcccctgttttgcggtagaagacaattgtccctatcccaatttccactgaaatatgagagcagatttgcagagaccatcatgtcagagaagaaatttccttgtcagagatgttaaagggctacagtcccttagcaaagaaacttcgaaatctaagttggtttgtgtttttctaaatttgataccgtaattcatttggcagcaaaatctgacttgaactgatgtgagagtattgtactttatatttatgctacttcattgtgacttaattttccctgaagaaatatccatggatttgattataggttttcccttagatgctgtggaggtgttttgtaatattcaaaatatgcccatattgcctttttaaaaccccaaagattatgaattctgaaacacatccagcccagcgggttttggataaggggttgtaggcatttaagcagcctcacataatgggctgacttcatccaaaacatgaaaatattacaaggcaaattctattttttatattttttggttcaatgcttgaacaacttgtttttctgctgggggaagaaaaaaagaaccaaccctgagtgtgattgttacggaaactaatgactttgtttttaaaggatcacattgattcaacaccttctattggacccagaagtgcgtaaatattacctatggtagtaaacgtttaattatcattcagtttaaatgttggccttctgtatgtagccaagaacagctcattttgtgaatttcagtttttaagtggctgctttttgatttggttgtattattttattataatgtatttgcaagtatattaaaaaattaacattgagccataaaaatccccaaatatgttcaaggacttcataattgaaaaatatatagaaaacaatccttacttctttttacaaaaacaaaatcatgggaattattcttttctatatatttagttataaatctttctctgggccgggcgtggtggctcacgccagtaatcccagcactttgggaggctgagacaggcgaatcacgaggtcaggagttcgagaccagcctggccaacatggtgaaaccccgtctctactgaaaatacaaaaaattagctggacacggtggcaggcgcctgtgtgtggcgggcgccagctactcaggaggctgaggcaggagaatcgcttgaacccaggaggcagaggttgcagtgagccaagattgcgccactgcactccagcctaggtgacagtgcgagactctgtctcaaaaaaaaaaaaaagaaaaaaaatctttatctggatctgttaaaccatatattattgatcattgcaagtgaaattttgagagattgtttctagtatttaggtgatgaaaacatttggtaatattgctttggttcaaagaattttatgtctttatctttctagaagaaagcaattatatatatatttttgctaaattacataaacatttaattacatcaggttctaatttaaacatgtattactcacttgaggccacttttaaatattcatactctttgacataagatgctttgtatatttctcatttcttttagttcttagtaagtcagctttaaaaagtacctgccaaccagaaccttccatattctggactaaatcttgctcttcggattatacttcagtgcagtaactgtggatttgcaattttgaaggggagatagtagctattatattttacacttgcttgatgtgataactctaaagactttttaactgataaaagcgcacatggctattttgatacacaaagttgtgtttgctactttagaagcttttgtggcagaattgtaatctaattttcataccttgtatttctgaatcacaacaaaaaaataaatggggaacaagacttacagatttgcaaacttatttatctagaagtttgtgttttttaagagaccatttgggcaaaacataaatgttttctataatgttatcctgactttgcatcctaagcatttcaccaggcctgatttttatcattttttaggaagtaatatttgtggagtaaatacttggtattctgagctcttgtgtcaagtaggttctgttcgtatcactatgatgtgggatatacgagtaaaagtttaagaaatgtgaatttagcaaaatttcttaaacaagtacgttttctatacaaatatatttctcatactttaaacgaaaacctgatattccaaccatgtaatatctcccagatcctgatgggcagcaaattatacaagactgatatggaaaagaacatgcctcgatatttatcagttcgtaaacagaaaggttttggaacattgagaagagatttcttggacatcgtggtttgcaagcttaatctttctttacatgtgagcaatttatatacataaatggcatgtgatattatatctgtaatttttgtttggatatttaaaggacaaaattatgtgttttgtttgtttgtttgtttgtgatggagtcttgccctgtcgccaggctggagcgtagtggcatgatcttggctcactgcaacctccgactccctggttcaagcaattgtcctgcctcagcctcctgagtagctgggattacaggcacgcgcccccacgcccagctaatttttgtatttttagtagagacggggtttcaccatgttggccaggctggtcttgaactcctgacctggtgatctgcccgccttggcctctcaaagtgctgggattacaggcgtgagccaccacgcccaaccccaaattatgttttgatttctgttacactcctgattttataacctccattttgcctcatccatcatatatttgttgggtactaatgatgagcttggtatcaggtgctggggatacaattatatatcaacaacttgttccttcctcatggcaattacttttcttgtttcttcaccttctcccatccttcatccctcagatggctctgctatatccttacaagtctcttagacaaagaggaaccattccccattttcttctttggcttggagcctctgaattttaggcttcaaatctttgtatgctaagcactgttctaagctggaaagactccaaggaaaaataggatccctgccctcgaatagtttataatctagtgagaaggatatatgccagagattacactgatctgagaatagcggtgattaagataccataaccaacactgaaaacaggtaccagtcacttgtgagtgctttacatgtattaactcaatgaaatcacaagctaaccccaagaatagtactacttatatttccatgttataaatgagggaacaggcactgaaagcttaaatacttggctcaaggtcacagctactcaatggtgaagccaggatgagaatcttgattctgatttttaggcatctagccccgtactaaatgtcttctagcagcacagaaggaatgttaagacggcccagaaacagcagggatggctttacagaggaagaaattcttcagccaaaactaaagaaatgaatttgtcaggtgaaaaagctgggtaccattcagggagaccggcagatgtgcaaaagcgaaagacgtgagagaccttggcatattccagaaaccacaaaaagtggatatagttgcaagaagggaaaaggaagagatgaggggtagggaggggggtggcaaaggattgggccagatcatgccatgtgaagagttaagatttttaggttttcaagaactttgagtggaaatatgaaatagccagattttagctttagagaggtcacggtagcccttgaaactcagttctaatattgctgagtctttaggccttggggtcaatgatcctcattagttttaaaaatgtcatattagatacatattgtgatggattgaattgtgtcaccccaaaacatatttaaattcagtccccagcacctgtgaatatgaccttatttggaaataaggtctgtacagatgcgatcaagttaagatgaggtgactgtgatgggcctgaatccagtattatgactggagacctcagaagaatgggagaaaacagaaccccacaggtcatggcggaagcagagactggagtgattaggctgcaaggcaaggaacattaaggattgccggccaccaccagaagctagggagaggcaagaacagactgtacccgagcttcagagaaagcgtgggcctgctttcgccttgctttttgacttccagcccacagagctgtgagagaataaatttctgttgttttacgctacctaatttgtggtattttgtcatggcagttctaggaaacatattaaccttaaagtttagaattgtgttcactatcaattaataccttggagacgtgctgtgtgctaaatagcataagagaataaaagttagttattacacgtaagaatgtaaattattcacccagccctcccggtactatggtattataccttgtttggttctatcactgcagtttcagtccaacgagagcagtaggcatctgaaaaatggacaagttcctacccttagcttatttcactttaaacaccaagttattgattagaaatggaaaaaaaaatcacaagttaatttgctatgctttccattgtaaaccaaaagtaaatattatttgcccactattaaacttgtacagcagaatgatttatttgtagctcattgcctagcttcaaatattattgcttaattattccgattttttttgtcttgtttttaggtttaggttccacttaagttaggtgagttaagttaggtggatttctaagttaaaccaaggcttaacttagaaaccaagagagtttcctggttatgacaagaatgactttcaggcacagagtggatgacttggatgtgatcacttaaggcagaagacaggctctgaagcaaaagtgattgggaaaaaaaaaaagcatgactggggcttatataatgcttgctggcaatgtatgcaaaccatttgaaagagcatggcactacctaccacacaaatttataatgtataagattcttgaaattggaaactggcattttggattgctaatctaagcctatgagaagttattattattattattattattattattattatttttgtgagacagagtcttgctctgtttccaggctggagtgcagtggcgcgatcttggctccctgcaacctctgacttcctggttcaagtgattctcctgcctagcctctcgagtagctgggattacaggcacttgccaccatgcccagctaatttttgtagttttagtaaagacagggtttcaccatgttggccaggatggtctcgatctcctgacctcgtgatccatccacctcggcctcccaaagtgctgggattacaggcatgagccactgcacccggctgagaagttattttttaagcagttctttctttctttctttctttcttttttttgagatggagtctcactctctcacccatgctggagtgcagtggcatgatcttggctcactgcaatctctgcctcccgggttcaagcaattctcctgtttcagcctcctgagtagctgggactacaggtccccgccaccacgcctggctaatttttgtatttttagtagagacggggttccaccatattggtcagcctggtcttgaattcctgacctcaggtgatctgcccacctctgcctcccaaagtgctgggattacagccgtgagccactgcgctcggcctcatttttcttttatgcaaactatatggactacttgtttttattctctctagtcagctcattttatttatggattaatttccatttcaggttggggccatggtttactcttccatctgacctattagttatcaatatcctcagttaatagtctcattctacccacattttcaataaaaagtttactagctgggaagatttgatacacacacatgattttttttttcttttcttttctttttttttttgagacagggtatcagtctgtcacccaggctgcagtgcagtggtgtgatcacagctcactacagcctccacctcctgggctcaagtgatcgtcctatctcagccttcagagtagatgggactacaggcacacaccaccatgccccgctaatttttgtattttttgtggagatagagttttgtcatgttgtgcaggctggtctcaaactcttggcctcaagcaatacacccaccgcagcctcccaaagtgctgagattacaggcatgagcaaccacacctggccgatacatacctatattaaacattagtatgttcatgttagaataatgtaccttttgaatttcataaacttggagaatatttatattgatgatggatgaaagaactttcttggatggatgaagagagtaacgctgtgaaacaaccagcaggtggcgaaaactggcaatcaaaagctttttgtttggtggcctggggaatgaagacggaaagaaaacacaggccattcagactcttgatacaatctccattccctgcatcttgttttttttctcttcctggtgccacgctacttgtagaatccaaccaggtaaagctgccaaaagggtcatccattggctcttacaagtagaaaacatcttggaaagtgaaaagtccactgtgcatatgtttgtaaggttgttggaaggtctcaggcatagatctaggattcaaatccagttactcctgcctcaggctggtgttccctcccccacctcagcattgcccaaagacgagtagtcaatgtcacatacttcctgggaatacttgcccttatgctttaaaatggaatctaataaacatggaatctgaacgcaggaatggtttcactctttcatttgaaagagtatctagaacattcccagggaaaatataacccctagccaaagactgcaatacagacctgtctcaagactgattatagccaagatgccacataaggaatcagtctgggaaaatccatagagtgaggctctgtgggagcaaaggaagacgaaaatcagtcagcttttctttctctggaagtaggggatccgtttccttctggctgccccctttgcagaagtacagtttcttttgcaggtttgtcctatcatttcctcactcatatgctgagtattaggagcttgaagcctttcaattcctcttaggtaattttggggctttaaaatacgctttcaagatttctaaaccatactgttgtgcaattggtatgaatttatgtgagaacatttattctaggtcaatctatacccagtgtctatccagaccaaaacacctcccacgcgcataaaagggactctgtcccaaccatcagaagggcaagaaggaggatctcctttcatcccctcttgcctggataagaaatttgtacccaggcccccattcctatgtgagagaagttggcttgttgggctgatgggatacaataaatgaagaaataaaataaaaacacccaagagagatggcagtgcgtatagtcccagctattcatgaggctgaggtgggagaatccttcgagcccagaagttcgagtccagcctgggcaacatagcaaaagccatctcttaaaaaaaaaaaaaaaaggccaactaagtaaaaattaaaaaaatcataatttggtgtgcttttctggctttttaaagaatgttttgattttagagtaggaatgagacaaaataaagatgtcaggcagggcacagtggctcatgtctgtaatcccagcactttgggaggctgaggcaggcggataacgaggtcaggagttcgagaccagcctggccagtatggcgaaaccccgtctctactaaaaatacaaaaattagcagagcgtagtggcgtgcacgtgtaatcccagctactcaggaggctgaggcagaattgcttgagcctgggaggcagaggttgcagtgagctgagatcgcaccactgcacaccagcctccaagatacaacagagcaagactctgtctcaaaaaaaaaaaaaaagtcatagcatatttgtacacattgtagtactcatttgtcatctttcttgaccccaataatccagtgtccctatatatttgcactcgagccctattaagtaagccgctgtgcttctagaagacctttttcttttcttggtgctttgtcaaagactcttggagataaaaatacacacgtgcaacttgtttgtcctcttgtccttttttgctaggggctattcatgctgattaatttaaaactgtctgcttgcgcgtacacacgtctgcgagtgtgaatgtgtatgtgtgtatctatgtacctcatttgagaaagtgcggccaactaggattggctacgaggcaaaggtggagacctttaggagcccacccaccccagcgttaggacggtgggcctgaaagttactatatggaagtcctcatcgtgtagcactaaaccagtgtaaaaggtgttagggacagagggaaaacattgacttaaactgtcgtaaagcccttgataaaccccttccctggagcgctgagttctgcatggcctgggccacggactaggtgttcaggtggacacgggcggggatgcgcgtgcgtgtgtagtgcgcggacacctaggaagctacttgaaagtaaacaccacgctcggggcgtccctagacattgcttaaaacgtgcagagtcacctgtcttcacagcagggcagcgctgaggtcccactgctgggggcggtggggggcggcattggcctgggtcttcccccggcggccgagcgccggtaacacaacgtgtgtgtgtgtaggcgcgtgtacacactctcatacacggctagaaagggtccaggcgacacacacactcccacatacacggctagaaaaggtccaggcgagacacacacacacacacacacacacacacacactccacacacactcacacggccagaaagggtccaggcggttcccggcgcttttccagcccttgttttcatggcgcaccctcccgccagccgcccccctccgcactccgtcgtccgcccggcccggccgcgtgcggttccccgggagcccccaccccgtcgcggaccccagcgaccaccaagtccgcacgcggcctgccgcaggcctgagcagaaggccccgcgcacacccaccgcgccgcggccgcgcgggaggcctgtgccgcccgcgccacccactggccgggccccgcgggcgcagcggagcgggcgggtggccggcccggacgcgccctccccggccgcggccccgcgcgccatgtgcccccggcgggacgcgccactcccgggcctgccgcggcgcctttaacccgggccagggagcggggcggagggggcggtcgggtggctcagaggagggctctttctttcttctttttttgaatgaaccgtgtgacgttacgcacaggaaaccggtcgggctgtgcagagaatgaagtaagaggacaggcaccacagccccgctcccgcccccttcctcccgcgcccgcccctccgcgccgcctgcccgcccgcccgccgcgctcccgcccgccgctctccgtggccccgccgcgctgccgccgccgccgctgccagcagaaggtgccggggctccgggccctccctgccggcggccgtcagcgctcggagcgggctgcgcggcgggagctccgggaggcggccgtagccagcgccgccgcgcaggaccaggaggaggagaaagggtgcgcagcccggaggcggggtgcgccggtggggtgcagcggaagagggggtccaggggggagaacttcgtagcagtcatcctttttaggaaaagagggaaaaaataaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccccgactcctgattcattgggaagtttcaaatcagctataactggagagtgctgaagattgatgggatcgttgccttatgcatttgttttggttttacaaaaaggaaacttgacagaggatcatgctgtacttaaaaaatacaagtaagttctctgcacaggaaattggtttaatgtaactttcaatggaaacctttgagattttttacttaaagtgcattcgagtaaatttaatttccaggcagcttaatacattctttttagccgtgttacttgtagtgtgtatgccctgctttcactcagtgtgtacagggaaacgcacctgattttttacttattagtttgttttttctttaacctttcagcatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggtaggtgcacttggtgatgtgagtctgggctgaggccacaggtccgagatgcgggggttggagtgcgggtgggctcctggggcaatgggaggctgtggagccggcgaaataaaatcagagttgttgcttcccggcgtccctacctcctcctctggacaaagcgttcactcccaacctgaccgataacgcctgccatctaaaagtctttaacttgcttgctagtcgtggagatccaaagatctagcgtttgtaatccagtaggatgtggtggtaaatggtaccccttcagtgtttctcaagctgaaggtccaggagtccccaggaccaccgtttcctggcttgagcagcttgttggaaccggagggaggtttcagggactgcttatgaaccagataccaggttgggtcttgacagtctgcatcccaaacaagctcccctgaaacaagcccgttgtacactaaaattggagaacaacccgattagaagaatagactccacagaagaccaagggcatcatcaatcggtaaaattttccaaaagaggaaaaccaatgtaagtctttttccctgaaaaacttagttgtgtttgtaaagagctaagttgacattccaaagtccttggactggaatctccagtgtgtgccatgttcccagtgggcgtgatgaggtgtcctgaggagtatcaggctatggctttgctaccttgtcagtgacagaatttgcatcggctgcattctttgtattctataatttgtgtatggtttaccagtttgctagaatgttagaatcttttgtttttcaccactcagagtggacctaattttgtggtcggctgaaaaaaatttgcatctaggtatctatgtaaagtgtagaagaattgattcttagctgtggattatcttacccttactttagttgaagtgattgatacctgtggctttgaagaacatttgtgagatgatctttttctcgtactgtgctagatagagctttcatcattataccatacaattgtacttttctgagattctttgttggagggggtttagttcctaagagtcaaggattgtaatggagatctatatctcatatctaaaatgatgaatttatgaaaaagtaattcttgtgtgaagttttttttttttttacactttttgttttaatctgaagagttatctttgaaaaacaggatgcaattcagtgcttccttttatagcctcttgggagaatgactaatgtcattattttataggacctaacaggagcaaaaagcctagaaattactgcaagtggattagatgtcaagaagcacaccacatgtttttattacattttacaaagtgtgctcatactaggaggccaaatagagaaaaggccaagaaaagtagatgattgatgtgaacatctgatcttatttgaccaaagttgacaaaatattgatgccactgtttggtgtttaaaagtaagattaactaaaatgccccaatttaaatttctaaaatttaaatcctcttcttgaattgtttgtttgttgagatctcacattatcagatctttagtaattctggaagaatttgctaaagggtgaaaagaatatttttgttaaatatttggttaagtaggtggtttgatttttaatcactataactaaaggggttgggacttccagattcccaaaggatccttttaaaccaaagtaaaactgatttaatagttttactatttcacatttttgtgaaaaattcacacttacaaattttctttctacttgaaataaatccaaggtggtaactggtatctgtctatcaaataagttaataaaaatgtgggaaacagagacacatgtttatgacagaaattaagatacaaccttgatatttgttgctgaatttcagtgtgttaccctctcatgtaactgaagtttctttttaagtaaaggctcacttttttctttttgtgaaacagagttttcatagtagacctatctttgtggtcaacaggtatctgaggttgataaatgtagaggctacattttatgatgccaaaccacaatgacataccatagaacatgataaaaattttttgacaaaactgcttctagtaaaaataaatcatgtagaagcacagatggttgatggtaaaatatgtaatagctttcagaacaatgcatagatggtgactatataggaaaacaaaggaatttagagaaaaaatatatatatataccaggaaatgcactcataggacactttggaataaaagtggtagtgtttgagaatgatgaatgatttgcctatcatttcaaatgtgcattattaatctaaaagtcattttaggcatttggcatacagacagattttcttcacatttacaccaattggggttacatctctaataatatgttgtattttatagtgtaaggtagtcttaatggtaaagcttcagaagagagctagcatattttcttggcatgtgacaataatctgcactgtccccagggctccgtggattagcccatctcctgaatactacactgaatactccaggctttagactgcaagtcatttctttttctttgctgctgctcgtagaaaattggaaccttgtgaggctgaggaaatctgtttgacttttgtgttccataacatggataaatcaggtccttggaatgatcagcctctgatagattgtcccagaagactacaaattaaataaagactaaagaagtaattggctgtagagtggagtgtggatttattcctaggtctgaataaggcattgtgtggcatccagagagaggcaggacagaggaagcagtgagagagaagcaattctagaaaatgtggataccttgctgctcagtgtggcttatagacagtagcacatgcatcccccggagctttgtagagatgctaaagctcagctcccaccccagagctactgagtcagaatatgtggtttgtgtgcacgttaaagttagcgatgctggctaccatccttggttcctggtggcatcttttaggaagagttgctacctgggatggattctgcattgtccccttccagtggccttaaagatctatagtgttacttggaataccgagtatttcccaggtgtccactattgtgatctgactttaggaagacataaattggatgaaggagagatagcaagcaggtagatcaactataagcccagtcttctcatgaatatttttcgtagtagttatatagtttatattggcatcactggtcccattaaaaagtaagatagcttttcttcaattaaaggcaagagaattagctcttttaatagctctgttagttattattttatcccctcataacacagtttaaattctgtaaatgactttagtgaccttgcagcttctttaagacaaagggactcttgcaggcaagggattgagttttgggcaggtgatggagagtgaccctctaaactgggaactgtgacgacattcagcttcatgtcttaggagagagtgagataggagccactagaagaatgagatgattcagacaagagattgtaggagattggctttattctgttgacaagatggtaatccgacttattttttggttttttggtgttggtggtttaggaagacaggaacttctccacacccggtagagttcagctgccttttcattagtcagcaagcagtttttcctttctcaaggcagtccacatccagcaaaacatttgattaactggaaagcaataccattctcatgccagtgtacaaattacatgaaagagcatcatttttctagtgtctgaggattggctgcttatggccaattttggcagcaagacgataggattaaaaatagcttgaagatgatctagtcttaaataatatatttcatgatgaactttccttgggaaagtgcatctttctgcctacaagaatcacatgacccctttcaataatttatgtagtagagaaaaacacactatttctcatagagttttcagtcatgtgctgtggtgtgattgtttctggacattcataaaattttatagttaactgaattctcttttctgttttgttgctatttaacgtccattgaaaacatggctttcttttgcgcattctgttactttcagctgtactttctaataagaatggattgccctttttagcaatctttgattgaactggtacatttcagattacttaaatgtcatcaggccacacagcataccaggtaacagaaagccataaattaaaaataaaaaaaaggcaagcaaaattcttgttgttttttcttatctctgttcccagtcctattgcgctatttggagggatgatacgcccactcatgagcgagtgtgtgggtgctgcatgttaacagtggttcttcccacccaacatacctccgcacccttttctaaggtcactcattgtgtcttagcagtagtttagcaaagcagtatctcagcagaagtgcatttgtgctagaaaacaacactgtctttgtagtgtacaagtagaacgttttctttttcccccagagatatattgtatttgagattcaaaggttctgttcaacctttttaaggtaatctaatatcaccttattcaggtataacagtaacttgtcaatctggtcatcctttctgtcaaccacatgtaggagaccactcagtgaatttactccactgtgaattttctctttcatccctcttggtttggcttaatcaaccttaatgtttgatgtctaagcaggattaatgatgaaaatcatccaaggactgacagttattccacagatgtgattgccagtcttacatgagtcctgccttgggttaggttggaggcacggcaaggagagctttgcttctgccctggataaactcacaggctagtgttgcaggcatcttaataaactcgtagttatcatacagcctgataagcatgatcctagactcagagacttagaggaaaaaagcaaataactataagttattttgcatgtacttcagccttggtctaagaacgttatttctgaccatatggctgttcatgtgtgcattaggcctaatttaaacagggccaaaatgtagatactttaaaaaatactgtgtaacgtagacatatgcttaagagaactgaaaggcagggggagttcccttgttaaatattaacccactaagcactatttatgcatactaagaagacttaataaacaccagtctacaatttctaaagcatttcattaattctttttaagtaaaagacaatcaaggctccgattagactgactggaacagggtaatttgaagaactatctttcttaaataactcttgtatgccaaaaaatacaagtaggttttgaaccagagcgggggctcttcctttgagcaggggaaaaaaaagcttctgttttgttttggtttgaggttatattactgttctatttatcaagacacttctacgatgctagttacagaaattcacagtccattgtaacactggcatttgccttcggacttttttgggcttgtggtctgttcgtttaaatggagactgtaaaactttcaaaatgccaacaaagctgttttcacttaaaaacatatttttatagattgtcacttgttgttcttatatatgcccaattctgtatatgctatagcactatttctctgccctccatttgccagacaaaagatacacccatctgtccttcagtgtgaataaggattgaatgattattcctctctcttccaagccatgggactttctcataggtgccaccacccctgtgaccatcccctacctgccttatcattccaccggtgagggacctctcaggtgtagctccttgttaacttccaattagtgatgggtaggatttacctgaagaaaaccgtaatgcgcttagatactagcaaaagggagcagaagtggggagtctaatcaaagtgagaggataaccctcaccccaaacttgctgcaggcagctgggcaggtcaaaattctgtgaccagacactatccttttcctctagtgattataaactttaacctgtgcagagaaaagatagtatctgctggcaaaatttgtacttactttgattcctctagtgcaagattatagtggggttatacctgagacttcaataaatgtttgactaactaaactaaaatagcttagggtaaggactacttccccaaacgcccttttaaacatgtgagaaagggaatctccctgacatactggtatggccatttgtagcaatatactgagagtgacttgggtgattttctggggcgatcaaccacattccatgagcaggttaactgtggaagacacctgcccttgagcatcgcgtttgggccacatgcgtcaatggggaaatttgtgtttccattctgcttcttgttttgccttcacaacttcagggatagaagcgtattccatttttagttaataatcagctctctggggcttccatgtaatgagtcagaaactgatgactgactccactctgctcattatcatgtctcccaaaaacaacccgagaacccactgtgtcaagtgaagctttaatttttcaggggaggttttctccattgagaccaatacatcttttcttgtgacagatccagttaccatatttccttatttttaactgtcgaaaagacagttaagctgcaacagagtatggtgagtttaccaattttaatacttgaagcaccaaacaaaggatcagtgttgcaggctgtctcttcttgactttttccagctctccttagcagataaccaggatgatattttttctgctttacaacatgatgaatgctatatctctatattaactctgaaattgaattgcagccaaatattcctctcagctgcattagaattttctaaaagaacatgagacacataaacttagtcttcttagttcaatgctatatctcagatatattgatatctgatttacaattaaaataggaataaaattaagtacaaattatatcatcagctttaaatattgatttatcttcttgaaaaaaaaaaagcgagtccataaaggatggcagcattggcatttctggatgtaaaatttcagggctatctcctagccatatcctttatggattcctgccagcatctttaaaaacacacacactgaagacacacagagaggttttgaggtattttataacaaaattataagaacagggagacaaagccacttactaaacattaaagtgatagtataagaagaaaatgatttgaagaagtcctaattgagggaaatgagcaattgtccacaaaacttaaccctgggttcccaggaaccggggtagtgatggtcatggagaggggttttagaatctggttatttaggaaaacatgcacactaacttgtttcattgaaaaaaacatttattgaggccctacaccatgcaaagctctatgctaggtgttttagttaagcgaaaaaatgtctaagataacttttgccttcaaggaacttaccaatcagtaggagaccaagacaaggatacaaatcactgtaatcctggacaatgtgtagtagacagagaggcccaacccagctacagtggtatctgaagagtttcatgccggagataatgttgagacaagttttagagaacaggcaggcgatacggggagagggtctttcaggtagtggaaactggaggcgtcaaagcaggcatgaatgcgggaggtgtgtttggggaattgtggagagtctgatttgactggggcatggagaactctcctgagataaatccatagttttgagaacttaccactgcatactaagttgtgaaacttgtatagacagccctccctatctttgggttccacatccatggattcaaccaactttggatcaaaaatatatggggtagggcaggcacagtggcttaggcctgtaatcccagcactgtgggagctcaaggtgggtggatcacttgaagtcaggagttcaagtccagcctggccaacatggtgaaaccctttctctactaaaaatagaaaaattagccaggtgtggtggtgggcgcctgtaatcccagctactcgggaggctgaggcaggagaattgcttgaacccaggaggcggaggttgcagtgagccgagatcgtgtcactgcactccagcctaggggacagagcgagactctgtctcaaaaaataaataaataaacaaacaaataaataaaataaagtatataggaggatgtgcatatgcaagtactactcatttaatatcagggacttgagcatcttcagattttggtatccactgggggttcctagagccaatcccctgaggttactgaaggatggctgcgtttaactgtaccagggatgttgaaaggatgttgcaaaggttctcagacaaggcaggatgtgtgcgtgggaggaagattgacagtgactgagcctggacgggggagaccaggtatgaggtctgaagcacctggaacagaaaggacaggacagatgtgggcacactgcacgtgtagaatcaaaggactgacagcaggtcgaatgtgaggaatgagggagggaaagaatcaggactcaagtgccatcctggctgcctcaaaaaatgatactgtcttccagagggaaaggaaagataacaacagttactgctttgtggcgtacatgtgatgaatttcattttggacattccagtaggatatccaagtggaaatgcccagtaagccttagacataaggatctggatctcaagagaaaaattgaggttgaaccataatatgtctttcccctcgaatcatgtaggtttctcttttgccttctttcattgccctaagtggtcctaaatgctactgctgatgctgtcttagtttgcgactgttgtttgcaccccaccttttcccaaaggtaatctgtagacttgcatggattgggttaaggtggttaacctgcagctttgctgttcaaagcttggcttcccactaccagtttgccaacttaatgagtacttcaacttgagtcaaattagtattgttccaaatatcctaatagtatcctctatgtgtgactctaggtcttacaaaatcaaggtgtcctttctcattgagacttccttattaataaaatatttcttctattaaattcaacctggcaccaagcatagtaggtaataggcacacacaatgactgtttattgaatgaatgaataaaatgattatgttagggcattctgagcaattcatcctaagcagctaattttctcctacttcttttattatagtgtgtgtttgtgtgtgtgtgtgtgtgtgtctgaaatgtcccatcctacaggttcattaatatttaatagaaatgaaagaagaaaaatacctattaagtgttttgatttcatccttttcattgaattgaaaaagtatatcatttattcctgaagagaaatctagattttgctctatattaaacatttgacatttattggtccttaatgctaatatagataccagcctgctggttgtcacattctatctgtttatacgaaggttgtagacacacagtgtatgtacatatgcctagttgctctcattccttttgtttcacatctcaagcctaacccagactgaaaaggttttgaaggctgagattattcatcaccccatcattatagaaagcagggctggcccaaggttctcacagtgggagcaaggtggattttaactctgatcagtgttgtagctcaaatataaaaagaactgcagcacaaaagtcacaaggataaatgatcccctcgttcttctcccataaaaataagcagccaattgaaggtggaagtcagtacagtgcggcattcccagaggcgacagaacctaagattccatttctaaagacactgctcaacaagaagaccacctgggatgtcttacataaaaccattggcctggcagcttttggctgagttctctattctggttcaagccagcatcacagcctatctgtggttttaacaactgatggaatttgtattttgagaaccctcatccgttagcatgaagcaaactcaaagcattgttgctcatcagttgtcatctgtttgagaaagattttgatttgtttacttgtagtgaagcttgaccatacttctccaggggctttttaaaaagatgaatgtgtcagcttgtagatttgtccccatgaatgaaaccacaagcaaattctcttctctcttccagcctcccttcctccctcttgtttcttcagtggccatctgtgcattatgttcccattgccaggccctcttcaagcagcttatctatgagtgaattcagaaacttcaaattataaaggacacccagataattggcctgttctccaaagtatctgtcccctgtgctgctgccagattccttcttaatgaatacatccagtgacagtgggattcttgagcttgtccgtatctgtgagaaaatgagctctcctgctttgtaacagcttgtggctcagggaaaaaaatgacagccattgcacaagtttcctttgaatgtagttttctttcccataaatgatactttgagaatacagttaaggggttattagttttctatttcatgcttggcctgtgtgtgagaataacacaagctgtcactgcaaatcagtagctaaaaatgctttgtctggttaatgtgaacatttaatatttggctcaattaaaaattaaccgatgaaagtacatgtcattggaatttgaaaataccttttgtacggaatacttaaagggcatcacccatgactaaaccagtgcttttaaaatatggagaatatggggaaatttaatatgagttgggatacttgactcttttttaaaacctctctacctgtttggcacaacagggtattgataaagagtgggctcattgttatggcaaaggattcacttgcatctctgtgtttttaagtgggtaattgtttttttgcactcagtcacatgattaaagcagacagaacaagagatcagttattcatttataccatacttttaaaaaaatattgagccaggccctggggaagtgggaagtgagagccagagcggcgtggctgatagtctagggcagtgctatccaatcttttggcttccctgggccacattggaagaagaagaattgtcttgggccacacgtaaaatacgctaacacgaatgatagctgatgagctaaaaaaaaaaaaaaagcacaaaaaaacctcataatattttaagaaagtttacaaatgtgtgttgggctgtattcaaagcctgccatggattggacaagcttggtctgggggagtgaagaccattcaacatcagctgcaggagagcatgtttaaagctatgagaagagatgcagcaatagtggtggcatttattggagtcaaggaagtcttcccaggaaggggactgaagcctgaaggatgagcaggaatcaatgtagtgaagtgggtgggaggaaccaagtgtggccccaggcagaacttcaggaacaaaggccagaggcaagcggccacatggtggactgcaggagctgaggagttcagcctggctggagtggagagtgcaagtgggtgggtcagaaagatgatgctagaggtggcccaccctggaagagtttgtttcagatacgtcaccctgactccactccagaccgttaatgagacgggggagaaatcagtgaccagatagaaggctctttcagcaaacgggcaagagatcaagtgcctgacctagaggaatggtagtgggaacggcaagaaattgctagctttgcacaatgattaggactagagtggagagattttttggaagaggtaatgattgactgaatgctttagaacatggctcagttcttcctcagctttgctggtctttctgtacaacttggaaagaatgtggtcattgttctggttatatataaatgcttttttgtgttttttgtttgtttgtttatttgtttgtttttggagataaggtcttgctctgttgcccaggctggagtgcagtggcaccatatcggttcactgctgcctcgaactccggggctcaagtgatcctcccacctcagtctcctgagtagctgggactacaggtgcatgccaccacacctagataatgtctgtcttatctttttttgcgacaggatctcactttgttgcccaggctggtcacaaactcctggcttcaagcaatcctcctgcctccgcctcccaaagtactgggattacaggcatgggtcacctcacctgaccttatacaaatatatattttttcttatttcacttttaaaaaattgtctggttaaaaactatttttgttagaattcaccgtgtgataaatctttattaactatcagttaataaaagtatatttgaggaaagaattcaattatgaaaggcagttttcatagaatttttttccgggtgaaaaaaatgacagtggtttcttgcctttacgtaggattttaaagtttctaaaaaaaaattccatatctgttggcccatttgatcttcacaacaaccctaagcaaggcagatattgtattccaacttctccctactttcctccccacacacactgttagttatttgtttatgcccatgtaaagaagaaagttcgcccaacaaaggtgtgtacgagccaataagcacaggaagagctgatattcattccctgggttgggaatcccgtagatatttctttatcctgtgctgcttctctggatatgtgttcataaagacacaagattgcttagtagagactgaaatatattgcattttgaaaactagtatactctactgctttctgtgtcaaaaatgttcagggaaattggaatgcagtcttttgtttctggttactttcccttcttcgattcagcctttgcagcgtttctcatgcttgcagcagagggggatctagctgcttccatttggtgcctaccatcagctcaagaccctgtgaggatgcgcttatgagccaggcgggcttggacatgagctgaagggacagtagtaggattgacgtgcgaggtctctaacacttgaaggccctgtaaaacagcccctttcaacaggggccaattggaattagatgaacatgtgtgactgtttttgcttgttgacacctgactagcaacggtgttatgttagcatgctgtttgctgcctttatttctttgaattcctcagagtccttatttattattttcaaaggttgtaattagctttaatcggaagtgcccgtaagtgtagtcctgtaaatgttgctcttccatctttcttttttcttttcccaagaaaatgccgcattggaccatcaggaaaaataactaatgggtactaggcttgatacgtgggtggatgaaataatctgtataacaacatccaacaagtttacctatgtgacaaacctgtacatgtgcccctgaacttaaaagtttaaaaaatttaaaaaggatgtgaaacaaaaaaattaaaagaacaaacactaataaatatgaagaagtccttcagagtctttaaatttgctcatagagcattgactgagacactatctcctttagtaactaaataaaattaaaaaaataacactgggctcctctttttaggtgaccaaaaatatttggtacatgttttttgaatgttgaaaatggtggagccttcatcagtagggtttccgcagtagtaaagggcatgttactgcaagttcattcaatcaacaaatatttataaatatttgtttactgtaaagagcctactctgggccaatcattgttctaggggctggagctataacagaaaacatgacaggttaagaactctcccatctcttgtgaatcccacattgtgaggaagtcagaaaagtaaacaacttaaaaattaacaatataacataagggccacaaagtaatgaaaacagggcaatgcagtgcaagggtgctgatgggacaatattaacttcttccttggtctttgagatttttcaagcagtactacaagtttacacagaggagatttaatgggtttttcttcattaatagttgaaaacagtgttgtaccttaaaaataataaatgtattagtataatatagcccttacatcagtttaaaatgagttaccatgaacaatatgaacttaaagagacttttactatttttggctaaaatgtttagcgcaatcttttccttacctactcatccttctcatttccccatttccatttatgacaacattggtcattggcctcagtcaccgaaagtcaggaggaaggaaggaaatgaatatttattgaaccccaatatgtgccagaccctggatttaacacttttagggataggagattatttaacctcaataacctctccctgagggcaggaagtggatttatagatgcggaaacagaggttctgcaaagtcaattgactttgcctggtaagaggcaaaaccagcatcctttatttaggcaatccaagtgatgttcatgtcctctggaacttaaatttttaaaacaaaaatttaaacagaaacatattacaaaagaacaactttatgcatgtgaccttttgggttctttaggaagccagttagtcatctttattttaataactagaaggtgaaatctttcctacaacatgtaattttaagttctctcatagttaaaaaataaatgaaacaactttttttttctgtctcccttttgactcctagagtctgtttaaatagcctttgaaaaataagtactaatcactggttcctaccaagaccagacacctgattcagaagctcttacaggggtcagagtgtgcgttggaaaaacaaacccacagtgccttcctggttccagagaaatgatctcactgtcaaattgtaacctgcctaataccttaataaaaaggtggggaaagtctgcggttttacctctggtatgatccttttcccttcactctttttattttaggcatgaccttagtgttttttttcttctagagtccagaggtggaatgacatgtcactcaggtttacaagatgaggatgtatctgtttttatattcagctgtacattttattctacttaaaaacaaacccaccttcagcaaccagggcgtatcaagggagagttatttccatccccctcagtttaatttggatacatttggcccagaacagcacagtgtttccataataacatttgaacaggatgcccttgtgttatttgcagggctaagggagtttcagcatgggccaggaaactactttcttaaaagaaacttaaacgcgaaattctgacaagataggaaactcttactgcatccttactaaacctctttttcccccctactttctcatttatttatatatctcttgtgttatgaaacatatataggttgaatatttaactcactctgaattcatgtgcagaataagtcactcttcagaaggacaaaaataatgttttaagtggtttgtttaataaagcacatattaaaaaatttcaattcaacatcttccctgggcacaacatgttatgactttttagagtagagcttcgtggtatttcataaggaagccaaaaaggaagggaaattattattcgggcagagggacaatagtgacctttcattaagcaagacagagttcaccatcaggctccccaaaccccaggctctgtgttagttgaactgaacaagccaccaactatttcctctctctctttctctctttctctctcttttttttttttttgagaaggagttttgctcttgttgcccaggctggagtgcagtggtgcagtcccggctcactgcaacctcagcctcccgagtagctgggattacaggcgcctgccagcacgcctagctcatttttttgtattttttttagtagagactggttttcatcatgttggccaggctggtctcgaactcctgacctcagatgatccacctgcctcggcctccctcccaaagtgctgggattacaggcgtgagccaccacacctggcctcctctcttttatagaccagactactttaaaaatattcgtccaatattacctaaaatatttcatttataagacataacccaacattgtaatatttaaaagactgcattatgtagtttttacatatccttaagatcctaatgaattcagataatcagtatttttgttcttttaacagctttacatgtgacctcttagttctagagtttgatctcaggagaagggaagagtagatttggattctgtgccgtggacaggcgcactggtttcccgtgtgaaaaggacaaagccccgccccttctggagctcagttctctttgggattattcataatgttctccaagaagctcggagtgcctgtttgtcgccagtactgtaatttgtgagtaaaagatctttatgattgcaaaatacattagcgccttcggagatcattgtttcttgatgacggtgtgaatcacaactaggaactaggaagtcatttcagccccttctgtgcagagggatgtcatgaagtacatatgctaaagttcatacccattgctcataagagctcagccaaccttctcaaccagttcatgtaaaaatatatctgtataaatatgcatacgtatgtatgtatgtggtgtgtgtgtgagttaagatatacataaaatttacgttttccaccaattttaaatgtatagttcagtggctttcagcacatttactttgttacataaaccattattatgtaagccattactgacatctgtttccagaacttgttcatcattccaaatggaaactctacccattaaactataactccctgtttctttttctccccagtcctaggtagccactattctattttctgtctctataaatttgactcttcgaggaagaatttgattcttcccataagtggaatcagacaatatttgtccttttgtgtctagcttgttttatctaacatattttcagagttcacccatgtcatggcatgcatcagaatttcattcctttttaaggctgaataatattccataccatttgcttttttaaaagtccattttctcaaaaaattggttgtcatttccactccccacccagccaatagaaacagcaaatatattaaattagaattgacctgacagaggaggtaatggaggcctgtaaattattcaaagaattattttagagtctgacagcaaggaagaagacaaaaatgctcttaaaaccagctcaggagtctctgaggctcttctgcgtggggcaggcagtcacaaagatctctacggctcctggagttctcgctggatcgtagcacaggacaatcttagtgattcctaatgatgccactgagtcatcaagacagagttattttctgtaggaagagtcaaagagttcagggaaagtgagtagtaagttacagaaatatctccattccaaatggttaaaattttttaaaagtttaggcttcagtcatctgaaaaatttacttgtgtgaaatgattcagtccagactgtagtgaaagagaggaatcccagcaatatcaaagtaaaatacacacacacacacacacacacacacagagagagagagagaaggagcacaagatctctttcttttttgtttttttctctttttttttgaacaaactcttacatatccttcaagcccaggccaaatggcaccttctctgtgaatgtgtgtgtgttaaataggcagagagaccttcaggggcgtttgctgacttctttcattctttttcatctcctacctccctttctagagtagagaattagtaggaacttgactcaagtggacggggatgtaatttctagggggagtttttgctgtcttactgcatctaaattattctgtctgtgcataaattaagttgtacacatatttagaagagccacctcccccactgcaggatgcatagagtggtttttgtgaggagctgctttgcagcctcaactctgcctcctgacttcattttgaaaccactgtacaataaaacgtggtcatttgtttgttccacattctttgtgcctactgggtttctggacatgatctctggccttgggggggacagtctcctggggaaacagacacacaaacagatctattacagtccagtgagttttttcctgggaaagttaaggatggtttcacagagaaggtgccgtttggcctgggcttgaaggatacataagagtttgttcaaaaaaaaaaagaaaaagaaaaaaaaaaagcaagagatcttgctctctggagaatgtgaaagggtaccatatgcaaataagcagagtaattgaagggcctgccaagcttgggaatggcaaaaaggccagagtgaccagaagagaggcagttggggatggaatggaaggggatgaagcgggaagatagtggaggctcgctctccaaggctctatgtgccccactaaggagtttgattagacctttcctgcagtggaatgccagtaaaaggtttctagcaggatactaagtgacatggctggatttttttgttgatgaaaatactgctggtagcagtgtgttggtggcactgagggcagcaaggaggccagatgggaaggtggggtcaggtgcccaagtgaaggtgctgggcagctgccccaaggcatgggcagtaggaactcccaggatgggactacctgaaaaggtgttctaaggtagaatcaacaagattgtgcacagttgatcatcgctgaacactcagtgcttagcgcaaggcaagcacataatagatgctcagtaatattgactaaatgaatgaatgcacaggcagctgggtacacatgacaagcagtacaagcaagtgttaaagtgacaccccagctatactcacaacagtgataaagcagaggttcacatggcctgtactttgcccgactctttctaaacgttctatcactattcgtgtatttctttcttacaacagtactgggaggtggtggtgtttttatccttgtcttgcagatgagaacactgaggcttgcagagggggacccattacagctgtttgggtggctgggctggaatttgaacccaggcggttttggagtacttggagcccttaattctgttgctctgctgccgcccagcttttgagccttccaggaagctgctgctttcaaggccccagaagtgatgactcggggcaaacctaagtggtggcaggatgcagagaagcctgtttaggaaaccatttatctcacgtagacatgccatctgagatgaccttagtagaaataacaatggcaatgataacagctccgcagccttttccctggcataagaaactagttttgtaatgaaaatggaatttctctggggaatagtcctagaaagagataggtagttgagataaaaataacaaaatataaaatagcattgcattgttttctgtgtatttttccttccacctttgtccttctctgttgtgtaatttaccttgttcccttggccatgggtaggttgggcatcactgtgatttgacttttgtcctttgtcccaaagaaagggatgagtgtgtgcatttagaggtagctatttgcaccttgcctggagcttgccatcaacatagctagctaaaaggaggagaggcccttgagggtaaaccttgctttaggagtcgaagcccttggctttctggaatgaagggtggtgagtttggtttcccagatggcccatgggccagaatctgagctccttggcattcaggtgtgtgtgccgttctggatcattacaaccacgactgagctgtgttttcaagccataggtcagagtcgtgtaaaataaactcttgtcataacaaaggatgcggcagccagattgcagctcggagttccttcactcatttaccccagaggacactgattttcatgtcagcatagggaagagattccatttgtctgccgattctaattgggggtctgtcttgctcgaccaccctggtaaatggtgataaatactggtggccatagcagcacagagagagagtgccggcctggaaacccagccaagctctcttggctccaattttatgcaaatttgcctaatagaatgcaaatgatttcacaggaatacggatcccagggacacgtgctcatctgttttcagcagtgttcctgggcttttagaagcagccacttgagaggccaggcaagtccacagagaggcaggttaaaggtggcttgcgaaggaatggctcaccccatcagccgatgccacgcctggaatttcattatgagcagcggctttccctttggcagtctgcgagccaagacttctgtgttttgggaacaggaaaaggtcaacacagactaatgctttttcaaaaagtcctttattcttcctcttattctacagattttctgcgatcacagtatatatccaaacatttactcatcctacacatcttgattgggcatttagtcactaaaaggcactgtgctaggcactgagaaaaggctgctctgtgccaccaaggtgtgacaccataacattgtgtctaaaatctactcctgccctctccagtgccgtggctgtggctaccaggctcacgtaatgtggccaatctgaattgagatgcgattggagtgtaaaatacacaccaggtttactggatttcaaagatgtagtatgaataaatgaatgcaaaatattttatcaataatttttataagaattttgtgttgaagtgatagtattttggatgtattagtttaataaaatatactaaacgtgaccactaaaaatttaaaattacatatgtggttcccattatatttctttctttcttttttttttgagacagagtttcgctgtgtcgcccaggctggagtgcagtggcgtgatcttggctcactgcaacctccgcctccagggttcatgccattctcctgcctcagcctcccaagcagctgggactacaggcgcccgccaccatccccagctaaattttttgtatttttagtagagacagggtttcaccgtgttaaccaagatggtctcaatctcctgaactcgtggtccgcccgcctcggcctcccaaagtgctgggattacaggcgtgagccaccgtgcggggccggttcccattatatttctattggacagcactggtctagactgctaaccatttattgcacaatgtggtcacctttttattcccatagttggatattactatataggaggatagaaagacctttccttttttcttcaatgagctacagttgtgtagccctttttaaagttcattcatattcatgttcttgtggctcccattgtcagtctgctgagctgggcagggaaggcctcaccatacttttacaggtgagcatactgaagtgtaagaggtcactgttgccagcctgccctaagagttaagccaagaataaaacttcagtagtttctgggtggacgtggtggctcatgcctgtaatccccgcactgtgggagaccgaggctggaggatcacttgagcccaggtgttcaagactagcttgagcaacttagcaaaaccctgcctctacaaaacacaaaacaattaagccaatcatggtggcgtgtgcctgtagtttcagctgcttgggaggctgagatgggaggatcccttgaggctgagatgggaggttgaggctgcagtgagccatgattgtgccactccactccagcctggatgacagagtgagaccttgtctcaaaaaaaaggacttcagtagtttctaactcttgccaggctggaccattacagctgggttgggaaggttggaaatagaactttcgacttctattctagtgtctattaaaaatacactaaaatttatgcatggaaatatttacttttatttctgtaccaaagatgatagaacacagcccacttagaagtatttctgtgtgcatgtgtatgtaaatacacacaaacatgctctgcagctggctaataaaacacagtaatcaaagcctatagtggatattcagtgtaaaggtaagacttgctgaattttgaggcccattggggaagggcagggtcagggtgagacaagcatgtggtcacaaccagggggcgttttcttctgttgggagtcaactactgttagggaaaattcctggcagcgtggagcaaggttggtggatcccacctgtcagaaaatcctgagactgggtttagtccttgagggatggaaggacaaggcaggtaccctggaccaaagaggcaagggatccaacccaggtagtcacccagcattggggatggcttaggaaaaaggttggggaggtgcagttctaaggaagaagagagaattgatcaagaagaggaggtggatatgggtgagagctgtgtagttgttgaggacatttagggcaacgggccttgggttgtattcttctgacccgccaggcacttgctgtttgggcatgtcatatactcttctgagctttcatttcttcatctgcaaatggggaagttgagttacagggtccctcactaacattttgtgattctatgagtttcgaaggccagagaatcagcaagaattgtattaataagctatcaatgatggtataaaggttttgcttctcactgctgctctttctgctgtctgatgtgctgggggcactgaggtctatggcaaatgagatcattggcctggaccattcacttggcccttgacagacacaagttgggtctaggatttctttgcaactatagccaatacatacatattgtagtataatatctaaaaacatttatacctacttgtctttcttggttctctctgttctccttgtccctacactttctatgaattataataataataataattattactattattatctttttttgagatggagtctcgctctgtctcccaggctggaatgcagtggcacaatctcggctcactgcaacctctgcctcccaggttcaagcagttctctgccccagcctcctgagtagctgggactataggcactcgccaccatgcctggctaatttttttttttttttttggtattttcagtagagatgggggtttcaccgtcttggccaggctggtcttgacctcgtgatccacccaccttggcctcccaaagttctgggattacaggtgtaagccaccgaactcagccaaattataattatttcttatctcctatcttcagagtctagtgttacacagatagtaattctccaacattgctcatatgatttagtaaatcactgcatgttctcggtttagaaggattttccctgtcttataccttctatgaattaaaaagcttttggaccatggatgaatgacataagaatttaactacttttttttttcttttcttttgaggcggattctcactctgtcgcccaggctggagtgcagtggtgtgatcttggctcactgcaacctcagcctcccgggttcaagtgattctcctgcctcagcctcctgagtagctggaactacaggtgtgtgccaccacacccagctaattttttgtatttttagtagagacagggtttcaccatgttggtcaggctagtcttgaattcctgacctcaaatgatctaccggcctcggcctcccaaagtgcagggattacaggtgtgagccaccctgcccagcctactttttctttttaaagaatttattttaattgggtttcgtaaatgcagggatacaaaagctattggatcttgagatagctttgtattttgtagagaatcatcccaggagcacattccctcactgagggttccagccacctcttccgcctcattatactttgcttagcaccgagaagtctggcatcgtttctgttggaatgaaaagattggcagagctgccctggacaacagcactgcaaaacactgtggcagaaggtttggtctacataccaaggcagccaaagtattaattgcattctctgtgatcacaaaataaggcgctgaattattctcttcatgttttaagaatgacaggcttttgctctgccagctccaagcatagtgcatcacatggaaaggagatgctagatttgcaaaaaaaaaaagagaaaaaaagcacaggagtgaagatctctggtagccagctgcttcctaaaaaagatttaaagctgaactgttgcatgagaggtacctataaaagatcaggagccgggtgaggaagtgtttccataaatttacatactctgttaaaacatgttctattttggaatcttactttagattttgaaatgggacttttcacgttgctggctatactttgatcccattttcctttgttttggtgtatttactggagaaaactggttatgatatttctatatgtacttgtctccccccagccccagaacaagcaccatatgtgagtattccagatatccaaggtcctctggacaccccagtctcttccacaaagctgcctcctcagagcctgctgtcccgtcttctaggaatgtacccatttgaaaacccacactcacactaccacaacacatacactgtttcttgctggtcgttcctttaatctcagtggaagatatctcatagagaactgttggtgattgcttaacttggttgggaggaaaatagatcaagcaggtgacaacctgcatattggggattttcctatgctgaaaattgttattctgttgcagcactccaccctcccttcacagccccaaaaaagagaagtacgagtgctgctgatgttcagggtttgaatatgttttggtttaagatgttcagtggaattagagagaatttcatcctgggcagtgcagtcaggctggaggagtattttggtttcatattactaaaccttgttttcccatcccagctgcttgtgtgctatcttggggccactgagaacctggctgggctctgcggggtgggagtgttgtcccggggctgagtccagccaggggtgaggtcgtcttggtgcacatcttgcacgttgcatgaagctcagagcccagcttggctcttgtgaacttcccctgtggggacacaccctccaaccaaagtgagggtccagcggccaccaggttgtgacatgagagccgtcgctattattactcatcacctgcagcagcaggaagggtgcccagaccacagaaatcttctgtctctgggcccgtgcctactgcagttggcagagagctcctgagctccttccctaatgcgtggtgggagagcgctttcttcagcactttcttcacagggtttcctgcagtgggagtcttcctgatgctctttacccccatacttatttcactcccagaatcaaggagaactgttaagccattcctcagtacgatgtgtcatggctgaagaaccattcattcaagacattggtgaagagggttctttcattgcctttcttcaacgacggtttatttgctgtccatttgctgagcacctgggtggtgccaacatgaacccatttccttctgtgcgcaagccccccctttctattaccagagtgcagatcccagctagcatggtacgtgtgagtgcgctgtataaagtctggaaccacaattagaaaggaaagcctttctaaaggtattttgtcttgatattcattaacctattagattgccattctttcatatctaagatgatcataacatgtctcatccaagctgagacacttgttattaatcattattctgggacaatagggtaggccaggatggtcccaggcaagctgatgtctagagtaataaccctgcacatatgaatcttttgaaggattgggcatgatttttttttttttttttttttgcactggggttggctggggctaggagtttgtgatgaatccttccagtatttttctgaaaaccagtgaactattttgtaggtttctgtgtcgttagaaacatgcaaacctatccactaaaaccactccagttgatctattaagtcattcgttaggtcttacctggactctcttcactgtcactatcatgatctgtccacatcactggccctttctcctatcacctagctctcctgtgagcccagcactgatataaagtggtttctagtcttcttggactctcaatttaacttgcttcccatgggaatcttctaactgtttccccaaaccaccttgtagacattcatttctttgtttaggattctaagaataggaaagagagacataagctagattccattcctgtttcagtaagattatctttccaacacaagaaaggaatacatctaaaaaattctttcagcattttttcccgctttattgagaaaaaaaaaaaaagaaatactcatgagtactccagggcctcggttgatagtgtgacaaaaatagttccaactaaactaagtaactcaaggctatttgctttatctttgtactctttcatgtgttcccgagtcttttacagattgggatggtacactttggtttaaattgcaaactcttgtatttaacttcctctgaatgattcaggacggggctgtggacctgttgacacttgatgagtattggtttctagtgcaaatgatgacctgttgaagggcatcaggcatatctgaaggtagctgtccaactaggtcacgttcccatcaacactgtattgtgaatctttggtaagaagagtgataactttttgcaaaatgtagtttttaaaaataaccgtgaacttcagtgtccccagtcaaaataataattcatttggggaacaatttagagattctttcgacaaatacagagaaatggaagccaatcatatgcgcctcaagcatttgatattggaagaaaatcagcatctactaagtaactcttgtgaaaaccttatccattttttgcttttttgcacttttcaatctgcagcataaattaggccacaggaaaaggatggcgtaccttcaaagagccagttgggttggctgtgttctttctattcgtggaaaacagctgtgggtgccgggtgttgaagtcaggcttttgttccatgctaaggtaggaaggtttgttcttgagacctatcactcttctgtggaggaggagttcacagatggtgagccgctttatcaccatctcggaggcttttgaaatatgttgataatgacctgggaaagagggccgagtgggatgagggtgggagtaggaaagaaacattcggcccacacagtgttcatatcttctcttgtttttgtatctgtggcaactgcagattaaatgaattaggttattcttttccattgccttctaccaaatagaagtacttatttaagccttgcagatttttttcctgctgagtgaagcctgaactgagcccatgaaaggtgatctctccaaagcaagggctcctgtttccttccttccatcctgctatctcattcaagtgaaattcctgccatggcatttatcctgagctttgtcacacaggattactgtgatggtccttactatgaatggagtgttaaggtgttttctttagctcgagataaaaaccagttttaggaatgaattctcttttgctgtgaaaaacatgttctaagggaacaaacctcgcctcatttccatttttacattgagcaaatggttgggaagttcctttaatactgtctgtcttgactcattgtctcactttttttttcctgattctcttgtgcgggacctttttcatccccacagcttccgtatcgtctgtatgcagctgattctcaaatgggtatttctgcaaattccagttctgcttatatactatttcctgatgaccctttctatctggacttcctgttggcagttcaaattaaacacataatcaaaatatttaatccaagactaaactcatcgtcatccctccaaaaccttccttggactcaacagtttctcttcctgctctcatcactattccgatcacccaggctcaaaacctagggtgcattcttccagcttctgctcaggtttttgagcccagcatccttcactgccctccattcctccctcactggtcttgctgccaccaccttcttaactcttccctaggggaattcattcacctgctccagtttctccgcactccagtttatcttatactttgtgatgatttaattaaaattcttccctgattgtttttcttcttgaggtggagtctcgctctgtcacccagctggagtacagtgggaccatcttggctcactgcaacctccgcctcccaggctcaagtgattctcctgcctcagcctttcaagtagctaggattacaggcatgcaccaccatgcctggctaatttttgtatttttagtagaggcggggtttcaccatgttggccaggctggtcttgaactcctgacctcaagtgatccacctgccttggcctcctcgagggctggggttataggcatgagccacccttttttttattttaaggctcctcttttcctaggtaagtcttcattttcctttatccagctgttcaaattcctctctccatctttcactgcaacctatgtgacattttcttcatcattccctgctactccttagcaagattgctatgctctgaacccgccctgccttctctgttctggggatctttttcctgctgtttttacatcccagagtattctgttcccatcagaattctccatcccttaaggcccagatctgatctcaccttcaggatgacagtatccctgttgggagtgaccccgctgatttctaaatctttaccaccttttcagcctttttctttttttttgtgccatttttccaggccttgtcacatgctctttgatattactttgatatacaaatgtttgctatacttttccttcttcctcttccaggttataaacatgttgaggcccggggctgttttctaagttgttattttaggcttgtgtatatccaccaccatgccttaaaaaaaggcctcacattagtaagagctcagtaacatttgctgaatggatgaatgaagtatggtggctttgctatctcttactttacttgttcacttctctcctagcttcattcattcattcattcaacaattacatattgagagcctattatgtgccaggcactgtgctacgcatgtaggtttatcagcaagcaaaacaagatccctgcctaaatgtgccagcattctagattcttccttagactcaccatctttgcattcactttactcagctcttaaagaaacagtagacagttattgtaaatactattagctttatatttatgttgttcttctgtgattaaactttgctgccaagaacattatgctttcttggtagtttgcaacttgagtttctgattcttaaaattggttgcatatcccaatggctgtgatggtgttgaaaactctacttcttttctccccttgactgctgaaccaaatcattttccaagttgctctgaaatatggacaaaagactccttgatttcagccctatgtgcagcatggaaactttcactaggctgtgcctactgactaatagcaagtcaatgcccatcttcccttggttgcttgctaaatattctaaaacgaaaacaaaacagcagtgaattatagcctagcatcagtaagaatggaaaacaactgcttttcaaagcttgatttgtattgtttttaataaggaaggaaaagctttgttatataaacacatgaaaatatggtagtgttcgtggcaagtatgttaatggataatgtgcctaaaatctttgctgggtcagtgtcattccctctttgtgatgctgaaggaaagtcacaaaacaaaaacaactcagaagaagctaatgtgtcatcttcatgtagggatctgtattcaaagttctttttcattgtagctgtaatgaaacagtatttgtggaaagatattgcactcaatgccaaaacccaacaattttgttttcaaattcctaaaaactaaaaaaagaaatcttggtgacataaatgttccaaaatcaaaatgtccaaaatgaactcatcaacttcctcctctcgcctgctcatctatgtctgttctgtctgcttaatgatatcactgtccacccagacagagccccaaactcttaaatcattttcaacttggttttctcatctgtgagatagagctttcctggatcatctcttaagattctttccagccctgaaagtctgcatatctgagttcttcactcatactccccacatatctgaatcctgcttctaaaagtctctcttccctagatctctggtttttaggtttttaaaattattttattatttttttatcctgctgctgctgctgctctaattcaacctctcattccttcttgcatatgctgtaacctcctagccagtcttcctgtcatttcaaaaattattcttaagtttacctacagtaaaattcatcatttttgtgtagctttgtgggttttgataaatgaacagagaggtaaccactactctaatcagtatacagaacaggtcagtcaccccccaaacatatttcatgatgagagtttgtactcaaactgcccgccaccccctaacccttagccctggcaacttctcttctcttctatatccctagagttttgtattttccaaaatgtcatagattggtatccttctctttcagcacctgttcccagcccatccatcctcttcgtcaatgccatttatcttcctaaaacaactctgttgagcaccttgagaaacacttagtttctccaagcttcagtttccttgttagaatgtgacccagccagagtataaaataaggagcatacagaattctaatactttctaaggaggttggttcctgaggaggacccttcatcttgctaactggggcaactgatgggcagatcagagaagcaggaagtcactctgagtaagaaatggtggcctagagctcttgtgagaaaagggatccaagaagggggtagtagagagagaagtgagagacggagaaaagagaacagctgccacaagaagcaaaacgctggagagggacagatgtctacagaagatgttttgggacagttttgctgttgaatgagtgccagtatccttccatagtggcctcgggagacctgtagttcagacccgtgttgtaggaggtgtcttttgaatgggtcttattttgaggagggacccaggagacccagatctgcaatggggataatgacatctgctccatgcaatcatcatgtggggatcatggggtagcaagataggaccctgcctggcagagattgggcaccaaggactcccttcccaccatcctgtgccatctctgccttctctccttacttcttgcctctcacctggaaactgccgcaaaccaaatcctcctacctccccttcaatgaccttcagaatgccagccctgaaggttggctcagaggtcattgtataccaagctacagagtttggtgtacagctgaccttcagggctggcaccagcccactttccagtctacctcccattaaagttctctgtcctccttactttctgctcccaatcctcgcccctactcctgccctaatcttacgtcccagctacgttcaactcctttgttgaaccctcctgcctccccttcaatgaaaattaacctatcctttgtctacattcatttcatgtttattcattttgtgtctacatccattttctgtgtatatatacaataggttttgtatcataattattcatgtctgtttggacacccctgcccccaactgtgtaaaaggtgctcaattcatatttggttaaatgaaatgaattcctaaataatcacagcaagtttgaacctagtgaaggaagtgttaaggcatttcttttacattatgctctcattttaatgtacaagtagcatgccagctatggggcaggttttactcttccagatttcttgtggttgtcaatgcatcaggcagcctgtttccaaacagctgccatatggccaaagctcctcaagtgacccttttatgtgtataagagcaggacatagttcagatatacccaggagaagtaagggcattgaaaacctcccaggctgctgttgcagaaaggacagggagaatgccactacctggaggtgggaaactggacgttgctatacctgcccctccatcaccatcacatagtttgtgtgctgtcaaatttaagttgccaacacaagccatggaccacaaagacatgcttgctaaatcaagttgagtgagatgcacttctagtactttccaaacccatgctgagatgcagaacccccagccccatgcagacagatttgccctgcatggaaacggtgcaccctctcccgctacacactcagagatgagaggagatgagcctgtttgtgaaaccaaactcaggattctgtttttgtgtaagaaccgtaccacatggctgacatatgttcagtccatggctggcagaagcctcctgaacacatcccccatccagtacctccccggcagtgacccatctcatatttgcatatgttcccctgtcacaagattgtggggagggtgcagtttgcagctgactccttacctagctacagctccaactaagggcgtgcattcttggggagatgttgggagcatcacaaggtccccttccgttcccagaactcagtttcagaggtcagccagaaagagaattccagaggtcagccagagagagaaggtagcaaggacagagcccctactgacatttttcttcccacccatcccatctccagggcaatggtcttcagcagggaacaacgggccctcattccctgccaggggagctgagtacacacaaactgctggatgggcgagaagttcccccagtgatctttatttttccgtttagaaagaatccttattccagccccttctctccagctgctgcgtgtgagcctgtctctgtctcttgggtggtgcagctgcaggtgagccagctgtgggcggccctgaaggacagcgaggtagggagcctggttgtgaggtctctgctccctggggatgctctgcagccttttgcctgcagcaagtctgaaaccttccatgcctgactccccctttccatttttttcctggcgtctgcccttgctggagtggagcatggtgggagccagcccctggagccttccaggattctcacagtctgtagccagagctgtgtaggcctgacctgggcccagcgggaggaggatttttgaataaaaaccagtggttcctctccgtccaaaccccccacccctggaatacattgcaaccaaatatttactcaaggttcccccttgccatttaaaaataagatgcttcacctactagcctggcggtgttctctgctctgaaattttatgctcttgagtcatacatttgaaggtagctttttttggatttaaaatttcaaactaatgaagttgtttaaagtaccctgtcgagtgctgggagctgcttaagcattgccacataagcactgcagaggctgggtctggcgcatacatgccaggcaaagtctgccttgtttcaaataaccccaggaagagtctctctacctttggtgcaattcagatcttaggaataggacttctggggtcccctgtttggggactgtgcttagcacacacacttgggtccttgcatgaaagcctgcaaaagtatacgtgacttcctctcttttctcctcaaccactgcacccctattttggggtattcttagacttcttagtggggaggcagaggtggttgatgatgcgctcccagtcagtcctgtctaccttcttctacctcaaagggcttccattaacatcatccaggaagtgttataaatcctgccacccaggccacatctcagaccaatttaataaaaatatctgggctggagaggggaacccaggaattagtattttttaaagctcctcagaagtgcccccaggccaaggctgccagcaccatatccattcgtcagcgcgctcagggacacactggtaccctgtgtgctgacctgctgcagttagagtgacaaaagccggattttgattgtccagaaaagtaagggttctttgctgtcgctgtggagtctccagtcagattttccattggaataggaaacaaacgccaagtttattttaaaagtgctcttgatctacctaaaactaggaagcaggaagaatcctcggggagcagttgagtctcacatttgaatgtgtctttgcttcctctgaaccaaacttcatggtttcatccattaccaaagaggccctggtgacttaggagggatagaattgaactgaaaattccgggatcgctggaaaagtgatttaaccagtttttcaccacatagggaaagttatttggtgagataacagacctcgaggccctgcactcttctgcgtgtggttctgggttgggatacggttcccatgagcagaagatcattcctggctgattttgttcagtgattatttgtttaaaactttaaaaagaagaagcgcagatacagtacatttgtactcagctagccacgcaaacatctttaggctaagaataataaacaaattagtggtttgttttattaccaaactggtagagtttcacaggcaggaaaagacggtacctcccaggctggagaaggttaagtatttttgtcaaggaagattaaaaaccctaaaagcttttggttgaattttactgaaatcagaacgtgaatccatttgagagctagcaaccaaagacccgtagaggtgacatggaatgtttttaattctgagagatgggcgtttcagaactcggaaaatgacatttgttttgacatttggtatttttgttgccatacttactgcctttagttcttagtggaagtagtttgctgctcctaattacccaaaaggcaagaaaaaaataactagaaatttttcaaaagaggggaaataggtcttgaaagtttcattaattgcaaaatgaaattaaatggagcattcaatagaagtacttctcagaaccaatggagaatttctcagaaagaagcccattaaagctggattctctaaagcagtggaaatcccaggaacaaaagccaaatgcctgggaattgagtttcagaagaatttttgaattggtacagatcagtaatttacaaaatggaatggaatcactgaatgttctaaaatctgttcagctaaaatgggataataaatttagcttacatggaccctgcacattcaacttgtgctattatgatatatatatctatatatatttactgctatttattaagcattttctgtgaaccagggcctatattttgacatacatgatcttactttgtctaattacaaagattcagtgcctttcacagaagtcattagtagattttgggagggtcgtgttgatgactttttggtgttttgagtaagtaaaatgtgtaatggcatttgagatattgaatgcttgttaaagctgaccttgaaaataagattttcattccattgccgtgctttacaaatcaaactgccatttaggagggaaaaaagacaaataaatgaagtcaactttctttatttcttaaaccatgggttaaactgggtatttggacagatcgttttcaaggccactataggatacttcaggcaagtattttgaaacttgaaagcatttctgataaacttccagggaaaattctgatcttttggtccatgagagaaataactgctagttacaactctggattggaatcgcagtttgaagataatcagaactgcagcttaaacatcatcaaagagtgacctgtagcttagctttcttaattacatgtgtcaagaacttgtgataacagacctaattgaaatgacttattgagtcaggtaacatttatgcccttttaattaactataatttttaatttacctgatcagcattaagctcactttagccgacaaaaggctatgggctacagtcaaattgcaaatagaatacttagtaaatgtgatagtattagctcctactatggactaatattagtttggtcttgaccagaagaaatccttgtgcgtatttatgttgaaagatgaaataacttactgaaattgttaatgaagtattggataagctactttaaaaataacaaacccgactaccagcaacaacacaaataaacaaaccgtcagcctaaggtggacatgttggcttctctctgttcttaacatgttaaaattaaaattaacttctctggtgtgtggagatgtcttacaataacagttgctactatttcttttctttttctctttctttcctctctctttttctttctttctttctttctttctttctttctttctttctttctttctttctttctttctttctttctttctgagacaaggtctcaatttgtcactcagagtgaagtgcagtggcatgaacatggctcactgcagccttaaccttctgggctcaagaactcctcctgcctcagccctgcaagtagctgagactacaggcacgtgccaccatgcccaactaatttttgtatttttttgtagagacaggggtctcactgtgttacccaggctggtctcaaactcctgagctcaattgatccacctgtctcagcctcccaaagtgctgggattacaggtgtgagccatcacgcttggcctattgttagtattttttaataatttttttaaattgtggtaaaatgtatgtaacataaaatttatcatgttaaccgtttttcagtgtacagcttagtggcatgaagtttcttcacaatgtcatgcatccatcaccaccatttatcaccagattatttttttcttctcagacagaaactcaggatctgttcaacagtaatgcctgttcccccacgcctgcagccctggcaaccaccatactactgtctgcctctatgaacttgactactctaggtacctcgcataagtggactcacacttgtgactggcttgttacactaagcatgatgtcttcaaggttcatccatgttttggcctgtgtcacagcttccttcattttgaaggctgaatgatattccattgaatggatctactacatattgtttctccgttcatttattgatggatacttgagctgcttccccttttggactaatgtgaataatgctgctatgaacggtatgtacacatatctgtttgagtgcctgctttcaattcttttgaaattccacttccagaagtggcatttctggatcctattgtaattctatttttaattttttgaggaaccatcatactgttttccatagaagctgcaccattttacatttctaccagcagtgtacaagggttccagctgctctaattcctgaccgatatttcttattttctggtttttcaagatggccctcttcatgagtgtgaagtggttaacttattgtggttttgatttggatcttcctagtgattaatgatgttgagcatctttcttatgtgcggattggccattcatttatcttgtttttagagaaatgtctgttcaagttctttgttgattttttaaaatcaggttgttttgttgttattgagttgtaggcgttctttacatattctggacgttaatccgttatcagatatacaatttgcaatgctaccatttcttgaggcttacagtatgccagatgttctactaggtgctttatatataggatcttaattcattttacaaccctgagaaatagatattatcaccttcatttaatagatacggaaactgaggctttgaaagtttaaataactcattcaaggtcatacaattagtcagtggcaggggtaggattggatcacaggtatgtctcactccaaagcctatgatctcatgcagtttggcatggatactcttctatctttttgatttatgattttccttcatttaaaaaatcttttatttagaagtataataaatataccaaaatgtaaataaaatataaatgtatatcccattgggctattttaaagtaaacactttgtagccatcatgcaggtaaaagaaacagggcattgccagcccccataaggccatgtcccctgacaatcatagccctgtatcttccaccaaaggtagaaattatgttaagttttatggtagccaattccttactttccttacacatttaccacctaagtgtgtcaccctaaatgatataaattagttgtgcttgttatttaacttcatgtagatgaaattgtagtgtatgtagtttgtgttttgggcttcatttgctcatagttacgtttgtgagatttcatgaagctaaagtttgttcattttccttgttgtattttattgtgaaagttcacccactgtatttattcatcctgttgtttttgttatgatatataatgctgctgtgaacattattgtacctgttctttggtgccttgtgcatatatttctattgggaacacaccaaatagtgaaattgttgtagatgtaatgccatgtatgagagttcctgttgttttgtatactctccaaacttagaactgtcagtctctttaattttagccattctggcatgttcacaggagtatcacattgtgggtttaatttgcatttccctgattacttattactaataatcttttcatatgcttattttcttttagaacgtgcctatgcaagtctcttgtccatttttcaactgttttctatttcttatgaatttgtaggagttctttgcagcttctggctatgcatccttcattaattttgtgtgttgcaaatatattcttccattttgtgacttgtctttttagtctcaaaacagaatcttttgatgaaaagaatttcttaattttgatgtaacctcatttatcactcttttccttcatggttggcacttgttgtgtcttgtttgacaatgttgcctatcccaaagtcatgaagattttctcttatgttaacttctaaaagttgtatcatttgtcttttatatttatatctacataatgcacctggaattgagttatatgaatgctgtgaatttgggaggggcgtgtttcctttttttcccacatggatatccaatcaactcagccacatttactgggggaagacatctttttttctaatgcgctgtagtgttaggtttttcaaaacttaggtgtctgtatatgtgtgggtctgtttatgagtctgtctattcttttccactggtctgtttcctacacttgtgccaatgccacactgtcttacttatagctctataagtcttggtattgttaaggaaaaatatttgtaacatttgttaaaaatggcagagaagactttattcaaggaggggaacattgtgataggtagagggactgctgcaacgaggtcttgctgtggtgaggagagagattgggctggagtccaacttctacaaggacaagaggggatttatagtcaagcagcagggtggggtcagtggatggaagaggaaacatcagagacaggggtattcttgctagaccaactcaacagaattcttgctgaaggcaggccagggtgataagatatcaagagttaggggtgaggacagataccaagggtggagaattttcactaaaactagtaggattcttgcttaaactggattctataagacagaaaaggaagcccaaggtcagggtctagtggaagagaaggctccggggagcccgacctgagtttgatctaggagagtctttgtcaatatcctgtagaatatgaccttcacctcattttcttttcctcaagtgtatctggactgtatttggccttttgggcttccaggtgacttttagagtaagtttatcaagatctacaaaaatagctactgagattttgatttgaatagtatttcttcctgataatttctgagtaaaattcattttaaggaagtaggaggggcagtggcctgatgaaaagcaaaaatgaagaaaagaataaggaaagacacagttttgccatcaccagccagtgtttagtgatcttaaaatagctgcttttgtttttgagcatcatttgttgggtatggagttgcagaagttgggttgagggacactggcttctagaatcaaatattggcctccatagagtgtttctgtacagtgagttgggaggatgggcaggggccactgaggactgtggcgtgtccccacgttagagtgtatctcacacagagcctgtcctgaaaatatagttatttttaaaaagtgtttccccctccttttcattggccattttctcttttactactctttacctagcaaagggtgggcatgagaaacctggtcagtggaagagaaagccattttgcaacagtggttataggggtgggagagtaaaatttcctggttcctggggaagctaagcccattggtaggaccagacttttgtatgtgtgtttcttcctttagtcatctactaaggttaataaataccttaaaaaaaaaaaaaaaaaaggacatgatctccctctgtcacccaggcaagtgatcctcctgcctcagcctcccaaggcactgggattacagtcatgagaccctgcactggctcattaacaatttttttttatatagagacagggtctcgccaggctggtctcaaatgcctaaccttgagtgattttccttccttggtctcccaaagcattgggattacagacatgagccgccacacccggccaagaagtgccttttatgtctcaggcactgttcttggtgctggggaacaagatagacaaaatcctcactctcatagagcttaattctagtactagagacagtcgagaaattattaaatagaagatgtaatgttgagctctgataaattctataggaagaaaaaggagagtcagggacagaggaagggaagtgacgaaggagccctgtggatctctgagagaagagtctcccagacagggggcaggtggagggtccaggacaaaggctgggcatgccaacaggggagaaagaggtattgcagtgggagggagggaaagtggcgggaaatgagatggaggaaagcagccctggccagacccaaaacctcacttcttatgatagatatttagtaacacccttttcactcttcaatgatgaaatttgtagaaaatataacctatctacccacatcattacaaaccatccatacaatgccttaactgtaatagaaaggaagtacaaaaggggagaaatgtatcatgaactaagaagtatttcatgactacactggaagacataatggtgtggtcatatgttttgcacccacttgtaggatcactgcaaacgtggcagctataaatccagatggctgcagatgtgttatattggccactcaaatgacataatcggtgttgactttagtgatgtgatatttctgaaatggtgaatacgtgttagtaaagttctaaacaaaacaaagtacatcattccctattgaaatccagcatttatgaaaatcatggaggaaacccttgtgttgacaggtaaaatggcgtaggcttttcagcccttccaggggagactggaaagtcctgggggacatagaatatttgtggcttgtgctagaccatcccatgtactgcaggttgtccagcctgtctggccccaccccttaaatgccactaatgactcccaattgtcctgtgactaccagaacagcccccatggatttccagatgctttttcaagcattttgggttttgtttgcatgtaatgagaagccagcagacagtttggatcagggaagtgaagtgacccaacctaggttttaaagagatctgccattcataaaaataatgaaggggaggctgaggtttctgtgtcacttagcaaggactcggcccccaagagtgagctgcagaggtaccaggctgacctctgtctgtctcaagcttagactcacccagaagtctgtctttctaccccagagccacctagaccatccatcagaggcctccctctaatgaggagtagggtgggggcaccccatggtgtcctttgtgccctaaaccctttacaataacaggtgttggctgtcacctgaagcaggtttcaaccatcactcccttcccaccatacacacactcccagctcattttgattccttttcctgcaataaataacagattcttgcaaagtggttagaagaaattagtaagttaagcctcacactagggttattttgccaggagaccttcctttcctaggtaaccccctccaccacgtgggcaccccagtgggatctgctgcagtctgcgccagggtttgcttggcctgcaagggttggccatggcagatgcctttcctgtaactggaatcccccatgcctggccttccagacagtagagagataattggataaaccctaaactggaaattacaaacaataactactctgttagtttacatatgaaactacttaagcaagtcctttttatttttatttttcgacaatatgaagctcattattcgtgacactcggggcactctcaaaatgtgctcaagaaaagggtcacggctgtgtagtatttagcaccagaatggaaacacccattccaagttctcttccatcctttggccactgagaggtttggtttagtggtcccggggaggacaggaaggggagagccactttaacttgctgttgttgagtgaaggtggggcaggagtgaaaggcattgttgttgctgagtgtgttttcatgaaatctaaccttatttaacatgatctccagtaactcactggtcttcaagttacataaaccttgatcgaaaattatttcccttttttttttttttgagacagggtctgactctgtcacccaggctggagtggtgcagtggcgtgactggctccctgcagcctcaagcaatcctcctgcctcagcctcccaaagtacagggattacagacatgagccactgcacctggccttgatttttttttatataaaaggatattagagcaaaagagtgaatatgtataccatagtggtcaaataaatacttctgcaggggccacacacaaaactgtgaaggcagaatctatttctgtccttagatgtgttggtcaataggtgtttgggcccgtgaatgtaggacccaaatgtaatagcagcactatactctacagcgtgtgcatagctggattcagaatttttggttttaaaaattaagcttttatttatatttacccatcaggtcaccgaatacttggattcaaccaaatgcttgaaagcttcttcatttgggggaaggtgggtttggaggcagaaatccctgcagactccacacccagggttttactaggtcctccgcggcaggtggaaggaaagcttgttgccctgcagttccgtttgcttcaaaaacaagggtgggaagggttcaccaattgatctttgtgcatatccagtgtaggaaaagtgttatttagagtatcattataaaatcggctgcatatggtggctcatgcctgtaatcccagcactttgggagtccaagatgggcagatcacttgaagtcaggagtttgagaccagcctggccaacatggtgaaaccctgtctctactaaaaatacaaaaattacccgggcatggtagcgggcacctgtaatccccgctactcgggaggctgaggcacaggagaatcacttgaacccaagaggaggaggttgcagtgagccaagattgcaccactacattccagcctgggtgacagagcaagactccatcttaaaaaaaaaaaaaaaaaaaaaaaagagtttctttataaaagcttgactcccatggtagatggacctaattaaggtttaccagcaagtcccagaaattagcatagcataggaaattaccgtagaggcatgtaggagtcatccagatttggccaactcagaggatagagagaaaaaatatctctccctccttcctaattctcaagggagatggaaaacaagaagatttagagcttcaagaatgaggattgaggaagtacaatgtaaaaatggctccctgggtcccttcttggaaaaaaatgtccagagagtttccaaaagtggttttcccctcctttttgaggaatatgtgtttttattcctttgtgaagaatatcatcttagtagtcttatttcatttgtctatttccctctttaatattaatttgatctgagatgcttgtaaagaccaagcaacaaaaagatgtcatgccaccttcatttgccaccatcacctgtgaagttcagacaacgcagtatagacagagccttaagagggaggagtcaggcgtgaggctttgtgaggggtgggtggtcaggggtgtagccacagcctttgatcataaaccatgaccggttagaactgggaggaacctcaaagtcgctaggttcaactctctcatttcatagacacgaaaaatgaggtccaaagagttcaagagactgccaagggttgtacagctaatcggccgacctagcaatcgaaggacagatttgagtatttttttttaaagcataggcttttaagttctttatcattgtcagtttactttggtttgcctttaaccttcaccaccccagctggtaagtgtaaattgtcattgttaatgtgctttttccttgaactgcttgtgaaggactctctttcaaaggagccggtagaagggaggaaagttggtggcatattacatatctctacgctgagattcaatccagaacggccttgggagttcttcgtcggctgacacaaggcaaagccccagctctgatctgaaaagtttgtatgatgcattttccatgtgtattggttgattggttttgctggaagacctaaccaagagaaagcattccgaccctggcgttagccccactcatgagtctactttatactttctacattttgtctataaaatttgccacttaaaaactcttgtttcatagaaaatggacttgattatctgtatcattatgaaaatcctgctgcattatcaaatcttcctaaaaggttaaaaagcttttttttttttttcaatctctgtctttgctgtgattttagactgggttgtaaacaagctataatgtgaatggactaccaagagatctacaacagaagcagcctcagaaatagaaattgaatttataggcagtgagataggataattagcttttatatttaaaaatatcctcagaccagaggagtctgctgtctcagatagagaagggaattgagtttgaatcctaatgcctcaagtaatttagtagaaactgcctgttttatataaaatatatacggcagcctgctgtgtgtgtatttatgatctgtatctctatattcctctctaaacacatgagttaaagtgtcagtctaagtctgaacattcagattacacaaatcatttgtacttataattctcagccttaaatgttgttgttgatatagctaaagataacctgattggccaattatctcccttttttctttgagtggttatttggagttcaaaaatcaaacaaacaaaaaacatttctgttttttttacatggagagcaagaattgtctcggatgtttacccgaagttttttgttttttatccaaccattatgcactacagaatgtacaatttaaaatgctctatgtaggttaaacaataaaagacacgagaatattaagtgtctgctattgttaaatatgtgtaaattcaacatacctcctgtaatggccagtgtcttagccgctgatccctgtcactctgaattggcagaaaccagatcctggcttgggatcttgaacagatattttttccagggttgcatcacaactcttgggagggcatcctgtctgaaatatgctgtctccccagcctgggtcagcagggacagagagaaatagcatctgtcagctgggttgaagtctcccgcatatggagtcagtcactggttctttgctgagggttcagctaatgagacttgattgcttgtggcactcttgtttccaccaaaaagagcctaaaaacaggatgaacttgaaaacaagaggaagtggtgctatgcttccccatgactttagctccagtttgcctttgagcaagggggaagcagaaggaggaacttcttacgtacctgcacggtggttcataccaggggttcatcaaccctgggatcttgcccccttctctgcctcctgtcataaatctctgtttcaaaggaaagaaaggggatggttgttaaagcataaacctccaggtcagctcttgttacattagaccccaagatgatgtccaaaaccttttgttgaactgaaatgctagcttggtttgaaataactgagccattcattgcctagggatagaaaatctttctgttgtaaagaggtggttggttggttggtgtgtggctttgtttgcaaatacagaaagtgggatggggattggaatagtattggccttgtgggggctgaatattgaaagcagcaaaactggatgtacctaaaaactaaagttgaatcggcgagttcatccatccttttagagctattttcattgagatataatttctttcagttgcttgaagttttcagcatcagatcaagttttctttcttgctctccaatacctcttttgcttgtttgccatctgttcatttccactgcaaactgctctttacacaatgttactcggtgttaattagaacacgtgtctctttgtcattcatctggagaaggggttaatgatgatttatgtccctttaattggttttcctccaaactgttaggtttaatttattattttataagaattccaagagactgggaaagaggaagagtgcctaatttttattcttcatgtctttaactatatatctcttttgctttaaaaaagagcaatcttggcctaactattttggtgttttaaaagtatggttctttggccaggcgcagtggctcatgcttgtaatctcagcacttcggaaggccgaggtgggtggatcacttgaggccaggagttcgagaccattctggccaacatggtgaaaccccatctctactaaaaaacacaaaaattagccaggtgtggtggccacatgcctgtagttccagctactcaggaggctgaggcacaagaattgcttgaactcttgagaggcggaggtcaaaatgagctgagatcgcaccaccgtactccagcctgggcgacagagccagactgtctcaaaaaaaaaaaattcttcaagttcttattaaatgataatacatatgagtatgtatttactgcttatcagtgaacaatttattagtcaaatttgttagcttatttctgaataagtaacatgttatcatggttcaaaattgaaaaggtcccaaaaggtatgcagtgatttctttcctcctcctcctattgtccccagacttctattctgggaaaagggtttcctttccgcagaatctatgttgtcagggtcttgtgtgtacatatatttgtatttatgtatacacatatgtgtatagatggatatatgcataggtacatatatatgtaaatactttccctctttttatgcagagggtggcaaacatatatgctgttctgcatataccttttaaatgcattttggaatgtactgcctatcggtaggttaagagcttcttctttctttgttaaggctacattatactactgtatgatgacttattaactacttcctgactgatagacatttgggctgtttccagtttttcccaggatgaacagtgattcagtgaatagctctgtatcacattattttgtatatctctaggaaaaagatcctagaaatggaattgttgcagctgaaagtaagtacatttatcatttcgattgattttgtcaaattgccctccatagacgttaacagttaacaattctgctagcaatatgaatactcgtcagcttttttcatacttgtgaaaatagtaggtgaaataatgatcccagcttatggtttaatttgccctttcacttattttgagtgatgttgagtataatgagcactttaaaggaaaaaagataaatttttgtagttagatgtatatatatacatttcaaaggtggaaacctgtttgtgcattttcctttctaccccctcaaaacactaggaaattatacctagtttctagtaaattagatagctaatttctatattggtgtgttattaacagtaaatatgctgcaaatgttggaagatacctaacattctccttcatgtgattaccaaaaacatattgctgaaatccaatttcgactgacattatttttcaaaataatacatttcaaactaatcaaatcaagttttgatttgtaagggcacattacatgatatcttttaagatacaatattttaagtcaattaaactctgatgtatgttgctttttaccaaaagcacacagattatggagaactcaccaagtgactgacatgataaaaaagcaaagttcttttagataaaaatggccactttctccttgatatttttctatgggttgagatttagatgaaaatcccttgtggcaaattttaatgactatttctttaatgtaataactgaattcatctagatgatcccacgtccctcaacagagaaaggtgagagtctgttatttgttaggtttccttgtccatatttcttggtgggtcccacaaaagtctcatgaatctctacaagtgggaaaataaattgcccatttcttggcacaccgaactttccatgtcatattttaaaactgtaagtccatactttacatagctaaagaccaatgggccaaagcatggtgggtcacacctataatctcagcattttgggaggccgatgtggtaggattaattgagcccaggagtttgagaccagcctgggcagcatagtgagaccccatctctatagaattttttaaaaaattaccgatcatggtggtgtgtatgcacctatagtcctagctacttgggaggctgactcaggaagaccatttgagcccaggaatttgaggctgcagtgagctatgatgacaccactgcactccagcctgggcaacagagaaagactctgtatttaaaaaaaaaatggaaaaagaaaaaaagaccgaataataataataatatgtaatatttaatactttcatggattgggtactgttttccctcccctgtgagtccctgcctatgtttccttcaggccataaaaagaaagcttgtctggcaaatatgaaatttgaaaactgaccatctgctgaattataatagtagagatttacctttgggataaatatatttgtcattgccacaaagtttgtgaataatatttctgttgcccagtcatgaaatcaacaaacctccaaaatgaagttgctttaagtgtgtaatggcaattttgaattgttaaagtattccacactgtcgtgaaaccaatgtaaacccttgctcagaactagactcacaaaattttagagccagaaggaggtttggagatggtccagcagttcgtctcaattttataagtgaaaaaaactgaagctggggcaaggttaggaacatgttagcaagtgagtgaatgagtgagttacaaagctggcatccttgaatcttggccccagacctcacctggctaaattgttccagaaatcttgcctaaacacactttttttgtagtggaagaatgtatgcccttttagaaatcagttctaaggtctcttagtaaaaccatgtggtaggtcatccttaactgggggttggttttgctgaagacagtgagcacaagagaaaaccacagaatgctctttctaagaaacatctagacagcactcatgaggcatacacttggtgttccctccctctctttttcattggtaggctgtaaattactcccctgttggaaaaataaggtcttcaggctactcacggtggtgtgcagacgcacatacacaacagtgacagctttctagtggcttccgccatgcgtgaaaagagatgcaaaaggaatgcaggaatgttagagaaaataaaggcatcgccgctgattagctgggactgatcagagatgggttacttcacgtgaagcatgtaaggaaacctcttgtaaagacttttattatatttttaggaaggaaggaagaaagacagaagagaaaaacagagaaggaaagggaaggaagaagggagagagggaggaagagaaagacagagggaaggagggagagagcagggatttacctgcattacaggtagcataccttctccaaagtctcctttgtggaccagagggaccattggtggcagctcccttaaccacagtccagaactttcagtattaaaaacttagctgatacctctcaaggatatatatttactgcaggtccttcatctgaaattcagacacatgtagctagctacagatcacctataagatgtttcaacctcaacaaatttgggacttaacccatcatcttactccctccgccacttcctttgcttgatcttcttatctcagtgagttgcatcacagtcctccaaactgatgaggtcaaaactctggtaattatcctcaattctttcttctgtcccacctctagccaccatctaggtcaaacagcccagctgactgcacctcctttgtgtcttccccactccatcccctgcctgctgccactgccttagttcacagcctcatcatttcctccttgagttgctgcaacaatctccagctggcctctctgccacccagtttttgcctctctccaacctgtcctcctgactcttgccagagaaatttttctaggaaaacctacccaagcacggaatgcccctgtataaatgctccatgggttgctgagcacccccagagaaactgtcgtgactgatccacgctctcacttcctcggccttgcatcgtgctgtcccctgccctcccaggctctgtgccagtcacccaggcttccctcagtgcgagcatctcctcacctcctgacctttgcacaagccactccttctgaggagcactctctgtttcccctgcttctctcctccttgcctaactcctactgagctttctaatctgactttgagggcacttttcagagatgtcttccttgaccaaccgagtagacttatttaacaaacacttgcataaatttactgtgtgccaggcactgacctaaaggctttacatatattccttcctttacttctccaaactttaggagaaagggaggattccagtccccattttatggatgaggaagctgagaccttgcttgagtggtgaagcagcttgcccaaggtcacacagccttgtgggccagaagctacttctgcctttgtgtggctcctgattttgatttgtatgtagtataaatatatatatttttgtgtgtgtgtgtgtgtgtgagagagagagagagagagagagagagagagagatttatgttccaaattggttccgggtttgtcatctgtatatttaatatataataaattatatatacaatttattttttgaatagacaatagaagcacatattataaaattcaaaaaatacaaagtgtatacagtgacaggagcctccctcctcactttacctcccacttctccccaaaagcagctcctgtcacccatgccctgtgtatctttccagggatatttacaaatatatatgtagacactatgtgattttcttttatatttatgatagcctattctgcttgagatttttaatttgctttgtttgattaacagtataccttggggcttgttccatatcaatatattaagagcttcctcttctcttctgtgtctacataatagcccattgtagggatataccatagtttatttaatcagtctcctttttggatatttaggttgttctcaaacattttctagtacaatcagtgccgcagagattagcttcctacagacatcattttgcacacatacgagttgatctgcaggataaaatcctggaattggaatttgcggccaaagggcaggtgcatttataattttgatagatagtgccagattgtccctcataacggatgtactcatttattttctcattagtagtttatgagattgccccttccttcttagcctcacccttgcctatataataaaatgttttgatgttcacccttctagtatttttaaccagcttttttcttgttatgagtcgttatgcatcttttaatgtgtttatgaactatcttgattttctttattagctgatttagtattcgttggctcttttcatattgatttataggcatttcctatatattaaagaaatatatcctttgtctgtgatctatgttccagataggtccctggtttgtcatttgttgatggtgttttttccccatgcagaaaatttttattttcatgaaatcagatttatcagttttttttcttttatagcctctggggtttgagtcatagttaagactgaccttccccacgcctaaattataaaatcctcttctatgtgcatgcatgggtgtgtgaggttgtttcaaagaaagaagtgatagagtgtaatcgctgagaaaaccaactgtggagtcagactgacctaactgccctggtttcatctctatttctttaatcttggatgaaatgtttaatgggttagtaatatctatatcccagggttacaggtgactatgaagatcacataccacaatataggaaatcgtcctgtattaaattactgatagctgtttttattgtgttattttctccaagtttaataataattgcacaagaacaagggccctttcttctctttcttttgctttccccttgccattgtggcccttccccttcccaaactctgctgccagcaagaccttagcgtggtgctctgctgatgggactcgagtgctcactttgattgcttcactgtttattttgattggcgacagagaggcctggagttctggctggagccacctggagtgccacaggtgcttctccacttgccacgcagctgttctcccagtcccttgaggaccctggcgcctctccagatcttggcacttggtttctttccatgggtcaccggtgagagtccgtgttctttcctttgggccccctgcagccccttgccacagaggcctctgtgccgtctgccctgtggacatcactgctctggtcatgtcaagagttgtgtcacctcccatcgctgtatctcagaagggtggtgccttaccttggtctctctcatcccgagaggacttgagacagcgtactccccacatgggtgccctgtaaatatctttgaccaaagaagttaggagaagtaagaggtttggggtgtcatattgactggaagagccacaaatctcttggctatctcttcgttcccattgattacacaggaaggaattattccaaatcatgtatttctttagtggatgatccccttaaaaatttctacgatgtcagtttctgttaatatttactacagtttttattgtcatggattgtaacttcttaaaaatatttaatatcatgcaagctgttcaaagacaccagtaatttggagacagtgcagggaattgggctgtgatttcctggcttttatctgtctctgctgctcccttctcctctcctttgcctgtttgtgtttcctttgtacactcacttttaacaaaggccccttgaaattccaggggtaggagacacagtggagcattgaggtaggtcatctcatatttaattttgccactctctggccgttaattaaaataatgcttgagtgctagtgtccagttttacagggggtgtgtaaaatgttaatcacaactgatctgaagcatccagtccagtgccagggagagggtttagggcacaggcagggagcatgttatcaggaaaaaaataaactagaggaaataaaacattttgttgttctttaaaaaattttaatatgaggccctactatgagcaaatatgaaggaggatgtgaagacgggtaaggtgcagtccgcggattcaaaggcggggccatctgcatgctgagcgttttactatactattccatttaagattcgcagcaggctgggcgtggtggctcacgcctgtaatcccagcacattgggaggccaaggcaggtggatcacctgaggtcagacgttcgtgaccagcctggccaacatggtgaaacccggtctctgctaaaaatacaaaaatgagattcgcttaaacccgggaagcagaggttgcagtaagctgagattgcactattgcactccagcctgggtgacgagagtgaaactccgtctaaaaaaaaaatttgcagcagtccagaaggtaggccccattattccgattgtatgggtgaggatactgagttgaagaggagtaacttgacattgatcccattgtacagtggagccaagattagatccaggggacctggtttcccagccccatcacctcagtcctattgcattaccctctggaaatgctcagtccagtaaaggagagagtgatgatgcaatgatgtgactgcttccagtgaagagtaaaagtaatgaactagaaacgggagaaacagattgacacccttgagttgtctttctggttagggcttttgggtttttgttctgtaatacagtccaatgtggtggccattcaagggagaagggccactcatcagccctcctgctccctcacccccatcttaattaaataagtctccttaggatctcacacacctgcatgtaacaaaacaggttttaaaaatctgtagtcaaggagcactgcttgtttctttctggcaacaatcccagtggaagtaaaattacactggactgcctgaaactctgagcccaaagcgttaatttttgaaaaacgtttgaggttcctgagttcccgtggtatgctactagaatattctgtagctttaacaactcccagccttcattctgcactgcaccccccgcacacccaatacctattccacatgtctggggataggtcagctcaccgtccaccctcgctgccccctaggctgaggttccctgatgagcacagttttccgggaaggatttcagcccctctgtgaaagtcttcagttatctcctctcttgtttccagaagtagcttctttactccaacttgaaatcttgctgtattccttagtgttttggaaacaaaatgtgcagtaggagaattctggctttgtggatattggatcactttgttccctggcacaacaatctctcctttgtattaaacatctgagaacagaagtcctaaataacatttttatattccttgttgatgtaagttctttatttggggacagcagtttggtacttgttcctctgtcaaattctgatgtactttccctttttcctatgatgaggacaccactgacccctagcctggaattttactttgggtagtggtggtatttgcttaccccgtgggactttcctgttgaatccctctagtctgcagtgagtggcctgtgtcatagtgggatgtctgactggtcggagcaaaggtacccaatcctccagcctgaccatgagctgggtggtgaactagccagccacaaacaagccagatgggcagacagaccaaaatagccacttgtccacctccttcctggaaatgcagaagggctgctccggaggtccaagaagacctaatttggtcagcaacccagcacttactctgaacaggaggtggagttgtgagcctggtataagttccctacctccgattctttacttttaccacacacgtttgcacatttcaaggagatgatcagccacactaccaactactgatgggtaacaaatactctttacgtcaaagctcttctgatgattttcctggattctgtacttgtacaatgaatgtacttgtgcctttactccaaagaaaattagtatatgtggctgggcacagtgactcacgcctgtaatcccagcactgtgggaggccgaggcaggtggatcacttgaagccaggagttcaagaccagcctggacaacatggtgaaaccccacctatactaaaaatataaaaaaattggctgggcgcagtggctcatgcctgtaatcccagcactttgggaggccgaggcgggcagatcacttgaggtcaggagttcgagaccagcctggccaacatggggaaacattgtctctactaaaaatacaaacattaactgggcatggtggcaggagcctctggtcccagctacttgggaagctgagacaagagaattgcttgaacctgggaggtagaggttgcagtgacctgggatcatgccactgcactccagagcgagattctgtctcaaaataaaaaaaaaaaaagaaaaaataacaacaaaaaagaaaattagtatatgtgctttactctttaggcaaacccaatattatacaaattcagttttttaagacaggataggacattttatttttcagaaaatgtataaccacattccttaaatggcgtaggtagtataatataaatatggtttatcccctaagaccgtttttatttctatgtgagtttcaaagctctccctttttcctattcattcaacaactccacgctgagttgtcttatgggaggaaaggctgccctgcatggctctcttgcagctaatgaaatgagcagttggctttggtgttttatcactttgggtcagagatctatttcttgctccttactccttcagtgaatatctagttcgtgctccctatggatcaagcatcgtgctggtcttcttccatctgccttgttcccagtgggagcagttggaaggatgctgatggtttcttcctccaggagaggaagggcagtgtttcatgtcactcacaaccaagcagctagttgtcggctcttggaaaactagttcaccaaagggaagcactgagcctgaggccctgggatgggttggattcttttctaagtggaataacattctactcctcctgcttaacctttccttgcaaactaaaatgggaaaatcactctatggacaaagtcaagcggaaataaaaaataccctctctgaggcagcctggcagtacctgcatgaatcagccagtgtttggataagaagcagcccctcgagaaggaatggagcccttccctggaccttaattgatttttgtatttgttcttcttcttttaattctttgtggaaaagtgatttgtactgcagagtggctttaacatattatgggtgctgttttatgtaatactgttcttatctaaagatcatttctgcttgttttgccctattttttttcctgatccagctcatgtttgtttttctttttcattttatttcttctttttgaaggagttattgttcctcttatttctcccacttcatctacccccgttatctgccaggagaataggagaagacatgggccacttttttttttccatttttaaaatcaattggctagatatcacctttctctcgtgagtttgtttcataacgcagagcctcattagtaacgaacctgacccttaagaagttgggttatgtttattcctagggattaaggcactgttctggcctggttggccctttgctgtctgtgctatcgtccgcccctgctgaccagggcgtgcctggctcatggacagggcagctccttgcagaggtaccctgctgtcagggaaagttctatggactagtaactgctaagatcttttttgataaaatgagatcttgaagccttcaatcatgagcctcaaacaatttacataataaatccagaacttggagatccaaaagatattgccatgtttttggttatgttgctagggaactatgcctccgttttcaaatgatacattgctgtgtgtgtgcgtgtacatgtgcatgcatgtgtgtgtatgtatggaatgaggaaaattaggtgtttcatgcttatgcattgtagtgaaggctacagtgttgttaggcttttctgatggatatcataactcaaactacagaatttgtttacagcagtgttcatgtgaccaagaaaaaaaaaagcagatgaaaagtagccagacgtgttcaaaacacaactaatagatcaggtttctggaacatctgagtctaagggtttggtcttcctcacaatatgttgagaggtgatgttttaaaagcaaaaacggagaaaaggccagctgtggagaatggtaactgagacaattagaaagcagatgtgtgcaattgaatgtagtcagccttaaatggatccacactctcttctgtatgagggtctggaagggagagttcacagaataaaaatggagtcattttattctttctgttcaatatagattcccacatacagcgagtatttgaattgtgacttgctttctcattggcgtaattcccacctgcctttggaagtccattccgaggtgaccttgccccctgcaatatggaatgggaaaacacctggctgagtctagacgtctgataaccacgtaggtgggtaaggtaaccactgggatggctggaaggtgttacccagggaaactgaaggccaggatgaaaataaaagcaaacggtttccccttgggcaatgactgccatcaggattctgctgctgataaaatgctgctcctttgttctgcttcctgcgtgttcatccatatgatagctgttagacatttcattcagctttcacccacctggcactgcttcagtgccaaccaacggcaaggtgctccccagctgccatggggagccgggtacaaatagacctcagcgaagccctgcgtgcatgcaaactgcgtttgccttttgcattctgcttttctctcggggccatgcttgggacacttacacgctgcccgctttctttctgtgatgggggctggtgcctttgcactaggcccccacagtcatcaatagccctgttcatgtgggaggtgacagcaacattttgccacattacaggctgcagggctcaatgtgaacattcttcttagagtgagcaaagggcatgggacttctgacggccagggaagtcacagcctgcaccacagtgcgaagatcctccatctgggccatggggagcacttagaatgtctttttatgggttcaataaaatgtgatgaacaaatgtttgtggtgaagctctattgtgaggttttctgatcatatgtaacataattactgaaatctttgtcaggcattgttttgcatttttatctacaaaggaagccagtgacaagctcaccactgttctctgttttccctttagtcggttcttaatcatccaagtcaatagagaaaatcaccatcatcgatgacgcaaacccgtaaaaagtccaaaaataatttgtgtttgattttgagatggagatggtaggcatgtgaacaaaacgtgccaagacatttaggctactttgaggtccaggccaatgccctcccaactcggctctgctccccctgaagccggagaccgtgtatagggatctgggggaccggagggcaacgccagagaacaagtggaggaggtggctatcaatcctcagagtttgtcatccactatgaagaaagctggccaggttttgttctgataacatcacatagatattttatactttttaaaagatgatcagagtgacatctgtgtggttaaaaagccaaataacacagaaggcttttaataaaaaataacagccctgcctgggtcctgtccttccttggtcccactttccagaggaaacacctttgaaccctcccagctttgttgaaagttctttgggtggctaccttcatatctttaaataatatatggtagtaccatttgtactagttttctagggctgctgtgacaaaataccgtaaactgggtggcttaaaacaatagaaatttattatctcatagttctgagggctggaagtctgtaatcaaggtgccagcatggccacacttgttctgaaggctcagggggatccaccccccacctcttccagctcctggaagtgccatcggtccttagcttgccctctgtgtccctgtgtgtccctcctcacatggcattttcctctgcctataaggacgcagtcctattgggttagagcccaccctaacgacctcctcttaacttgattacatttacaaagaccgtgtttccaaattaagtcacatttacaggtactggggacttgaacatatcttttgaggggacataattcgacccataacactactctttctcagtttataaacatttgacttctgccttccttttatagtcaatggggtttctctccctgattcagcctcgtctgtgtcttctctcagacctcttccctctccatgctccgtccctccacttaaaggacattgcttatttctcaaacaaattcttggaaacctcatttctcattctgttgaccttagagagcatcacttaattactcatttaaaaaatgaaagcattcactctttcggctcccatcttctacctctgagcctctgtcagctagggccaagcttgatgccatccgtgttcttttcagttccctgaatggttaaatcctctgtcatttgtcctcagacgaagaatggatatttgtctacagcttctattgataggatctgaaagttgaaaaccaataaacagtgttatcgtgactctgtctcctggattattatacctttgcatgccctctgggttttaattaaaatactttataccatttgaaaaatgacagcataatttctgtttgtttagtactttagaatctacatttatttgattttagatggcagcatactttgcttgctctgaattgggaaactgtctattcgtttttcttgatgtcctttggcattacatattgaaatgaggctttgtgtcttataaatgtttgatcacatgacacagtagccgcatgggtctctctgtgagtttttagcaacaggtaagccattctaaggtagtgctagccaaactttggatttcaatgcttttcatttcttttttttaaagaccaatacagagatgctaactttttattttgccagaatgggatattaataaatcagctattatttactctcactggtaaaataagaacatttaacatgaaaaacaaaatagtaaggacataaccttggaataagttacacaattttaaaaattttgaatgaatttaactttcaaagaactcattactttccctcatttttcccatttggcatagactggtgaaaacattctgaatggaatggttgtcctagatcaaccttgtttagtggccatgtgtctggttttaatagagtagaacatactgttaatgactctgcttactctgtagatggttaggttgattgattaggacctggtatggaagatgtgcaggagaagggggcaggctttgtgtgaagtgggagagttggatcgccctattttgtgaccctaaactgtaagtagaaccccataccccttgccacatgcccctagtctaagccatttgtaagctgagctagctcacaaattcttgcccaacatgtgctgtgttgggcatgaatttaagtagatacatacagatctgtcacctttatatatgtagcccttgagtaagtcacgctttcactgtcttaatttattaccataaagttggccgggcatggtggctcacgcctgtaatcccagcactttgggaggtcaaggcgggcagatcactcgaggtcggaagttcaagaccagcctggccaacatggtgaaaccccgtctgtactaaaaacacaaaaattagctgggtgtggtggtgcacacctgtagtcccagttacttaggaagctgtggcagaagaatcgcttgaacctggaaggtggaggttgcagtgagctgagatcacaccactgtacttgagcctgggtgacagagcgagactcggtctcaaataataataatttttttccataatgttgtcttcccatatatattttaccagcttgaggtaatataactagtaaaacttaagcattcaaccaatgcacaatgacaccatttttctaatcttctctgactaaactaagtctaaaatggaatattattgactaaatgtatcccatcgactatatttgattaattaaccatcaggtaaaattctttctctccttaaggaagaagagattgggattaagattggttatcagtcatacccttgccacattgaattgaattcagttttcagaatgttaatgctttaataggaagttttgtgaaatcccttcagataagaagaaaattaatttcttacttttttttttttggtaagaaatgtttgtgtgtgtggcggggggggagggctgcagccaaccacaggtgattttaatgatggtaatatatagcaccttcctaggaccatgtggtttaaaacatcgatgaggtcctcttcacaacatccctgagaggcatttagatattgtcttcccatgtttttttgcacaggggaaattcaagacagactgaggttaagaagtgagtagcccaagtttagtcagcaggtcaattgcaaagtgagaaaaggaagtccagctctttcaaaccacatctcttatcctggctaatgaacagcatctccctgagtccatactctcaactttaagattccactctaggccactttactttttgaagatctgaacatttgaatgaatcagatacggctttccaattagaagtgtagacagtcgtgtccctcaaggtttcattgtaaggataaatgaaggtggtgatgcttttgagcccctgggacataggccagtccccagagaggaggaagcagctctgaaccagcagcatccctgagtttgatttgtttatcagaagtaatggtttggatagagctgtccacactgtcatcccattttattggtgaccaggaacatataccacagaaaagttatgaattatgaaactagagaaggtgacaagtgctggctttatgctgctctagctctgtgtcacttaactcttttggacctcagccatgccatcagtaaaatggaggtcatgatgttaactcctttccgttgtctttcatcctttgattcttctaaatgcccttcatcggaatcaaactggcagccgtacacttgccaggtctatgcacacagcagtgagctctgcaatccaaggaccagatccaagtacagatagggcccatgttttgcagctttgcattctttctcctctacatttcatctctgcctgcattccatgtcacctttggaagacctcatatgtcactgtctttctgccctcattgaacagagtgcactacccgtgagcttccagtatggtgccttctggcaatctacttgaagatatgatcttcattttggttgaaatctaataccccatgtgaagaacaaggacagtacaactcaaaattctggaccactgcatatggtatcttttctataacccatattttaaatacgtgtattaatttataacacaaacatatggatgtttcaaataacgttgggctataaaaaactggtattgataattgtgaccccaatgatgagaagcactcatcagaagaagaaggaattccattttttttttttaaggcagggtcttgctctgttgcccaggcttgagtgcagtgacatgatttcagctcctgcaacctctgcctccctggttcaagcgatcctcccacctcagcctcccaagtagctgagatcacaggagtgcaccaccacacccagcttttttttttttttttttttttttttagcaaagacagggtttccctatgccgcccaggctggtcttgaactcctgacctcaagtgatccacccgcctcagcctcctaaagtgttgggattatagacgtgagccaccttgcctggacaggaagaaggaactctgtctaagcacatttttggttttgtccagtcatgttgtttacacggccattgttacaaagcagaaaagccaccaggcatctctttacctctgaagcaagcattctaaatagttgagagtttgtggtacataaaaagaagccttctctcatgctaatgttttcaaaacaagttgtgacttctgaaagtagagaccaaagaaagaataacttgaacaagatttcagtgggtagaaaataaacactaactttatatgtatttcaagaacgtaaaagaaacaggtgggaaatgaatcctcctcgataagagagaaatgcttagtagggtggaaaaaaaaaaaaagacaacattcagcagtttttggaactgtgcgagtccagagagtttctttctttctttctttcttttttttttttctggttagctctcatagccacaaatatgtatattatttccttcttgcccacaatttactgagaatcatctttctaatatactggggaatcccaaataaaaatctcatttttctaaacacagacaagtcttttaactcctgcaattaaatgattcaactattcatatgtagactgtaaaagaaataatcaaattgttctagtagaaatctccaacggccatctcaaatagtttccttcccaaatttatactgtaaacggcttaggtttagggaggggttttgccctagtcactgatgttttgaaataggactcagaaacctctttcataaagtctctgcggtgattgggctaccccagcaatgtgatatagtggtaggattacagaatattttaacccttttctgaatgttgcaatatattcttatatgggaaatgattgattattaactacttagaatgtgtttcttttccaagcatgtcagcagagtaagtacagcagacttcgtaggcgatcagtgtagtgtcaggtgtgagcagtatggactggagatggtctgcctggattcaaacctctgctctgtcctttcttacccaggcttttctggggctccttctgctcatctgctaagtgccacgtattacagcattttcctcatagggctgctgtgagctttaaatgcgtttatgagttaactgcttagaacagtgccagctatgtaataaacactacgtaagtggcagctacaccatgcataaacaaacgcaaactgtgtgcatctgaggaataattctagttaacattaaagtgtgtttttgtgtacagagttggtgtctgttgtctgtgcattcactttttaaaaatcgggaaatagcagatgttaggaacctatttattttgcttgctcttccttctactttctgcttgctacctactctattctagttccagacttgatctgtttctctgtgcagggttgctcctatgtacaaccaatgcagaactgaccccatcaaatttacaaagtgtattagtctgttttcacgctgttgataaagatataccttagactggacaatttacaaaagaaagaggtttattggacatacagttccacgtggctggggagacctcacaatcacggtggatggtgaaaggcacatctcacgtggcagacaagaggagaggatcaagtcacatcttacatggatggtggcaggcaaagagagcttgtgcagggaactcccatttttaaaaccatcacatcttgtgagactcattcattatcatgagaacagtgcagaaagacctaccaccataattcaattgcctcccaccgggttcctcccacagcatgtgggaattgtgggagttacaactcaagatgagatttgggtggggacacagccaaaccgtatcaataggtatggaaggaagtaaaatactattttttggtaagagctctcccactaagatatgaggacatatgcagaaagtgaggaaataaaactcaaagaaagtgaggaaataaaactcaaaattggctttcaaaagcaaattttctgtcagtaagatgtgacacgaatgttaaagttttaacaggttttgtttccttgtaaatatttacttcactatatctaataatctttgtgaatgaagatctcattggtgtcttttttaagatattaagaatattaggattacttatatttgaggactaaaagattggtagagacataaatctatccttgtggcttctttgcatactttaatgctaaagttcagtacttaagattgaataaaaatgtcttgacaatcagatataaaataccttctttgggctgggcacagtggctcacgcctgtaatcccagcactttgggaggtcgacatgggtagatcacctgaggttaggagtttgagaccagcctgaccaacatggtgaaaccccatctctactaaaaatacaaaaattagctgggcgtggtggcaggtgcttgtaatcccagctacttgggaggctgaggcaggagaatcgcttgaacccggaaggtggagtttgtagtgagacgagatcacgccattgcactccagcctgggcaacaagagagaaactacgtcaaaaaaaaaaagaaaaaaaaaccttccttagtgtcagtcactcttttccttttctttcttccttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaagcccctattccgttccatagctcaggatgctaaatgagtttcaaccgtgtgacccttcttcaagtctcatattttgtgggactcccatgtgcacctacattattaaatatggggtttctttctgttaatttgtcttacgtcaattcataacccagccaagaaacccagagcggtggaggaaagccatttctctctcccctacaacttttaaatactaaaattaaaaatgtccccacccaccaatattggaactccgtggtatccataagctgggttgcatgttagtgattgtaataagcaataaaaatccttgcatgtcaatattttattaaatttgattattcatggatttgtgaccattattatttgctgtttattggtttgttgttgtttttaaaatattttacttggacttatggaccacatgtttgtttcagaaattcttcaaaagacagcaaatccctagtaagtgggaagaaaaatcacttaacagtattccaagtacctcaaaagatgcaaatatggaaagatgaatatgaaaaagggtactcctagagtttatcaattgtctatccctggagaaagtttccattctccattaagactccaacggctttgaatagtatatgtttttgtgtatacaatgaaaataaaccatcatcatcgtcatcatattaactgggcttgtgcccattgtagatttcatgaaaaataaccaaccatcaaaaatgacttgacaggagaagccaacaagccctaacattaaatggtcctgtaaaagtttgcaggtatattatttgtgtattcagtaatactctcaattagtgtttatgacttcattaacttaattcatttttcatgaatggtaaaaattcactctttcctacattcacaaatgataggctattttgatggaaaaccaaagactcactatatgttctcctttgcagtagcggtagtagttgcagccaccaacttcagatgtgcagttcctagtttactatgtgattcagtgtgcttttatggagggcctccttgtcgagagagagtataatacactagcaggagtatatgttttggagtcaaactgttcttggctcagatcctggcacagctacttgcttactgtgtggtcttgggcttcctggtctgtaaaatacccgccctgcagagttcttgctgagttgaagtgagaggatgtatgtgcaagtgtgcggtgcggcattcggtgggtactccacagcactggcttccctttccttccacactgggggcctgctgctctaattcctgttcaccaagtagacggggaggaagagagtggtgcctgaaactaccattttttttagtgagtcaaacgtgtcatgttgtgacatcttaggcatgtcccttcaccctgggggtcttggttaactcctctgttaaattcagagcttgccttttttttttttttttttttttgaggcggagtcttactctgtcacccaggctggagtgcagtggtgcaatctcagctcactgcaacttccgcctcctgggttcaagcgattctcctgcctcagcctcccgagtagctggagctacagtcacgcaccaccatgcccagctaatttttttggcatttttagtagagactgggtttcaccatgttggccaggctggtcttgaattcctgacctcaagtgatccacccacctcggcctcccagagtgctgggattacaggtgtgagccaccacacttggccagttgacctttactttatgattatttctaaagcacttccagatctatccttctgtgatgctatgatactatgaagcattaagttgagactaggagattaacagtagggtgttaaatggacaggactgatcacaatcttatatggtgaaggaagaaccaattggacttagtgacacattaaatgtgattagacatgaattggaaactattttgaggtaatgttccccaggatgccctctccaaaacactagttgctgaggatgggaatagatgttaattgaaaaaaggtttctgaaaagcatttgggaaatgctaacttcaccaggtttctttcctgcaggacttctctgattctttaatatgcccatatgcatgatgattctgaaattggggaatgtagtcatagtaggaagcatttctaaagcttatttcttcatggaatcagaattatgttgcacccaagtagcatcttacaggaccagtatttcatggaaaatactctgtgaagtgctgctctatggttttaaaccaagaatgaggtacaatataggggcattgactcaacccagtgaatgtgctgagcactgacctcgcaagatcctgtggagggcggaaatggataagatcccacctctgcaacaaggctggcaataagccattagtggtggcattgtctacatggctaatagcagggatgccttgggggagacaatatcccaccgaattactgatgcagattcagttgaggcagtatccccagggtgcaaagtcctgatttctctctcggatgtgcttattctctgtctctctatgaagctcttataatggtattagcatccagttcaccacggagaaattctgcagataaaatgaacgtaggagctaaaccaatgggaagtttcattcaggagaagattttacaaaatggactctttggacttcgtttttgagtacatagttatttgaccaccatttctacacttggccttaaagtcaaaatataatctaaggcgagaagtctaaaaactatgtagtagacaaccttgctttactgtgaaggacatggcatctcaatgttggcagaacctgacgacgtagtttgtttttatttctcattgatgaaagatgagccagaggcctgatggcagattttactgggaaggaccttttctcaccggtcagatccgtggattatttcaccactggatttttctgcctgttaggcctttggaaacattttggcagattgagcagttattttgctcatgttgtgagtagcgtttctctgaccttttgttatttactgaaacaatccagcctgttttcttttaagagaagcgtgaaatgaaggggagtcagtcagcacatgctgactctggtatcagaaggctaacttttgggctgcttggcaccatgtatgcttttaaagttatggggtcattggcctctttgtttcttattcccatgattttgaaggagtcttttgggggaatttttttttccttgctaaagcagatgcatgtaaggttagtaattaaaaaaatatatttcactatgtctataaacataaccctctaagttttcttacgacatcttgggcatggtagattatctgaagcctctcctcttttaaacattgatgtgacgtgatggggaggccagcttggcactggaatggtggcttggtgacagggcatccctcactcctgacctctcatgaccttgtgagtccagacagtggaggtgatgacaccattcaggacgctctccaccagccgcaacagggaactccttctccctagtgctctgcctacctatgcccagaaaacctatctccctgatgtttttctggttcttcccctagtagaagatttccattctttgcaggttgacttgcaaggataaaggaagtaccaagatcctattgtggccgggcgcggtggctcacacttgtaatgccagcactttgggaggtcaaggtgggcagatcacctgagatcaggagttcaagaccagcctggtcaacatggcaaaaccccatctctactaaaaatacaaaattagctgggggtggtggcgggcgcctataatcccagctactcgggaggcttaggcaggagaattgcttgaacttgggagggggaggttgcagtgagccgagattgcatcattgcactccagcctgagcaacagaataaaacttcgtctcaaaaaaaaaaaaaaaatcctgttgcatcttcaaagatgagaaaatgtgcgtgtgtatgtgtacttgagtatatgttcattcctatctccccatctatctacctgcctactgatctctttctagcccggtcagaaaattcaataggaatcatggcttttcattgggattccccatagcacttgagctcagctgctagtgttgaagacatcactcaaatttgtcttgtttattctcgtagccaaacataaaaatgatcattacctacataaactaacctagatgatcattaattgaggctatttaataatgatctgcatgtttgacaatcaccattgtctaagaatgggccatggctttaggaatgtttcattcatttcttcagtctttcagtcaacaaataacacactgtcctaggtgctggggacacagtgtgagcaaagggacacaattctcatggtgccacatgggcaataagtaaaaccgaaaaataagaacgtggcagacaacaaaatggataacgtagggtgtaactggggaggatggtgatatggtttggctgtgtccccacccaaatttcatcttggatcgtagctcccacaattcccacatgtcatgggagggagcgggtaggatgtaattgaatcatgggggcgggtctttcctgtgctgttgtgataatgaataagtctcatgagacctggtggttttataaaggggagtttgcctgcacaagttctgttattttctcttgtttgccgccatgtctttcgccttccaccatgattgtgatttataattttctttataaattacacagtcttgggtatatctttaccagcagcgtgaacacggactaatacagggggaaggctagtttaaatatgagtttcacaggacctgtttctttggcttgaggcctgtgagatgaggagccagccctgagaagtcctgaggaaaaacttggagacagaaggaagaacaaacggactcctctcccactgaatgacctcatgtatatgtttgccacttgggactatgacctgatgcctctttaaacctctaggtcattgggaacatccacaaaacagctgaaagatgctgttttgttagaatgctcgttgtaatgcaggatgctggtgaacccagtgtgaacttttcaaaaacctattgatcccaccccacccactctctagagctctcatattgacaaaggatacctttcacagattagaaagtcagtagactccatttcttagaggaaagttgtggaaaatacttaaaaatactgtgagtagaagaaagaagcagtttagagcttcaaattcaatcgggctaagttgggcaagctactgccttataggcagtaactttctcatagaactttaaaaagttttattttgcaataattatagacttgtgggaagttgcaaaaatagtacagagagggcccatgtactcttcatcctgcttcttgaatggtaacgtcttgcataacaatagtaaatggtatcatgtatatagcatcacattatcaataccaggaaactgacgttagtattaggccttaaacagatttcaccatggtttatgtgcactgatttgtatgtgtgtgtgtatctcaccccatgtctagattcctgtaaccaccaccgccatcaggacacagggttattccatccctaccaagaaactcccttgtctccctgtacttttatgtatgagaaatggcagcagatgctgtcctgcttttagtctgaatcatattctggaaaaatctacagtgagagaaggtggatgagtctttgaaatctattggttgaaatgtattggcactgagaatctgcttaattgatatagaaatggagttccttggtctgacttatatgaagaccatctacaagctcagaaccaaaaaacacaggtttgaataagtaaccctgaccacattatgagagtccatcagttgatgctcaattggtttaagaagctaataccagtcatgtggcctgagtagtttatttctaagaagaaaactctttctggcaccacacaacttgggggattaataatatatatatggagcgtttggcacatttctcgaagatgacccaggaagcagacacaccagtaatgggttaacaggtcacccgaagagtgggtgcattccttatggaaaacagaacacatgatagaaaaatagccttttgtgtgtggaggcaagaaacctttaggacgtgcagttagcagtgagaacttaaggaaggtgcaggctgaaatggaaacacgctataaacagattgagagagagacaacagctttaagggaaaacatctgtctggtggatctgacatccaaaagttgcatctgtggtctaggaccaatcttgtaacgcttaaaaaaggaatccacagaggcccaaagcgggctctgaaagtttctttctttccttgagattttctgtttgctctgcccagaatactgcctaggacggatgaaatgaactcatctggtcctgtttctcaatgctgaagtagcacgccagagaagttaactttagaacagttggttgcagcaacattttacctggattattctagacatactgataaggggagtccatttactctgccaaacgaaacttctggaaatctttttttttaaagacagtcttgctctgtcacccaggctggagtgcagcggtgcgatcttggctcactgtaacctccgcctcctagattcaagtgattctcctgcctcagcctcctgagtagcaggaattacaggcacccgtcaccatgcctggctaatttttgtatttgttgttgttgttgttgtttttgagacagagtcttgctctgtcgcccaagctggagtgcagtggcgcgatctcggctcactgcaacctccgcctcccaggttcaagtgattctcctgcctcagcctcccgagtagctgggattacaggtgcctgccaccacgcccagctaatttttgtatttttggtagagacagggtttcaccatcttggccaggccagtcttgaattcctgacctcacaatctacccacctcggcctcgcaaaatgctgggattacaagcatgagccactgtgccgggcctaatttttgtatttttaatagagacgaggtctcactatgttggacaggctggtctcgaactcctgacctcaagtgatccacctgctgtggtctcccaaagtgctgggattacaggcgtgagccactgcacccggccgcgaaacttctagaaatcttgagagtgactcttccaatattttgtatttcaagtagaagttttcagtaataatgaagttgaaagccagaagagaggagcagataatgttctcatgaagcctcagaagacattaggagcatctatctcgatattagattgaattgaaaatttgtcatattagtcccttgacttattcatattttttctcttgagccattggtttgtgttctgtaaacacagcctaagaggctattttaaaggaaatggagatcaggtgttctccatagattcccatgctcgatttcccggagtgggagcaggagagaattatgagcaaagagtttcagccctcaccctgggacattacccctcctccctgcacagacttcacagtgggatgctggtgaattttttaatgttaatttttatttttaaatttaacttttattttaagttcagcggtacatgtgcaggtttgttacacagataaacttgtgtcatggggctttgttgtacagattattttgtcacccaggttttaagcccagtactcattagttatttttcctgatcctctccctcctcccacccttcatcctctgataggtcctagtgtgtgttgttcccctgtatatgtccatgtgttctcatcagttagctcccactaataagtaagaacatgcagtatttggttttctgttcctgatgttagtttacttaggataatggcctccagctccatccatgttcctgcaaaagacatgatctaattcttttttatggctgtatagtaagtattcattccatggtgtatatgtaccaaattttctttatccagtctatcactgatgggcattgaggttgtttctgtgtctttgctattgtgagtagtgcagatgctgatgaatttgcacttcatattcagtgattttcgccttgaagaacataccttacccaatccatgttacttgaagacgaccgtaactgaggtgtaggaatttgtcctaaattactgtaaacaactttttggggcatttcacaatattccagcgcctctccgttccctttcattgtcttctccacctgatccctctttcaaactcttgtctttatttttatacatcttaccccaaacccagattgcagtaagattcctatgtgcattgccacatgcattttcagcaatttgaaattttatctaatatcaattaagctggtataaatcataccacttcacatacgtgaagttgtttgctacagccctgttctggagaacggtgagaatgccctccttgttttgtggcaggggtgaggggggatgttttaatgaggagagactggtaataagggattgtggtgaactggcaggggaggaaattcaataaacagaagagaggaactcaggatagttgggcactggagtgttgcaaataaagcaatatgtgatgctctccccatggaatgctcacctacgctatactcagaatccctgacagccgttttgcactctccaacactggcacacaatggggtctcagggtttgttgaaataaattgggctctatatcatgtgttccctgatttctcctcaataatgtgtgcttcccagccctgcattgaaaattaggacatcaagtgacattgaagtcagataatctgcctcatgtcacatgggttgaatgtggtagatgtgatctcaggtcttttgactgcctcatggcaccttccatttccaagcctctgttttctcatattcttaaggcacagaattcatcccattacttggtctggtgttgaggagaagcttggcataatggaaagactcaaatttcattctttttttccttcttagaagaaatctgtagaactgtttcatcacaacctgtggatagctgacgcagtttgaagatctacaccttggagtcacccatctcacaaaatgtcagccggggtgctcattggtacattgtttgttgtatatttcctcataccttggaaaggactagttgaatttgttccaaaccaagcaattgacctaggactttgcatcctattagtgtcggccacaattcaaatccaactccttttcaaagttgtattttttacgaaaggtgacctgatagcgagacaagagtaatgacgggtgaggcactctcaaatcaggccagggtggcaggccgggacatcttgttttcatcagattctcgtagttactcttgacttttctgtgtgtttgctgaacttgtgagattctattgtgctctttctagctggatattttccagagggttatcaagaaaaaggagtatcttctgcattaataacctcgggaaggattttagcagtaaaattagagaccagatgatctgctggacagcaggatgggggagcatttcttcccctttcccaggagagtgtcaagttcagcatgacctagcaccagacctttcactcagtaactctgagatcttatcatatcaagttatctcagtcatgatgacgtaaatggcaaaactactacccttatttcttgggataagaatttttcgctttaaaggaatacaatatacaaaataggtgaccatgaaatatgcttggtgggtcagctaatttccatatgtgctttgtgattggtttttaagtgaatttattgctatagagttccaaaacaaccctttaacatttatgttttctgcactttgtctcattattgaaaataacaagcgctatgtaaaagcgtaaagaatatactgaggtttacagcaaggataaccaccaaagaccgggagttagaaagctatggcctgtgggccaaatcttgctcaccacgtgcttttgtaaataaagttttattggaacatagctatgcccatttgctatgtattgtctatgtctgctttcacactgcaacatcagagttgagtaattatgatagagaccatatggcttaagatatttgctatctggtttttcactggaaatgttttccaacccatgctatagatattttcatggtatttatttactgactcgtttgttcattctttcagtggacaccaaccctgttaatgacgctggggaatgtaaagataagtacatcagtctctaatttccaagagcttataatgtaacagagacaagttatgtactcaaataacagagacaagtcatgtattcatctttacctctgaccaggcagaatgcagcacgtactacagacaagaaatagctaaattgctgtggtagtttagagatgatgagagcctccgacaaaggcagggaattgggaaatgcacaaagatattgcttccataactgtggcacacagtgatttcccaatagggaacttcatgagaaatcaggctaatttccttcatggaattttataaattgtagtatccaaaagagtggaagtgatttagaatattactttgtgtccagattcctttatctagaagcatatttcccctgtaactatggggatgatcatatttatagaaaatttttgaacatttgaaggaaggcttcctttatcagggtgggaagacagaaggaattccttttcttttttgctgattgttcacttcacagtgtaatattaaatgctatgggtcttaaagaaaggcttctgtggggaaaccctcaaatatcaagtggactataaaaacaagataggctgggtgcagtggctcacagcggtaatcccagcactttgggaggccaaggtggatggatcacttgagcccaggagttcaagaccagcctgggcaaggtggcaagaccccgtctctaccaagaaatacaaaaattaaccaaacgtggtggcacgtctgtagtcccagctacttgggagtctgaggtgggaggattgcttgagcccaggagggagagattgtagtgagccaagtttatgccactgcactccagcctgggagacacagcgagaccctgtcttaaaacaaacaaacaaaaaatcaagataaaattatagaaccctaaccatggaatagcaggactcagtgacaattacatctctctcttctccacaatgcatgcgagtgtgaactgagattttggtaagttcccatttccctttggcctattgaacccctttaagggttcagcccccaaccctgggaagattccatgcatgaaaactacccaaatcctcccagttgggattaatgtgacctgataaagagttctgatttttttttttttttgagacagagtctctctctgtctcccaggctggagtgcagtggcgcgatctcagctcactgcaacctccacctctcgggttcaagcaattctcctgccttagcctcccaagtagctgggattacaggcatgcattgccatgcccggctaattttttatttttgtagagacggggtttcaccatgttggccaggctggtctcaaactcctgacctcaggtgatccgctcatcttggcctcccaaagggctgtgattacaggtgtgagtcactgcgcctggcctgatttttatgtcaccagaattgccttgtccattatttgtgttttccaaatatctattgaattaactcgaattggatgcagacagacattgtgcactcaaaacctaggtgattgatttggaaaaagattcaagacttttaggttagtctaagagatgctcaggggaggccccttccattttgcttccagcagggtgtcaaagttattggctaaattccagcctccctttctttatactcataacaataaaggtaccagcatgaatgcagcagagttttgttttagaatataatcctgtgaagttttaccagccgaaagcataatatttggatggataaaatgtgtgtttggtgagaaagctactgaaggaacataatattggacccccaatcaggtaatttaaatgttataggaagcaccaagcccacctatttcacaggcccccgcctctcccctacccggagtagcagggctcccgcagttagccatcccacagctctccaggggctctgctctctcgttaccaagaagcacatgccagcccgtctcccagcgtttcctggtcctttcacaatagacagatggggatgctccaggtagagacaaaagagaacacacaatccatacgctcatcttgctggtacccttccgctccctgagcccaaagaggagaacccagccctctgcgtaggaagaacacatttcaaggcatttactgacaagtaggtatagttactgcatacacatgtggaggctgcattatatcaaaactgtaaataaacatagactctgcacactccttcaggccccaccatgtatttatgaatgggattgcttcatcattttcttttaatgtcagtagcagggaagtcagaaagcattacctctaaaacggggacagaacattgcaaatacatacatttccaaccagctgtggcaataaccagcaaacaaaattacttcaccccgttgttatgggccccatgcctatgggatttttcctgagtttctgatttataacaatcacttttgaaggcctcaaaatgcttaggtgagattaaattactgattatccaaaagttctgttttcgctggagtctttctggacggctgctgattcggtcccatttaaagcattcggtggcatgaactcactcggtttctgcccacatcactgcattcctgggatgccgttcacaggccttagcaagatcatctgacagccgcctgtgaggtcaacgaactttatacataattaaacactcccagttaggagaattcatttctttctccctgagaagcagagaaagaatacatgttgtgttgccctccattacggagtaaaagttgtgtggagtaatcaggctagtttcacatgatttaatgttgaaccgaataagaaagtgattgcatcctctactgggcctcacagaaaagtcaccacccacattgtttattcagactgggatcttggccatttggggtttaagccagaagaaagaggaaaaaaaaaaaatccaaccctggaatgaacgcttttgaaactctgtattcttgatgaaatgcggccaagggttcttttaaaaaaaactatttaaaatcaattaccaagatcatattttcatttacaatgggttgttagcaacagctaattctctgtttccatccagatttggtgtttaagcttcaatatgctggtattggaatccttgccgtgttttgtctgggtatcagatgctaccaccaaactatgtgtggggagttgggcaactctgacctttgaccagctttccataaaataacaaggaaaggtgtgaggaggctagggattgggtgaaaactagcctgagggatggcagtaagtgagcttcaccagggggatgaacatataaaggaggcactgaggatattgctaagggtaagagaaagcaaaagacagaatcatatgccttgggaggagggtcaggcccgttaaggcacctagtccgtctgtctctagccaggactgcaagaaatcatctcagacatgcgatcttgtatcgcatttttaaagatctcaagaggagattccggaacctcccttggtcatccgccctattatttaacaattcctacagccaggaaattctttcttatttccagcctaaaatgtgcatgtggtgcagcttcaggggaggtgattgatcgaggccacgcccacctcccccccgcctgtttactccttggatgggatggtgcatatgtcttgcttcttccttaaaatgggcctctctcggcctccataccacagtccccgggctgggagaggggtcgtggtatagaggtggggtgggggccgaccagcggcgtttatggggaccagccgccaccaggaactgttgctaggcattttatgtatttcccagaggcaagagaacatagctgtgatgtggccaggagtgcgcctcaaaaccacgtgcaaataataaatgcggaagctcccgtttcagattttaaaagaaaagaaaagaaaaaatcctgaaaaacagaatgaagagtctagaatttcactggcctcgagatggtagtctactcctcaattttaaacaagaagagcccagagcagaaaagggacctgtcccggacaagatctcagagctaatgcccctaaacgcagcgcagtgccctgttcttaatttagatagggtgctggaaaggcgaaatcatgctggaacggaggccatcgatctcacttcctccggccccttcctcctcttcggcagatgcgcagtgaatggtcaggccctccgtgagtgaattacagattcattgaagagccgtcagatgaccggagcagtctggtttcttccctttttatcgagttctgtcattgtgttcctcaaactgtggtttgttccagaaaggaagaggttgtcttcttcacccgcctgccctaagttgcgtcaagttccagttccctgtattaagtaaattactaaatgagtggaatgaacatcataatgtcaagggtagggcgttgacattatgggacaatagaccacgagcccactctgtcagctttttgtcccgcacctctattatctgtcaaatgatcatattaacactctcctacctactttagggggctcctaaaaacaaatatttattgacaggttatgtattagtctgttttcatactgctatgaagaaatacccgagactgggtaatttgtaaagaaaaagttttaatggactcacagttccacatggctggggaggcctcacaatctgtggaaggtgaaggaggagcaaaggcacgtcttacatgagggcaggcaagagagccatgtgcaggggaactcccatttataaaaccatcagatcttgtgagacttattcaatatacgagaacttgggaaaaacccacctccatgattcagttgcctcccaccaggtgcctcccatgatacgtggggattatgggagctacaattcaaggtgagatttgggtggagacacagccaaatcatatcatcttataaatgtagaacacaaactccatgatatcctttatataaagtttaaatacatttaaaaatatatatatatagtttaaggatacacacatgtgaaagataaaaccatgcatggtgataatgagcattgagcatcacacagtatttttttattgtgaaagatctcgagcaaacagaaaatgcagagaataagattgtgtataaatgtgcattcaccactattttgtcatgtccttgttcttttttgtaaaaaagagatagactttccccatttccacccgctttttccttccctgaacgtcacagtcatcagtttaaatgtgatgctcaatgctcattataaccatgcatggttttatctttcacatgtgtgtatccttaaactatatatatatatttttaaatgtatttaaactttatataaaggatatcatggagtttgtgttctacattgtatttgtaagatttgtccgttgcaaaacatggacctctatacattttccatgctgtgttgtagttatcagatggaggacatggaagttatttctaattttaagatgtcctttggaagaatgctacaggtgtgtctagctttttgatatgttctttgcacaccatgcctggtagtttctcttggatatgtagccagtagcaaagtgatgaattagcacatcgtcttccctggatgttgccaaattgctctccaaagtgcaagccccttctcagcagcagggtctgagaattcctaatgctcagtattctcttcaatacttgttagagtcatatttaaaaatttttttcctttgccaatctgatagttgtttcaggtttcagttgcaatttcctgattaccagtgaggttgagcatattttcatttgcataccgagtagtcaggatttcctccatgagttatctctttctttccttggcccgtttttctattggttcgttgtttctttattggcttattggagtatgtaatgtatgcttgacaccactcccttgtccattatatgcacagcaaatatcttctcttggttttgtaattttattttgttgatgatggtctgctaagagattttcattattccttttgttttattctcataagagatctgtgagctagatgctatctctgtttgcatttttagatgaggatagtacatcttagagagtttaagtaaattgactaaggtctcacagctggtaagtagcagagctgaggatcaagtccagatcgaattccagagcccatgcgcttaaccactgcctctaagtcataactactatgagtatccccattttacagatgagcacacagataaggcccagagaggttcactgatttgctcagagtcactcagcgtggtagtgttggaacaaggactgttcctcaggtcccagactgccaacacaactgtatacctagattgaaatgttggggaaatgatcggtgatagactagataaaggaaatgtgatacatatacaccatggaatactacgcagccataaaaaggaatgagatcatgtcctttgcagggacatggatggaactggaagccattatcctcagcaaactaacacgggaacagaaaaccaaatactgcatgttctcacttataagtgggagctgaacaatgaaaacacattgatgcagggagggagacaacacacactggggcctattggagggggcaggaggagggagagcatcagaataaatagctaatgcatacggagcttaatacctaggtgatgggttgataggtgcagcaaaccaccatggcacacgtttacctatgtaactaacctgcacatcctacaaatgtatcccagtgcttaaaataaaataaaattaaattttaaaagaaaaagaaaatgttggggaaatgtgcagaaaaagatcatgtatacccttttaaacagtaactttaaaaattatgaactatttaatatttaaaatacaaaatttacagagaataatatagcaaacaatcaggtaccccaactcagatttaataaatattgacattagccacattttaaaaatattttttaacagaaaatgttgtagtttaagcctcttttgtgaccccaaactgacagcattcttccacagctttcccagcagtaaacactctttagaagttgcactgttacatacctgttgcattttgctatgtgattatgtgtcataagccaggggtccccagcccccaggccatggaccggtacaggtccgtggcctgttaggaacctggcagcaccgcagaaggtgagctgcaggagagccagcatgaccacctgagccccacctcctgtcagatcagccacggcattagattctcataggagcgcaaccctattgtgaactgtgcacccgagggatcttggttgctcgctccttatgagaatctaatgataaatgtaatgtgcttgagtcatcctgaaaccatcccccacccccgtctatggaaaaactgtcttctattaaaccagtgccagaaaggttggggaccactgtcataaacaataactagtatcattttgcaagtttaaaaaacgaatggtaatgttatcaataatccatctttctggaacttgctttatcacttgaagttatgtttctgagatttatcctaattaatgtatgtagagctaattcctttaactgttatattgttataaactgaatgtttctttccctgcaaaattcatatgctgaaatcctaatcccaaatacgatgctattaggaggcaggattttggaggtgattaggtcacaagggtagagccctcatgagtgggtttagtgcccttctaaaagagaccccacggagctctcttaccccttcactgtatgagggcacagtgggaaggtcctctatgaaccaggaagtgggtccacaccaccacatctgctggctccttgatctgggattccatccttcagaactgaaagataaatgttacataagtcacccagtctatggtatttgtgttatagcaacctgaaaagactcagacataaaccaatttctttctataaatatatcataatatatccactccctaactgatgtttccaggttgtcattttataaacagttctattgtgaccttctctggacttgtttccatgtggatttgttgaacttttcaaagatacagaagaagtggaattactgggtcttggggtacaaacatcataaaggttggtaggcgttgccaaattgctctcagtttgctttcagcaacaatgtgtacaattcttattattctgcatcttctcccactcttgacattgttgggcttttaaaatttgctaatctgatgtattgaaaaggtatttaattgtcttgatttgtatttctctgattacttatgaggttatgtgtttagtgttggtttttcctacggtttttcatcatttgggatttttttctttctctttgtattacctgactctagactttgctcacttttttgtagtgggttgttttttccttatagagtactaagtgttcactaaatattatgaatacttacagaaattttctctctccaaggctatttattgcctttaaacattgttttttggcatccttcatcacagaatgtttaacatcaaatttctcaattttatcttctttccttcttcttcttttttactttatggtttgtatttttttttgtcagtccctcacttaagaccataaaaatagtgtctaaaaaacattttttcctaaatgttttaaagttaactgtaattctcttggaattcatttttggatatagtgtgagttagtgatctattttttttctccatatgggtaacagttgtctgcgaaccacctattagtttagtttttgttttccccatagtttgtaatgctatctctgtcacataccaaattcccacatgtgtggggctctctctattgcgttagtctagttatctatatttacaccaatactatagtgtcttaattttatggcataattaagtatattgtatatgtcttgatatctggtaggacaagtccccatattattctttttcaaagttatcttggctgcttttggaccacaattttaaaaccggttacaaatatccatgaagaaaacctttctgggatttttatatgaatttcattcaatttatgtattaattttaggggatttgatgttgaaattgtggaatcttctcactcctgagcatgagatatatctctgtttatttaggtcttatgagtttcaatgaagttttataatttttttttccatataggccttgcacctctttctttagatttattcctaggtacctcacaggtgtaagatctctattgctaatgacatcttatgaaaattacattttctaattggttgttactgatgccatggatgtttgtatattaatcttgtctccagcgtccctgccaaaccctcttatttcttgtaattgttcatagtttctcatggattatctatgtagacaatcttatcatttgcaaataatgccacatattcccccttcatttctaattctgattttcttactcctttttcttgctttattacatcagcaaggtatctcatacaataatgaatagagtggtgagagagaagacatatttatctagttgctgattttaaaggaaatgttcctaaagtttcttgtaggttcttaggagaaacttccttctgtttctgttggctaggtattttattttatttttaaattgtgaatgggggttaaatttgttaaatgatttttctgcatctattgagatgattatatggtttttccttcctaatttgccaatgtggggaattacattaagattttctaatgttgactcttacttgagcttctgggataaaacctactgggtcatctcacacacattccgtatatttattgtgtgataaacatgatattttgatagatataatctcaaatatgtatattaaagaaatactatatatttgtgcacacactatactgctggaatttttgctaattttttttttcagattttttgcattgatactttaactgagattgaccaatacttgcctttttttgtattgtcttagtgtttttctacaatgtaggtttagactgaactcataaaaatacattcaggattctttgttctttttccatatttttatgtgtcaactttggtaacatatttttctaaaaggttttccattttatctgtttttagatttattgctttaaaatacagaaaagaattctcatgctttaaaatctttactctatttagttatgacccattttatgcctaatagtgtttatttgtgctctttctttttccttgctcaatcttgtcaaatatttacctattttattagtctttttaaagaatcagcctctattttgtttctattctctattgtttctgttttgattctattgatttgttgtctttattattgccttcctgctactttaaccatgtgtggaaaaaggattttcttctattgtttttgagtttacattgttgccctttctctaactttcttaaaatttttcttgtttactaatattaaattcaatgctaaacattttcttcaactgaaatttagggcttcagttgttcagtcctaaatatgttttactttcattttgatttcatattaataatttagcagtgtgcttctgaaatttcaaaatgtacttgggtttagggattgtggttttatctatctcaatttttttattgtattttggttgaagaatgtggtctgtatgataacagttctttgaaatttgttatttgttctgtggcctggaacctgttcaatttttatgaacatttcatgtgcattctctatttattgggtagagaattctcttcccatgtcattagctgaagcttgtataatgccttatttcaatattaaatcttttcccttttttaaaaaaaaaacttgagctgtcaatttcatagagatgtgtactaaaaatctcccactatatgcttctggcagatcatgtgtgttaaggaatcacaaatgtggtaaatgaaacagcatatccaaggcacccatccttgcaggaggataaagaagatcctcatggatgtgacattttagctgaacaggagtaggccaagaaattcttgcattgccatagaggaacaccggagactgggtaatttataaacaaaagaggtttaattgacttacggttctgcaggctgtacaatcatggtgccagaatctgctcagcttctaggaaagccacagggagcttttactcgtagcagaaggtgaaatgggtgcaggcacatcacatagccagagaaggagtaagagagaggagacggggaaggtgccaaacactttgaaacaactagatgtcatgagaactcactatcacaaagaagacaccaaggggatagtgctaaaccattcatgagaaatccagacccatgatccagtcacctcctccttcagcattggggattatatttcaatatgagattcggggggacaaatactcaaatatatcagttaataacagaggacttcattctaaatgcaaaggcacacaatcacaccacctaaataccactttcctgtattctattttcttgcatatttttgacattttcattgaatacctcaatttttaaaataataaattgaatacatgtaaaatgattttcttctatttttaatgtattaagttcaatagagacataaaaaataaaatataaataaataaataaataaaatctcccactataattttgaattgttactttcttgtagttaattcaatttttgctgtaaatatttgacactgcgtcatgaggcatacaaaaggattctggtgaatatatcttcatattaacaagtgatcctctttatccctcaaaatgcttttggctgtaggccgggcgtggtggctcatgcctgtaatcccagcactttgggaggcagaggcgggcagatcactcaaggtcaggagttagagaccatcctcgccaacatggcgaaaccttatctccactaaaaatacaaaaaaccagttgagcctggtggcacatgcctgtagtcccagctactcgagaggctgaggcacaagaattacttgagcccgggaggcggaggttgcagtaagcggagatcatgccactgcactccagctgggcggcagaacaagattctgtctcaaaaaaaaaaaaaaattgcttttggctgtaaagtctgttttatcagatccgttcatttattcattcactgattcaattaaaataaacatttattgaacatttattgtttttaaggaatgtcctaaacactggagatacagtagtgaacaaatgagaaagtccctactctcttggatctgacagatcttatattttatttggagatcacagataataaacaaacaaaatatataatttgtcaggtggtatagtgctataaagaaaaataaggcaaggtgaggtagataaagttatgctggggggtataaagttatgctgttctatatcatgtagtcgtgggcagctcttggattagttgacacttgagcagaggcctgaaggagccacctgatgtttatattgcttatataaactgaatgtttgtgtcccaccaaaattcatacgcagaagctccaacctctaatgtcataatatttggagatgaggcctttgggaagtaattaaagttacattctctactgtgtattccatgcttattgggtggagtgttctcttcccatgtcattaggtcagaacagcagggccctcacaatggcattagtgatcttttaagaaaaagaaggaagagatttttctttctgtatgtacacctgaggaaagaccatgtgaggacacagcaagaaggcggccatctgtaggccaaaaagagaggcctcaccagaaatgaaatcagccagcaccttgattttggacttaccagcctccagaactgtgagaagtaaacttctgctgtttaagacacctggtctgtggcattttggtatgacagcccaagctgatttgtctaatgactataccaagttcttgtgagcatttccctatggtattgctttctcttcctttatgttaatccttgtgttttaggcttctttcttgtaaagagctggagttttaaaaaatccaatctgaggttttctgtcttctaacaggttaaagtcatttatatttattatgattactcatatatttggaattcactaggagcctgaatgttttctatataccatgctacttctttacttgttttttcttcttattctgcctcacattaaattacttgactttttcttacactgttttccactgatttgtaatgtatacattttgtcctattgttttgacagttgttaccctcaaacattaaaaattatatttgagagctgggcgtggtggctaacacctgtaatcccagcactttgagaggctgaggcaggcagattgcttgagtccaggagttttgagactagcctgggcaatacggtgaaaccacgtctctaccaaaaatacaaaaaattagccaggcatggcatgcacctgtagtcccagttcaaattccttcttactgaagtacatccttgaatagctatttcattaaggatttgggaatattaaagcatctcagtctctgactgaaagtatctttaattcactcttggtcttgaataataatttttctaggtatagaattttacatagatatcttccctcagcatttgagtatattatttcattaccttttgatttgtgtaattgataaggtgtagtctgcttcaggctgtcatttatttagagggttctctctctctctctcatattgctttaaaatttttttttgtttttatctttggtgatctgcggtttcaccacaatcctgcttgggattcaagactaagaattcctgacattcaccgattctgaaaaattttgtcctagtctctgaatattttctctcctcagtcctctatttatctatctgagtcctcttttatatgtatattggaccttgttattctctttttcatgtctctgaatgtgtttttcagatttctcatgtctctcttttttgtgttctatttttttctttaacatctccctaccttttttattcctgtccctccaaggtaaccaatgttaacacttggtatgcattcttctacatgtttctccaagctcctataaacacatgcacatatatattcatatatatcttaaataagggtgttttgttactgttgtttgcaaaaaaaatccaatcatacagcatgtattttttcacaacttgtttttctctcttgatagtacatgaaggataatctccagataaatggatacaaatttaattcatttttaaaaatagctaagtaaaattccatgttatggctatattatagtttattcaaccttctccctattaatgagcattcagattgttttcagttttatgtcactgatagggacaggagacagggaaattctgggcagaagagggtgggtcccagtgagggccccaccctcaagctgaaaagcctgataccatggtccaaagggagaatttacatccctgttttcccactcgaatgttgccttttccaaaaccacccatggcctgccctgcctcccatcctgagcccataaaaaatccctggctccactggcagagagaagagaagcagctggatgttgaagactacagttggacgttggagagaagtggcttgagttcagagggacagtttgacggtgtagcttcagacaggagtttggccagggatggctggacttcaggggaagattaccttccatccccgtccccttttcagctccccttcctactgaaagccactttcattggcagtaaaatcctctgtatttaccatcttcagtttgtttgtgcgacctcatttctcctggacgccggacaagaacttgggtgccacaatgcaggtgtaaaatgctgtgtcacactgaccgcccccactgagctgttagcacttaaggcgtccatggatggcagagctaaaagagtactgtaacctgtcctcttgggcttcaggggttgcaggcactgctccagacgctgctgtggggctggtatggaattcgctccttccagcacccaaaaagcactcacctggctcctgcatctactcacctgcgtgctccacctccgtgaggggtggagtgcagcatgtcttcatgagtggagttcacccctgccagtgccagagtggctggcaagttccagcgcccatgcactccagttcccacccatgaagcgttcagggaaataatcctgcttcatcaccacaaacattgtggccataaacatccttgtgcatatttacttatgtgctggttccttaatttctgtggaagccaattcaatgccactttacttaccccagtccctattctcaaagaatataactttgtatattttagctttttcttctagcatatatatgtctctgcatttctaaataatgtatatactgttatcttttgtttcatcaattttatgtatatcttaaccttatattatagtagataaaaatttacctgtctgatatgatcatatccacagcttcctctcccctctttctcccagtgtagttatattacaatttgggggtaaatcagcccctagtgttttcactattttgtcaaaataaatggcattaacagctaaacctttaacaatgaagttaatatctgtctttttttcatgtccttaattgatctttgtacctggtacagacttttcctctatcttccataggctcacagtacctttttccacaaagctgatcacattagtaatctgtcagttctccttcttttcttggtgatatctctgctggagacctacattttccttctagctagacttctctctcggcctgctagatagctgacatcctgagatttgtcttcactgttattctagaacttccctttgccttttcttctgtgttggattctctctcttgttttaccccattgtttgaggaagcacagcctccagcagctatcagaattaaaacctggtgcagtggtaacagccttcatatgccttgctcttggtctgctggccctgtctggatgactggtcctgtggctgagccagtcatcatcctggggtatctcacttcagtgccgtcatccctctgttgtggtcctgtgttagttctcataaaactccctttacactctctcatttctgtggctcccagcttacagtagcctatggaaaatggatccctgagagacacattcacacttcacatgtctgaaattgtcttcattctgttgtgtcacatgatgacttgtctgtcttgtacgggaaaatccaggttaaaaatcagttttccccagaagtttgaagatattgctttattgcacgcaatctcccaatgttgctatcagaaagctgccactgttctgattcttgatgttctgtgccttaccttatttttcttttcccctggaacctctgatttttcctgtccccctatattctaaatttcacgatgactgttctaattgtgggtctgttttcacctgttgtactcagtgatcattgtggtctttcaatctgtcaagactgtgttctctctgtaagctgctctttctttccagaacttctattatttgggtgttgaacttcctggacagttttgtgattttttcatattttctcacctgttttccatctctttatcttttttcactctttttgtacaatttctttaacttcaatttccaacccatctattgggttcatttctgttaccgtcttaagtttcctcttttcatctataaatagttttttaagcattctgttctgttttcaggatgtgtgtcattctcttagttttctgcatttttttttcttttcagaaattgtctttgcctctcctggtctctgtctcctccatgttgtctttttcagtctgtttgttttgaactctgtctttcctgtagagactttccttgcatgtcgggcagtcctgattgtctgaccatatttaagaatgaataacagatgtattgaaagctctgaggatgcgtgagggacttgtcaactctgagcatcactgtagaataaaatgtttctgtcataggttggagaactcctaatgctaacaactcctaaagtctcctaatgggaaaaccagggaatggtcagattctccagagaacactcttccagactcctggctgcaagatgccgccctgcctgtcccaggctgggagctgagatgaggaatgagactggagggttcagccttcagcatgcatatttccttttatttgatgtgtggcatctcccaattccaaaatcctctcccagagttcaaacctccagtattagcagttgtgataaaggctgctgcctagcagggtggattcaaggaaaggatccagggatctaactgattcttaaacagtttccctcacattcttctttatttttttttttttttgaaacggagtcttgctctgtcgcccaggctggagtgcagtgacgccatcttggctcactgcaagctccgcctcccgggttcacaccatgctcctgcctcagcctcccaagtagctgggactacaggtgcccgccaccacgcccggctaactttttctatttttagtagagacggggtttcacctgttagccaggatggtctcaatctcctgacctcgtgatccgcccacgttggcctcccaaagtgctgggattacaggcgtgagccaccacgccctgccctgttcttcttattttagtgactcatctcccttccgcacagttccagaggtcaccggtgctatctgttcctgagcctttggaggatccactggttgttcctaactttcctgctcctcactgaggattcagcttcctttgtctgttaattctatcactgcttctccatctgctttccgtcttctaaaatcttattactgttatttctaaaatcttgttacttgttaaacctacaacatactaaacaatcctggaattggttgtaaaagggtcatggattgccagagatcaaaaggtatttaaaatctcctctcctattgtcctggtggttttatgtcttttaaaaggtcatcttccctcgttacagtgacgtttcaggtgaaagccatattagatacagtgtgttcaattctccatttttgcttggaagtcctgtgttacattttggtttaattttctcaaggctgtcttccggttcactgatggcctgttttgtgttactctactgtctaacctttccattgagtgattactaggagttctactttattttttcaaatctgcttattctctttttttcatgtaatcctaattttctccttatggcttttagtctttatcactataatatttttaaacaatcttattttgtactccatttgagattgtatctttccagttcttaggatttaaagtttttttttccctttatcactgtccctcatggcagtttatttgtgtgtgtgttggggggtgatactggcagttcaacctcagatatttttccttttctttgtttcttttttctttctttctttcttttttctttttctttttttttttttttgaggtggagtctcacttagttgcccaggctggagtgcagtggtgcgatctcggctcactgaaacctctgcctcccaagttcaggtattactcctgcctcagtctccctagtagctgagactacaggcatatgccagtatgcctggctaatttttgtattgaaatgggatttagccttgttggccaggctagttttgaactcctgacctcaagtgatctgcctgcctcagcctccaaaagtgctgggattacaggcatgtgctgccatgcccggcctcttttctataggaatcttgtgagtcctgagttgtgaaatcgtttctacatagtggacatatgtttgtcttttctggagatctaaggactttcaatgatcctagaactgtgtttgtattaatttattgtcatgggattcccctactcagatacacaggtagtataaattccgatcttacaactgaaagtggttcatgcttaaggttctgatttcccaaaggtgtcctgagctagggatacaagggaatgttctgctctttatctctgaggcagtgggcagagtgctttagtccaccttttcatggttagggtgactttttgaggctttgagatttaggaaaggggctcagttctggccccgctacctcatgcaagaccaaggtcatgtccctgcatgggcattagaatctcaccactattcccagggcttcgggagcatttgcgagagtctgaaacttccttgagcactgtgtagtcagccttacataaaagctctggcttcaattttatctttatttctggggcctctgtttctctcccttcctctatcccccttttccttccttttttccctttttttcccccaaacttaactctgtgatattttcttgggaatttcacatccttgtagtgggaagggacccatatgattaacctgttgtttgccattttgctgaaaatgaacactcacatctaattttgtgttaaacctggaacatactaaacaaacctggaattggttgtaaagggtcatgggttgccagagatcaaaaggcatttaaagatccgttgtccaaccctagcattttacttaaggaaactgagcctcaacactgataaaaccacttgcccacagacacgtggccagttagtggaaaaggtgggactgacctcaaagagtggtcacttttatctcacagcatcacaaggaggaacatctgacagcacttgccaggttatcaagacaccaagatccaatgcttgttgagccttaagtcactgagacattttggaaaagccacatataccatttgtgtttgtcttgacttgctgttgtgtttttctcttcttgaatacagagtagtaatgcttgttgaattatttaagtggcttattgctgtgccagtttgtttgtttttctacctttattttttcaaagaaaaacgcctttttttttttctccttgaagacgtctttcaggatccatcacctaccggaaaccttccctgaagtctgaagctcttagagggtttttcaccttttctagctccttttgaaattgtcatttgaaccatgtcattagcaccatatgatgaattcatctgatcctctttaattgttgaatatgtatgtgcttcatctccccaagattgtaagtgctagcttgcagaaaccatggcttatatatctttaccattttccaaagtgttttcctgtggatgagttgatgacgaaaaacctagaggaaatatgttcttttagatagagcctgagtttggtgtcaggaagcctggattctgccccatttctctgctccctggtagacctatgcaaaccaccgatgttgtatggagaaactactggtgtctgacaatagcactgatacagtggttgtaaaatttttcatgcaagctgggacagttttcagagtgaaagggggcaatggtaataattgtgcagggacaacaggtataaattgggactttccctaacatgctgggacagacggtcaacttatgttctagatcaccttgagctcgtcagaactatttgcacagctgctcttgataccagtctttcaaacaaaaaattatcatcccttacaaaagttttcatccacgagcccaactttacaggtaataaaatttttagtttttccagacattcttgttttttcagctacttccatggctccaaatgcgcattataactgaagttaaactagattgtagatttgaagattagtactgctgagtaacaaatgccttcattcttctttatcaaccactctgtcttctggaaggaaataaaggccccgatttctggagttctgagcctacttttcttgggtgcattttgaaacatacggattttaccgctagtatattcagtgaggaaggaaggcttctgaaggattgatgatccccaaactggattatgtgttcatgataatggtgtatttggtggcctagcatagtgaggtgaggtaggtctttaaaatggctcattataaacatcattgttcctgagctcacttgcccttgcatctcctgccagagtgctttgtacatagtaggccctcatcaatgcttgtagattttaaattcggaggcacacttggaagacaatggtggctggtaaattaattatcagggttagcaacttcatttctgcttacgcttaaaaagtgctgcgtgaggaggctgagacaggagaattgcttgaaccagggaggcagaggttgcagtgagctgagattgtgccactgtgttctaccctgggcgacagagcgagaatccgtctcaaaaaaaaaaaaaaaaaaaaaaagttctgctgtggttgatacatggtgttggaatgcaaagaaaaatagagaagatccctgccctccagaactttgtgacctagaggcaactttagaaccataagccactaaaatttagaaagttcaggagaaaggacaatcacttttgacttggaggaatgaggtagcacttgagctaggtttgaaaaataagatttttctctaggactgaggtgagagaaggctgttccacatggtaggaacagcacaaacaaaaacctgcaagagtaaaattgcaagccatatttggagaatcagaaaaagcctggtatgttcagaagataagatttaatgatgttggtttggggaagttagaagtcctttaatgtcaaatgatggaactcaggttatgttatatagaaaatggagtcacataaagtgttggatgagtgcagtgatatcaaccaactcatgctttagaatgagaacctggttgcagggagaccagttaagaagaggcttaggtgttcaggagagatataaaggcaggagaagaaaaaggagccagaaatgagattcagaattggcagttgattgaaggaagggccaaggtggagagaacaaccaaacacaatcccaagggacagagtggatggggacgagtggagggggatgagtagatggggatgagtggaggatggggatgagtagagggggatgagtggaggatggagatgagtggaggatggggaggagtggaggatggggatgagtggagaatgggatgagtggaggatggggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaggatgggatgagtggatgggatgagtggagggggatgagtggatggtggtggagagacacagagaggatcagaatttgattggccaagactctggatttccagggaggttgtggagagataagatgaaatagtatgtgaaagaactttgaacaatgctttgcataaaggagatattcaatgaacattaaattgaaagaaaaagggaaggaacgaaagaaaaaaaagaaagggaagaaggagcttttcccttctctctacctctctgctgtgccccagtagggagagacattgagggttttaggagatctggtgggcatttttcctgggctgttcctaccaatagacttgctgctggtttcatgttagttaggtggcacaccaagaggggactcagaaagaacagaagatcagaacttgctggtgtcagacagaaaagacatgagcttgagccacatttgaagaaagaaagagaattgggttgatgaaaaggccatactgagaattatgggagtagaagttgtgaaggcaagaaggaagacggaagaaaacacaccaccgatgcagagaaagagaaggatgctgactgaccttggaggcagtttctgcatgttctggggcctatctttctatccttccctctatccctcccttccttccttttttccattcttctatttttctgaactcaactctgtgacattttcttgggaatttcacatcttcgtagtacaaggaacccataggactaacctattgtttgccattttgcttaaagtgaacactcaacgtctaattttgtgttaaacctagaacgtagtaaacaaaacctggaattgattgtaaagggtcatggattgccagagatcaaaaggtttctaaagatcactttgtctaaccttagcattttacttaaggaaactgaggctcaacactgataaagccatttgcccacagacacgtggccagttagtggaaaagctgggactgaactcaaaggatggtcactcttatttcacaacatcataaggaggaggcctgtcatttggcggtcagcacttgccaggttgtcaagacaagatttgatgcttttgggaaatgtgggtgaactattggggatcattggaaggagaacgttgcttaccttctgaccagcctatcctgaaactctgttaggaaaaccctactactctatgaaaacaaacccagtttctcctcatttttttcctgaccattgggaataacagcaagacagtccttttagtgattagaaaccaagtcacattgactttttctgacaagccactccaggataactctcaataaattattttattggaagtactggctggtactttgccttacagaatgcctttcggtttctttgtcttgggctttgattatttggtaaacatttcagtttcatgatgacgtggtgtttagatggcaatgcatgaattgcattactaaaattgtttgccttcagttatattacatctgcttcaggaatgctagagaacataaacacagtttatttactaaactacctcagttggagcatctgagagagagaaagcataaaatctggtggttggcatggcgtctcatctcgagtcagagaatcttgaagctgggaggttcttttggaagcctcctgctgccgccttcttcaacgtgatgccaccatcctccccctgaatgtgtctaacaaaaggcagttctcagaatgtgccaactgttagaagaaggaaaaccacaattgaatagaaacttttaaattaatttatcctaacatggatcgtagatttgttatgttgactgcactgcaaaacgaatcaagccagaatcacattggaatctttttttggtgtgcaaaatcccagtgtttctttgaggcagtgctttcagtggtgcacgtctctcctgtgcagaggaaggctctttacatcatcttagcacagtgtcttccacttctgtggtttctatcacttctattgccttttcccttggtattgtacctttccttgatatgggttccaagatgtagctgtacttaaagacttgatggtaaaaataggccagtctctaaagcaattacagttctctgtaatttttggatcctatcaaccagctttgacatttggttgaatgtgtttttgcagacatcagtgtaaactttacagagggccactgagccttagcagttcttcctaagcaaagtttcactcattctttttttttttttttttagaaaacatttaaggcctcctatgttcctttcagtgttcgctgtttcttctttatctggggtccttactgactcaccttgacgttactgattcataaatggattttcatttcttttgctgggggtcagcactttgatgattatccacttccacttccactgtgttattttttacataatatttttgttctggttacaaaagcaagatagaatttttgcagaaaaatccggaaaatagagaaaagcaaacagaagaaaaaaaaatcactcataacccaccaccaaaaacaaacaaacaaacaaaaccacagccctattgttaatatgttgataggctcctgtctttgcctagcacttagaaccctcctagtcaggttctaaattaactttacaacctcatctccctgcttgcacctcctctggggacatacattgcctggcataagacttttcatatttctctctcaatgaattttttctgattatgtaaataattcatgtggttgtacatatttccaatagtacctataaggaaaataaagtaaaaattatttttaaaaacatttcaccttattaaaaaaaatctcaccaccctgaaataaaagccattgatattttggggaccatctcaccaccatgtgtttatgtcacctccacacacatgatttcccataaatgagataggagcacccatgcggttcttatcatggacacttgctttcatttttcacttatttacttttttcctctcattcccttccctccttccactctaattcctctcttctagattgccagtggcatcagccttgtctgtgtccttccatactttatgcttctacaatcttaccaaatgttttgtagtcacaaatatatgttgtgattgttttttatacaaatcagatcatatcatatgtccctttatgcatctttctttttctcatttaacagtgatagattgctgaaatccctcttttgttttttcatgactgcgtactattccttgattgactgtagcatgaattattgaatgtagctatgacaaataatactgtaataaacatttctgtgcttacaggacgtgagatgacttgattaagaaaagaatagatttttagattggaatagacatttccagattgctttctaaatggcatggtgattcgtatttctaccagcaagtctttctgtatcttgccaagggacgatgcctctaaattgcaagaaagggtgggatgccttgtccatttgaaatccaaaacatcaagacaaatatggggcaataatatgaccatcacaataatatatataaaagagaattcattaagggatgattatcgctttctagagttgggttctggggaagtattatttatagaaatgagccttaggaggccaggcacactggctcacgtctgtaatcccagcattttgggaggcagaggcaggtgggtcacttgaggtcaggagtttgagaccagcctggccaacatggtgaaaccccatttactaaaaatacaaaaattagctgggcatggtggcacatgcctgtagtcccagctacttggggggctgaggcatgagaaacacttgaaaccaggaggcggaggttgcagtgagccaagatcgtgccactccactccagcctgggtgacagagtgagcgtatgtctcaaaaatagataaataaataaataaataaataaaaaagaaaagaaatgagccttagggcccgaaatgtaattttatttttagcatgatttttttttttattacccgacagtttttgattagtgtggcagctagaaatttccctcctggtttaatttgcttctttatagtttttgtcaaaagctcaaatggtacaacacatcacaggtgacttttcaacatttgagtcaaccttgaaaatacacagatggatggatgtcagggtgagacctgacttcaagttcccatgaatgtggtttatattttaaacactttaaaaataactgtgtatgtcgtggtgtcaggagtcaggcaggtggaagggttaggccttccaggccatcttccgagctgcaccggacgtttgtctcacctcccctacagagatggtggcacagtccaatcccttttccctcctcactgggtgtcctcctccaattcatggattgtctgacactttctgcactcgtccctgctgctggtgtctgctggcacttcctgtccttcttgcttcccatcttccttgtctgttctgcccctctcccttccatttctcccgtatttcttagctttatcacaaaaaggcttgggcatcacagccatggcccactcttgagattgcatttcttggccagcaagcccacctggcctcatcattttggctgcaacttcaaggtcatcagcccatcttagctctgttcatccctaagttttctgtggataggctttctatttgacagagtgcttctcccagccccctcttaatttctttatctgacactgttttttgggacctagaggtccctgagggcctggggcttccttgtgcgttgaggtgggccctgtagattctgccgtcgagagaactctgaccagcccgctctgagaaagaatgtcaagtggtcagggtctcaccaagcaaagggcctctatatgataatggtccacagagctgtcaggagaacaaatggggtaatctggagtgtgatttcatcattcttcagtgcattctcagtgccgggaaaagtcatgagtagggttctcgttttaactcctaaattatgaacttactcacatttgtggattagacaatgcctcaacatcattttcataggtgtgtgtgtgtgtgtgtgtgtgtgtgtgtttatgtgtgtgtgtgtgtgtggtttaatgtgtacaactcatctgaacccagttgctctgtggtttatcttttactgagaactgctttttttcttccttttctaagaaaatactagttcttaaagtatgaagtctttcttgtgagttcatcagcagtgaggggtgtggtgtgaggacctacattggtgataatgagatccaacaatcactgaattcaggcgattttgacacaaatcatattgactaaaataatattaagcacgtgatgctggtgacatttgaatatttgccaggaagaatacctgcatggtaacaattggctgcaaatggaagagatttgcatgttttattgtttttacagttttaacatacatttttattggagaatctgaaaccaacctatgtaggggaggttatgggagcaaaagtaacacagagaaccagcaggaatcggcctacctgcctgcctctgtcctcctctgctcctaagaatttgggtcacctctggcttcagcacttagtcctaatcatgaacaacacatgagttaggggaaaggtgtattcacaaatttgaaatttctttatgtttttcctctctcacattcctttcctgcagtctctttcctactttttcatcctttgtgtaaaggtagcaacttttttttgttttttgagacagagtctcgctccgttgcccaggctggagtgcagcagtgtgatctcggctcactgcaacctccgccttctgggttcaagtgattctcctgcctcagcctcctgagtaactgggactacaggcatgtgccactgtgactggctaattttttatatttttagtagagacaggatttcaccatgttggccaggctgctctcgaactcctgacctcgtgatccgcccgcctggatctcccaaagtgctgggattacagttgtgagccaccgcacccggccaaggtagcaacttttatttgagaaagcttggaatcctgacctaagctccctgagttcccactgtggcttgtggccacctattgtgatactcactctctacccttggttttctgatctctaaaatgagactgtctacttcacgtggctgttaaatgcatcataatttccttccttacctcccttctttaaaggaaacttggaattttcaaagctactaaatggagtttttttgtgttctttttgttgttgttgtttgtttgtttgtttgagacagagtctcgctctgtcgcccaggctggagtgcagtggcatgctcttggctcactgcaacctctgcctcctgggttcaagcaattctgtctcgcctcagcctcccgagtagctgggactacaggcgcccgccaccacgcccagctaatttttgtatttttagtagagacggggtttcaccatgttggccaggatggtctcgaactcctgaccttgtgatccacctgcctcagcctcccaaagtgctgggattacaggcgtgagccaccacacctgacctaaatggagtatttttagggccacatggttaggggcaactaaaaatgtcatatgctaccattgcattcatgaacaccatcctccctcagagaagaaaggagtcacatgactgcatttctggcgaaacctgattgcattttggtaaaacctgtgccaggaccaggacagtcatcaatgacgtgttccctgattttcatgactgaagagcttcaggctggtgctgccgcaggggacctttgcgtggcatggctcctctgcactggcgttagctgtggtgagacacagcttgcagccacagtaggacaatgccaagtccaatggtatttgctgttcaggagcaaaagaactacacagcaacaacacatactatcgtcgagtacctatttatttcactgtatgtgtctgaaggactaaatcgaagccagagccccccgcccatgcaccaaaataaaatgcagacagtgttgagttaccaaaatgacagtgcacctgcaaagggaagtcagtgaaggtttaaaggtgaagacttaaaaatatatagatagcttaaaactgcaaataaaaaaatgtcacatagagattttcatgagcttagaaaaccaggaggagatttgagtcgagagaaaacaaggccagcctctctcaagtggcagatttctgcagtctttggaaagatggaaataaatatggccaggcgcggtgggtcacacctggaatcccagcaccttgggaggctgagacaggcaggtcacttgaggtcaggagtttgagaccagcctggccaacatagtgaaatcccgtctctactgaaaatacaaaaattagctgggtgtggtgatgcccacctgtagtcccagctactcgggagaatcgctggaacccaggaggtggtggttgcagtgagccaagatcgcaccactgcactccagcctgggtgacagagtgagactctgtctcaaaaaaaaaaaaaaaaaaaaaaaagaaatgaaaagaaaaagatgggaagaaataaaagctgcaaaaggacaaatggacagattcagggcggaaagcaaggacagagcaggatttgagcgtgagacttgctatttgggcttaggtgaaatgaaataaagaaaagggctggagaagtcagaagtgggtcacagaacaatgagatggtgaatggggtccaaagtgtgggtcgccaggactgccaggaggagccacatctccagggtagggctaagctgcaagcaaccagcattatttagcagagtcctgcagaagtgaatggaaagatctttaaaaaacctatgaatggcagtggaaaaaaaagaactgaaaggaaagcagaaggcttatgggctagataaactcattctcagacatatgactgaactgaaactcagataaaatattatcttttcatccagcgtctttcattcgttagaagttcagtttctttatatttcattcatacaagagcaatgcagatttttaaattaatatatgtgctcatagacatgtggatagaaactcattgctgattagaatattatgaattaaggaaattttaacaaaatatacttggaaagtataatatgggattgaaatttgaagccaatgataagattataaagactcagagctaatctttcatgcactattttgtaaagaataaaatattattcttccttgggcctgaagtccacactagccccctcactaagatgataaccacaggggtgagccctgagatcttccacccccaaggcctccactaatcgccatctggacatttgcttttcgtcccttgtactgcctgttctccacctgaacagtccagacacttccagcatgttcactgcccacaagtttacttaggaccccgaagtcctagaaaaaagttgcctttagcttggctgctcctttggtctgcactgtgtctcctccccatgtctttagcttcctcaagctggatggtttcttcctgactgcacagcttcactcccaactgtccctactgccaccctccaccacaccaggggctcttcttttcccaggtttttaaggaaacactgtctttgaggggatcatgcaccaatttcagcaggtgtctggagccataacattttactttcctgtagcagttggaaagatctctctttaaacactagaccctcttgatcctgttaaacggcctgattcttccttctgtcttggtgaccagtcatctctgtccaacatgccagcttctctgtcttcccccactcaggtaaattcagacatttgccccagcctaggtcttagcttcctcgctctgtttcctctgtctcggagatctcacctactctctctaatccttccaattttaatgcaggttgttccaaaacccatatctccaggcctgacacgtctcccatttccatcctgtatgtccatgccaccttggagaatcccccaccatttcaaaccaagctctgcctctccctccgccactaacagtgtattgggtacagtgtattgggttgaggatttatacacttctccctagcattgccagttaggagaccacctgccaatgggaaccactagtcctggctccccacatcttagtcatcttcagttccatcatctcactttctttgtatccgtacacagactaacacttcatttcccccacttccaaccctgtcctcatggcgttcctagaaatgacataggcggacatctactaaacccttacttggtctgtataagtggaggagttctaggtgaagggaacaaaagcccaacttgcaccctgaaaacagagagtcacggcccctcgatcaattcacacacttgcaccaatttaccgacccagaagcccttgaatgaagaggaggccgggtctccttgacgaaggaccctaccacactgtcaagaattaatactgttgctttttctcccagccttccccaaagggacctatagccttttgccagggtgactgtgcactggggaaaaggaattaatcagaccttttggggactactggtgactggctctgagctgacactaattccaggagaccccaaacatcactgtggtccagcagtcagagcagtggcacgtggaggtcaggtgatctctggagttttcacttcatgtttgtgtccatccccatagcactttgttcaggacaacgtggcagggcccacactgctgcagtggattcctggaggcttgtacctcccaacccccaacccagagctgcctacagccacagtattattcagtccaaagcacctctgtgacaattatattcctggctctaaacttccactggtgcccagttgttaggaacaatgcagctttccttagcccgatagttaaaacccttcacaaagtctccttcccctttatttccagttttcctggctataaatcctcaacccaatacactgtaccccactccccccagcccccagatacaccatcccccaacacgaaacacttaccctcttctcagctttgcctttatccacgctgttccctctgcctggtatttccttttggctcctttctctggatttgtgtggtgcctgttttagcacaaatataccatgtccccttgtaaaatgtcttttcttcacttcagctggtaacagccagggaaatgagcaaaaacgtgtggatagattaattcaccagcatcggggagccgggtgggcgggggtggggggtacagtgtggcgcagggcatgtctttctgtgggtaggtcgttaacaattttcataaacaaaagattgccttgtttatacctgttcatcagagtcagcatttcttaaatctgtttaaggtgaaagtgagtgctttgtgttttaaaaatcatatgggaagcacagaaataggaaatgttcactttgtttaatgtggaagtatattccataacaggtggcctctcaacttgcacaaataaaacaaaattggttggctaaaatctatcagagaagaagaggaagtaatcgccaggtggtaggaccaggagcagatggggactatttacttagatcctcaattcttcttgttgagtgtccctctaattaagtacctttccttagatgttaaataaactttcatatttttaaatagtattttttttagaaaagtgtattcccatgccagtttctccttcttccaaagtcaggggtagaataaccatatagcattaatagagtctgtgtaagcttaaatagtccaactttcctttcaggctttttatttgaagtttccaaattacacagctaaaataaaaacagcacagaatttaaattgagaccattatatatcgcagggacttcccccacccccatattaagtaaggcagtgtcagccctggtggtccgtgcagactcagtgcactggaggcagaagttccaggtggactgactcctgcccccacccagacctctggtgctcccaggcagtctggaacaatcagactctggtgctcccaggcagtctggaacaatcagactctggtgctcccaggcagtctggaacaatcagagttgcccttggtcttccggaaatactgtaattccctgtgcaatgttagctcttgaccatctttgaattctttttcttagacttacaaggctctgtcgctggtttccctctcactcttctgacgactacatttcaacttccttcaacaaacacttatgaagcatttatatagcacttactgacggccacagccaggtgcagttttgtggatctgtacacaaatgaattagatgagccggtgcccatcggccctggggttcacagaccaaggctcgctctgccggcatcctgggctccctcctgccgcctgcacctggaacgcctggcggtctccgtgcctcttctccagttctctcctccactgtgctcctttggaaaggcttttctgtcacggcttcaatcataaaactgtattcctagtcctatttcctcatctgaggtgaagcatgaaatctcctcttgtttaccccgaattcagccagctcaccacgagccctctctgcatctgtcagcctctgtcagcagctgtaaaagcttcccttctccccagacccccacatctggaaaccgtctttaagtcgtcctcccctttttactgtgtgtccaggaatccacttttgggcttcctctgaccggcctcttccttccttcttttcctcctccccgccccactgcctccacctactctagtcccaaggccgtgcccctgccccaaccctcccactgtgctcttcccacccacaccagagtccccttctttaaatcctgtccgatcagtgtcactctcattaagtgacagagatgatgtctccaccttttatatctccaacagcatctaacccaacacctggcacttactagaggcatcaacgatgcttgttgttctgtgtggcgaaggcacacctggattctggatggtcagtctcagctctccatctttgctgcctcacagggactccaaatgtggagcgtctcccactgcccttaattagggaaattcagcctcgcagaagacagtgaaactgatgaaagcattgggaaatggaacctaggaaagttaaagaattggcatcatttgatgtgagaaagagaagcgaagatgatgagagatcctagggaaaaggctacatgccctgtctttcttgagacaagcgtgtgcacttcctttgcttccactcttacttgtgtttatccttggagggacctttaattatctaacgcttgggtattggccacggtgcttatcgtctgcgtgtgaatctggacatggtccccaagctgtgtggtgctgtttgttggtgcggtccaggatgcacagggctgagatggtgctgcatgcacacttaccgagcacatccccctgggagaggtgtggacaccaccgtgaagggggcccagacctcctccttaaatgcctgcactttcacagggatcagacatggagacaagaactctcagaagagggagaggcctgaggcacagcaggaaggtacaagttcaaaggaagtgaagatttccagtgagagctatcagactcttgaaatggactacagggaaagcctgtggtctcctctttcttagaaatgctaaactcataacagaaaacctctccaccgtggcttgagtgtcaaattctctggaggcctggggatggggccgggagttttctgcctctatatccccatggtccacttattcgggtggcttagtttgctttgcaagcagggggtgggagcggggctgcttattccaaccacagtagtcaaatgtgttacttatgagaaataataaaagatccttcttcttttctttttctagaccccctctagtcaaatgttgttgtttttttaaatagaggaggttgttttgcatttttcttttcgtagtgttcgaatttagcttttgtatatactctccccagtagttcagagtacattcatgagcccagatcatgaggaatgctcaccattttcctgaaagatggtgtgtggaggatgtgtacagatagaagctaggctgttgaagattttattgaactcatcagcattaacaacagacactgttagtgaggtccgaatgtttttgtttatttttttgactcaacaaacagttattgagcaaggctttcttctgtgcccggcaagatgcttgccacttgctgaagagacaaagatgcatgagatatggtccctgcttttaaagcacttacaatctagcagggaagacagccaggtgtacaaataatcatatgtgttacaaagaaacgattattccggttcaaaggaaggctgttgttgatgaaggatggttgcatagcagaattataatcgtcagtttgaaattcaactttttcaagctttgtcatttctatcttgtattagccttatttttccctttttcaaaatacttatttgcataggtattagtcacatggttcctatactggaacagtttagaaaggtgtttattggaaagtctcgctagcacctccgtccccatccacccaattcactactcgctcttccatcagaataaggaaccattgtctattaatttcttgagtatatatccagcgcccatccatgcaaaataacatatacacattttaaaattttccctttcttacacaaaaggcagcttactgtttgccctgttaatttaacagtatatcttgagattttaccatgtaagatcttatcatggtacatcttgagatgtaccatgtcagtacatagaatgcatgcttttcctttcttcctaggtagtataatacttcctagtattgcatcgttttggagatatcagagtgtgccagttatcaattagctgcataacagattactccataacatagtggtttaaaacaacaacccttttattagtcataattctatgggtgaactatttggcctgagatctgccaagggttttttactgctgcttttgcctggatttgttcatatggatgtgattatttggggctagatggtctaagatggcctcactagcaggttgttgggagagtctgacctcagttggaatatgtgccttgagtaaaccagccccagctgcttcatatggcgactgggtcccacaaaaacagagaggggttggccccgctgtggaggttttattaagcttctacttgaatcccattggttaatgttccattggcaaaagcaggtcatggggccaagcccagagtcaatgtggaagcaatttcaggatgagaaattcattagatgtcattatgtaactatttactacccatggagtaattaaccagcccctgatgatggacacctgtttatttccagtcttttggtattgcagataatgctccaatagataatcttgtatattagtcagttcatatgtgagcagggtaagtaccagaagtagtactgaccctgtgctggatagagggcagatgccttctcaattatctatctatcctatttctgtggtgctgtttctctagatattttaagcttgtgtttttctgtcactcgtgcaggagctttgaaaatgtgaaaagactttagataggaaatgcatataaactgaattaattagaaactcactcctaaaataacaaaaaacatgaaagctagaatagaaatcaaataattttgagtaaagtaatgtgtacattatttgaagaaatacaagtatgtctgttataacaatactttacatttctgttgtgtttacagcatagaaacacttagtttgcttttagtatctcaattctcagaacaattctatgagttgaaagtataattggccccattatgtgtgtgtatgtgtgtgtgtgtgtgcgtgtgcatatgtatgaatgtatttaaaggcttagagaagttacctaacttgccccaactaacaagtaatagccagaatatatacccagccctgtgacaataaacttgacgttgtcccattaatcgcatcttactagtagggacttgtatcttgtatctggcttagcttctaaagatatacatgtgctcaacttgctaattgctttgctagtacaatcacaatcatatatgatatcacctcaggaggctctttttaaaaatatataagtagttaatttctaatttctgaataggtggggaacctccctgaagttttctcttgttttacacatgtcattggcatccaggttgagagctccatctcctgatcatagcctctagtaaatcttgacggaggaattctctttaagcccagggtcttgctttcagacttcagaaaagaggagtttttttaaataaaaccttgtctggccctcccgcaatggatgcagaaggtagactgttttctttcttttaattcacactcagacgttttcgtaaggggcttggtcctggcaaagtgggcctcacatacaaaccacccactttcctgaagcgtgattgattagcaaagctgttctgctcaagggcagcctgttttccccagcctggatgctgacaggtccgacatgcacagattttcaagcaggtcgccagtccccaggctgcaggctgtaggccaggacgcttgttcttgagggagaagagaggagaaggaatccactccgggggcaagaattaagctatattatagaattcccaagacacagcagggcaggccaacatagtccttgtttagagagcccctgatggtgttgggtgccaagaaaaccatggctgcacaagacacacagagtgaaggtgaatataaagatgtttaggcaaagcctgtgcatatggtactgatccccatttgtctaagaacctctaaacatcaaagagagttaaagaaagatagaaatttgatgcctaatcaaagtagcctatgatggaagtttggaaatacagccaagcaataatactgtaaacagaacgaggtacagatcatgtctttgcatgtttgtctctgtggcatctaacagcgtgtcttttacaagtagaatctgcataaatatatagtcacaaaatgttagagctgaaaattatcttacaaaccgtcttgtccaggcctcaccattttaggaatgagttaacagaggtacagacaggttaggtaagtggcctcagttgttctgagtcagaccaggtcttctaaatcttagtgaagtagttgtcataaaattgtgctgccagtattctaacaaatgttatgtgaatgtaggaatattttattttttttgagactgagtcttgctctgtcgcccaggctggagtgcagtggcccgatctcgtctcactgcaacctccgcctcctgagttcaagtgattctcctgcctcaggcacccaagtacctgggattacaggcatgcaccaccatgcctggctaatttttgtatttttagtagagacagggtttcaccatgttcgccaggctggtcagaaactcctgacctcaagtgatccgcctgcttcggcctctccaagtgctgggattacaggcatgagacactgtgcccagccaaaggaatacatttatttcctttttttcattgtagaatttattattattattatactttaatttctggggtacatgtgcagaacgtgcaggcttcttacataggtatacacgtgccatggtggtttgctgcactcatcaccctgtcacatacattaggtatttctcctaatgctatccctcccctagacccccaccccctaacaggccccagtgtgtgatgttctcctccctaggttcatgttgttctcattgttcaactcctacttacgagtgagaacatgtggtgttaggttttctgttcttgtgatagtttgctgagaatgatggtttccagtttcattcatgttcctgcaaaggacatgaactcatccttttttagagctgcatagtattccatggtgtatatgtgccacagtttctttatccagtctattattgatggacatttgggttggttccaagtcgtcgctattgtgaatagtgccacaacaaacatacatgtgcataaatccttctactatgaagacacatttatttcctttttaaagagatttatttaagagtcactgattccgtaaaatcatggaaagtcatctccttaatttacttatgtattaaccaaaggagattcccccaaggtactttctattaggggcggtgggaaaagggagggttataaggatgaattgactagcgtcttttgaaagactttcaggaatttgggtcttaagacattttggccatcttacagaaagtcttaaatgtcagaattgggtgaaaaaaatttaacttttctcacaatggtttgttatatgctcaaggtgcagatagcttggtagggacaattcagcctgcggttaagagtggtctctatgtgtacgtcagtaaactggctatcagcgtagcagcaggagcagaaatcatcaagaccgtggaccccccagcctgtcacttgacttctgctccgtaatgctgcctgcacattgcccatttggtgcaggttatgcctggcttgtttcaaacatcccgtgcctgctggagctgaggatgcagcggattcattagctccataggaatggaccccttcattcaaagctcaatttggcccaggcgcagtggctcatgcctgtatctcagcactttggaaggctgaggtgggaggatcacttgagcccaggagttcaagaccagcctaggcaacctagcgagaccccatctctataaaaatattaaaaaattaaccaggcgtgtcccagctatttgggaaactgaggtgggagaatcactttttcccaggagttgatgagttttctcccacccgtgttgagctatgttgcaccattgcactccagcctgagtgatagagcaagaccctggctctaaaagaaaacaaaacaaaaaataaagcttgatttgttttcccatcccatggcccactgccaactctatcatttttggctcttgactgtcttatacgcaggagtgtagggagaaacttttgccagtcccttcaaagatggctttgacaatctgttgtcctgaataaatttgaacacctgacaaaagagtgtctagaatcttcctttcctttacaaagtgtaaggggtcagatgtattgccccttttgggatataaatcaattattgttctgccagccactgggaacattttagaagcccatttattactatctgcaatggtacctcatatttggtttcctgtgtcataaagaaaaacctgcaaatacctaaaagtaaggattccagtgaaatgtgggttctgcttcactctgtttggtgtgggaggctgtgtaagtctaactctaagaataccggtagtggtatctatcttcattctaagaactgagggaggcgaggtttgtgcagaattaaatcaccctgtcatatctgtgagggcttcctgcagaacgaaggcaagtaaacccaaacaaacaaaacaggaacatgttggaaacagtcagaggtatacgtctggaactaaggttacgagctgagccttgaaaagttcatgagagactggcttgcttgaaaatatccttcgtgtgtgtgtgtgtgcgtgtgtgtgtgtgcatgtgtgcgcgttgttttgtttgttacggttttggtccgtgctaccgtatttaccccatgtgtggtggttggaaatgtcagggtttcttgattgaaaaaggaaataagagattatgccactcacagcacagaagtgggatgagccccactatggtgtatacgtgtgcgtctgtgtgtttatgtctgtgtcatctccatgtgtttctgtgccagtgtctgtgtgtctgtgcatatgtagtgtgtctgcgtgtctgtacctgtgtgtatgtctgtgtacatgtgtctgcgtgtatgtgtgtgtctctgtgtatgtgtctgtgcatgtgttgtatgtgtgtctatgttgtgtctgtatctgtgtgtgtgttgtgtggtatctgtgtgtgtgggtctgtgcatgtgtctgtgtgttgtgtgtgtctctgtgtctgtgtatgcatgtgtctctgtgtgtgttgtctatgtgcatttgtctgcgtgtgtctctgtgtatgtgcctatgttgtgtagtgtttgtatgtttatggctgtgtgtgttgtgtgtgtctatgcatgtctgtgtgtgttgtgtgtgtctctgtgtctgtgtgcctgtgtgtcttgtgtgtgcatgttgtgtagtatatgtgtgtgtctctgtgtctgtgcatgtgtctgtgtgtgttgtgtgtgtgcatttgtctgtgtgtttctgtgtgcatgtgttgtgtagtgtgtgtgttgtgtgtgtctgtgtgttgtgcgtgtctgtgtatgtgtctatgtgatgtgtgtggtgtgtgtgtctgcgtctctgtgtctgtgcctgtacatgggtctgtgtgtgtgttgtgtgtgtgcatttgtgtgtctctatgtgtgcatgtgttgtgtagtgtgtgtgtcttttgtatgtctgtgtctgtatgtcagtgtgtgtctgtgtgtgtctgtgtatgtctgtgggtgtctctgtgtctgtgtgtcagtgtgtgtctgtgtgtgtctctgtcagtgtgtgtctgtgtgtgtctctgtgtctgtgtgtcagtgtgtgtctgtgtgtgtctctgtgtctatgtgtgtctgtgtgtcaatgggtgtctgtgtgtgtctatgtcagtgtgtgtctgtgtgtgtctctgtgtctgtgtgtgtgtctctgtgtctgtgtcagtgtgtgtctgtgtgtgtctctgtgtctatgtgtgtctctgtgtcagtgtgtgtctgtgtgtgtgtctctatgtcagtgtgtgtctgtgtgtgtttgtgtgtgtctgtgtgtgtctctgtgtgtgtgtgtgtgtgtatgtctgtgtgtgtgtgtctctacatctttgcgtatacaggggcatagcatagtcatgcaaaaccgtcttccttcaactcatagttctctccttcctcaaccagaagccactctgctttgttgtgaaaacaaataaactactttcttacaaaagaaagaccaaataacctgaaaagctcaaataaaatccaccttatgatacaatattaagaaacagaaattttcaatggagaaaatcccacaccagactgaggaagacagatcagtttaactggagtctctgtttgttttatatttcttttctactctccactcccatttgccaacaaaactatgctctctcacaggggacaggttcacccctcaatgtctgactaacatgcttttcatttgaattcaaaatatttggtgacgattggcaaagaatgaggatgggaaattgaatattacatcatcttatgaaagcttcctcctccctcacttccttcttcctttcttcctcctttctctccctttttccctccctcctttcctctctcccttcccttttctgttcctgctgtgaccgttcccctgattgagcagacgtggacatgggggagtcaactgtaggagtgactggcgcctcacagacaccgtcctctgaggtagctgtcaccagaggattgtcactgaaaatgcaagaagagtttggcatttgattgcattctgcacaattcaagcaggacaaattgctgcagaagatgacaccagaaatagccaccatgtagtgggttctcaccacatgacagacacggtgctgctataagcttgtgacttgcactgtctgagccctgaacacctgtagcaggtacgagcatttgctccattttcagaccaggagacagcagctcaaagaaagtgaacgatttgtcagtggtcacacagctaggaagtggcagggggcgcttagccgggttggactctgaaggtcatgcagcatctttacacagacccaaacccttcaaatcgatttccacccatgtgtgtttggcagccacatgtcaacaagccataactttcttacctatttcgggaaaacattattttctctcacctgtatttatcgtcatcctatttctgttgcaagaaatcaaaacgtgaagaagatagatttgaagaagacctttttttggctacttctgatgatgagatgcagttaggaagatggagttcagatgctaaaatattggaatttctgattgatgcatattcatggttagagggaaagtaagttgcactgtggagttaagaaatctgagaaatacaggaaatccaagctgagaaaaactcataactatgatgtttccatgtgcaggaaacttcaggtccttctgcgcccaaccttcctggaaagcttttatttaaaaaagtttttaaaatttttatttagttatttttaattgacaaacaaaaattgtatataaaggcttttgtattttatcccgtatgataaagggccgcacggttctttcttgatgcctgagttaagtgagcatattaacagcatgcagcgttcagctctcattaattttcaataggctcatttacctttgacccttttatttcaaagccaaaaaaaagaccatacatagagagaaacgattgcattatagctcctccttcaatatgagtcgctcaatctctaatggtttctttccatcgagaagaaggttttagtaaccaagtgactaagttacctagctaaactcccccctccttctttatcaatacttaattagtattgatgcttttcttggctaaatctcatttcagagcctgcacaactgaactttttccataaatgaaccttttaaaatgtgtatttgaaatatctttcagcctaagaaaatagtttttaacaagttatgcattgatttcctcttactctgaaatatttctcaagtgatttttcctgaaagattctttgtggttcattgaacacaaaaaacaaaccgtgtaccaggtctggtagaggttacagggatacagataacttggcatttgttcccaaggagcttaggtctccaagaggaaataagacacttcgacaaatagccacaaggtaaaatagagaattgtccagtgctgtaatttaactgctgattccgctgtacctaaaagctggttaaattatagttttattgaatgctaacaaactcttattcccctcctgcatggaattttaaaaaccttttattttctctgggctataattatggtgaccacattttccatggcaaaaattaagacacgtcgtctgacaaaggattcttgtgccacttctaggtgtgagaccacccatacttagattttttttaaagcaggcttttttaggcaggccctataaaaatagaggtttgttaaataggtgtgtttttagacttttcattaaaagcctacaatacaaacagtattttattttgtatctgaatcaacatgttatatcctaaagcactattttacagcctaagggtgtgtgttagtctattcataaaaacatactgctgcatagagcaataatacctgccattatctaggtgtaataaaaaggtcccaagtggtcctctccaggtctttaattttccttttgaagataaagctccttctttcactttcatggttcaagatttttggaccttgcaagtgattgctattgaagtgtgccagatgtgagcagttgtgagcatagtactttaaaagaaggtgaaggagtgactttttcttccttattgtctcccctactaccatctgtagtttctacacatgtaacttttccaaaacagcaaggcatgggaagggataccagccagggccgccacagtccaggcatgggacttctgaagtgaggagatagagatgaaagcggcctgtattgataaatgacagatgatgaaaccaaggcctgctggaccaagattcaatgacttacccaaagctacacagcttgttggtggcagagttagctcccaatccccagctttgtgagcaagggaggtttccatccccactatgatgttttcttggtgttctggggtcactctggtcgatttccatccactgtgatgttgggtatgccccctccatgtgactacataattctagaatcataattctaaaatgatatatcactgcactatcatgggaaaataagctggaagagctggagaggcgatgcctgccaccactggctcttctatagaggtgaccttgcaggttaccaggacttccccaggccgactctcagatcctgaagctgagtccaaggcaagccttatacgccatggttcctgctctcctgggtatcactgacctactgctgatccaggaacccttgggatcagacttttcccattaatgctttgtttatggttaaaatatcacagagtttagtgggaccactgctgtctttattagatggtttttatacttaattattttgtaacatggctgcacttgtaagttatctgctgatttttttgtagttcataagcataatgattgggtattcatagtcatatgtgagatgtgccaacctcaatctctatgctacagtatagagtatactataataatcactatattattacagcctggccaacatggtgaaatcccgtctctactaaaaatacaaaaattagctgggcgtggtagcgcacgcctgtaatcccagctactagggagactgaggcaggagaattgcttgaatcctgtggggcagaggttgcagtgagccgagatcatgccactgcactccagcctggacaatagagtgagactccatctcaaaaaaaaaaaaagaaaaaagtttaaaaatgtatctcttccattaaaaacatatccaataattctgctaagatatttgactgaccttcacattcagcctcattccagtgtaacttcccattcattcatttcattcaatggctatttattgagcacctactatctggcagacacttttctgcttcagcatcaaacaaatagacaaaaattccagcctgtttgtggtttatatgggattggatggtgctaataactgtatcgaaaaataaaaactattagcttgccaaaaatttggattactgtgggagcagagagctaaaggaaaagggaactcatatgtattgaatatcagtgactatgtcatatgctgtgttgtgtggtttatctcatttaatcatcacagcagccctgtgaaagatgaatatgattatttttattttttacagatgaagaaccaagatttaggaatataatatatcttgcttaaggtcatactagtgaggaaataaatctacatcagtcttttcaataccatgctagatgtgatgatatcattttagaaccatatgtttgatatatggaccaccatactgaaacctcagggcacatttttgtccactaataatatatatcaaggaatgtcatttcacagatgcatggatacggaaaatgtgtgtgtgtgtgtatatatatgtatgtgtatatatatgtgtgtgtgtatttgtatgtgtgtgtgtgtatacacacacacacacacacacacacacacatacatactactccgccttaagaatattttcatatgcaactacatggatgattcttgaggacatcatgctcagtgaaataaaccagtcacagaaggacaaatactgcatgattccacttatatgagcatctacagtagccaaattcacagaagccgagaacacagtggtggttgtcagggcctaggggaagagagaaatggggagttgcccttcaacaggaataaagaataagcaaatctcatgttaagagttcttaacacacacactcacacacagacacacacaaatgtcactttaatggacatgtttaaaacatcatttgaaatgtagttgttaagttcatgttctccttatcatttttgtagattgatcctcatttctgaatagcagtaatcactacagtacactctcctttcataacaggcatcttccatggaataccttgccccagattagcaatttgatgaccacagtaacatgtgcttctcagataacacatgacctttcatttggctgagaactcagcggttgactttgctaaaaataggtctttaatggttgagtgtgacatttcatcacggggtgttatttgggagtttttctcttcatacatgaaacaagtatggctgtagaattgattacccttgtttccttgatgaaacgcattcagaatttcaaagatattgaaaatatttttggccaaaattagttacacagaagtatggaatctgtcagtgcttggggacaaaacccttctgtgtattgaaaatgcagaagtagacagggaagcatttctggggaggagtgagaagctgtattaagtctggatgctggggcaggggtgaaggaggaggtcttgatgatgtaggtcttgaccaggttggagctgatgcaatggcaagtgctgtggccgtggtatcccctggtgatgtcattccaaggagccagctgccatcagtgctttcaagagtctggctctttgggtgaggggcaccaagggatagacgtgcacctcaggacacctgccatcttgttggccatctctctagtttggggtctttgtggaaaagatgtatgggccatgctttttagcttgtcttatcaccccaaatacttcccgtcatcctagaataatatccaggctctcgatctgatttccaaaatcttacactgccttcgcactgattctcaagcctcagctctcaccaactgcacactcccccattgcttgtgggccactcgaactgacttcctgatcctccaaacacatcaggttgctccctccttgggatcttccactacttgtgacttctgcctacattgtactgcccctaactttcccagggctggctccttcttgcctttcaaatctcagcttaaatgtcacttcctttgagaggctcccctggaacacccaatcattccctctcctatcaccctactttaattctctgaatatttctatacagtcaatgctgtgcttgtttattctttcagatccatgaaagcagggaccatgcctgtcatagtcccgacagtgctcccaagccctaggtgagcaccctgcacatagtggttcaatgagtagtttgtcaaatgaaggaaggaggcactcaggctgtagatgatttaaatgtaacaaacgtatttgtaggttattttttaataatgcaaaagaaatgaagactaggccaattttcttttttaatttcatatttcagcctcaacgcttagttatttctgattggtcagagattaattaatcacatgcaacagtctgtcctgagggggttcaaatgcactgctttttccagtgatttgcaaatgcaccggcctaaaacctactctctggcacagatttcagaatctccacttaacacatcagaaacctttagggcttatcctgaactccaaggctggcttaacttcttcagtaagcagctgcttatgcatggatgcctacaatgagtgatttcaccagaaacccacctcagctacttaaagtgtgatgtatttcatacacacaaagtgttttttcatatgagtaggttagtgacactactgaatacaaattaactgtttttgaatatactggaatctcacaaagttttttctgcctcagaagtggaattcagttgaagatgggtctgtccttagaagaccaagttattatagttgctaaaataaaaataaataaaataaagacttcaaaaaacaacagatgctggcaaggctgtggagaaataggaatgcttttacactgttggtgggaatgtaaattagttgaaccattgtggaagatagtatagcgattcctcaaggatctagaaccagaaataccatttgagccatcaatcccattactgggtatatacccaaaggaatataaatcattctgttataaagatacatgcacatgtatgtttattgcagtactattcacaatcgcaaagacatggagccaacccaaatgcccctcaatgatagactggataaagaaaatgtggtacatgtacatcatggaatactatgcagccataaaaaggaataagatcatgtcctttgcagggacatagatgaagctggaagccatcatcctcagcaaactaacacaggaacagaaaaccaaacactgcatgttctcacttataaatgggagctgaacaatgagaacacatggacacagggaggggaacaacacactggagcctgttgagggtgggcgaggagagggagagcatcaggacaaatagctaatgcatgtggggcttaatacctaggtgatggttgataggtgcagcaaaccaccatggcacacgtttacctatgtcacaagcctgtacatggtgcacatgtatcccagaacttaaagtaaaattttaaaaaataaataaagtaaaataagactttcacttactggggcaggcccatggtttctagggttgagaacaatctccaggggcttgaccctcaggaagggagaatcccttcttcccttgcagggagcatgggctgggtggcagttgtgtccctgccatctgaaagtgaaaagtggactttaaatgttgacttatatctcacaatactattggtgtccagcttctgatacttcatgggacattcctttgtacttgggatctaaccttattaatttagagagaagatgtagattaagtttcaaaaacctgaccttagaaaagatgttttaaataaagaatgggctatcatttgtattcgcaaatcacagagaatgtcccgtggcatggaatcattttgtcaagctctgcattccaatccaattttttatttgctctcatctcagggtggtaattgttaatttggagattattatttagggtggattcaacagtcttacatgggattctttttagggagaatgatgggaaattaccctttttcacatttttttatcctgggagagggggcctctattctttcgctcagtgtgacagtgagagtgaagtgaagagaagatttatgatgccaagatcagggctgagtaatatggtaaatcccagtttatcttaagtgcagtaaacccccaggcagctagaagagtgacgtattctggttagttcaacattctatttaatctgggaatacccaatagaccacttttccacaacagatttttatagaattcaaatacaacaaaatatacttgacaccacaactatactgaacacatatttatctcttctaatgacttaaaagacacttaaatatctcaccaagcctcagagtcacacggagaacatcagttatttcagaaacggctgttaatagggatttctggctgatagtgggatggcctgtttttgctgattgaaagcagcacttcattggatgcggtgggtggggggtgggacaccagttctcgttttcccaggtataattcggcaatctggggggcttcctcaaaaatacgtagaacctaaaatagataatgtatgaaaagccccctagtgctgagcctaacgcagaaaaacattcagtacatacaagatgacttgactcagtttatctgtgattggtttggtttacttttgcttttttcttttaggggtgggggagctcttcctacatagttaagggaccttcaactagaggaacttgatatacctaacctaggacaagcaggaactttttgacctccagcgttgtttatggtttcagactaagcaacaacagaagataactacaaggaactatcatgaattatggctaaatgctgaatggtgaccctttaaatcagttattagtatgactggattgtaccttctgccctgggacaagcctagacagagagagttgggagaagcaagtgtaaaaaagcctaggttgtttttctttttctttttttttttttttatatgctgttaatgggagggtaaattcttgtaaagtttttggagagcgctttgaccttaattttgaaaatgctaagtttacatagcctttgtcttggtaatttcacttctacaagttttttctacctatgtgtaaggatgtctattacagcattatgtattttaattttgcagcaaaaaaaaaaaaaaaacttggggaaaaaaagaaatgtctgtgtagggtactggctaaattggtaaactgatatgaaataaaatgctgctattaagaaaggtgatggatacatatgaactcacattttaaaatgtctgagatttattgtagagggaaaaagtggaagtctgtatggataatattattttattgatgagaaaaaaattagatacatatacaaatgcatgtatattcatagcattttctggaaggatatataatatactgttcagctaatatataatttaaggattatgagtattataaattgaaattaatattattacaaattaatacaaattaagatttgttgatgtatacatagtattatggtaaaatgagtataattaaattattcaaaagtttgctttcttacatttgttaaatattttccagtttatgttctaatttgcttattccaatctttatttctatcacctatataattaaactccaattcagtttagggtcattcataatttccaaactgattattttactgtttcttcagtagtgttgaagataatgatgatggcactagtcatcccttattgaacccctatgatgtgctaaacacttgtacttatattttctctaaacctccaaaattgtaaaagttgatgaggaagcagaggccctgccatcttaaggaacttgctaaagccatgcagccagcaagtaagtttcagagctagcactgaaactcaggtctaacgccaaagactgtactatttccatatgtcattctgcctcagatatagagctggtgaattcatttttcaggcagtgtctttgtgggtaagacagatagctgcttaaaaagagatagaaaacatgctttggattgttatggcttgctagcattttccactcaccattgttattaattattctgtgtttcccatttgtcttaactttgatcgtatacttacaaagtttatggaaactgcccaagtgcattcgattctgctgatatttccatggtctgaacgccagccctatgagcaggggccaaatggagcatgccatctgaagactgctccagctttcagagctggacctggttcaaatgggaatgccataccactgtttattttaatgagataaagagcaaagaaaaataaaaaagcaaaatctgcatttgaaaacattcaagtaacgtaatctgtattagtcgaactaattctaagcctggcctggttttgattttagagatttccacagctccacgtgtacccccagggtggccatgtagaggtaacaacaacaatactaggaagaccattccaagcctctgtctccatttcttgcttttctgacacccttcacctgttctttattcagctatttactggggcatggtctttatctgaagtttttcctggtattttcaacccattaggataagtggggtgggtgtagggggctgtgcccacaaaacagacatccaacttggttttaggaaaggctttttagaggaaatgataactacacggagtcctgaaagagaaatcatagaggtagaggtgcccacttatctaggtagagagaacggcatgtgcataagggagagataaaagggcacacagtacatctgtacagctgtgagtccccaagcatctgacctctcttgaatgaggatattgactacaggttacttagttgaccttgttaaagccttatcatatcaggattaccagggtacaaaaacattcctaaaataaatggctctgttactaaacactccccttataacaccattgttgacactgtgacttttaaaaatctctcatatctggccatacctgtctcaccttcctaaagtcacactgacagatgacacaccagggcaagatgaaaactgtagggacttgtgtagaatgaaacgataacttcctgttcttaaaagggactgttgatataatatcctttttgcaaaaacagggaaatgcttaaggttggagtttctgttttcaataatgaagatggatattcacatgaaaagaagacaaaagaaaacagaatgccccagctgtgggctaagcagttggctatttttatttgtcaggacaaaaacatcaaatgacaattctttcttcatttctctttatgaatctagtactaaagaatgctactaaatcttaagttctattaactcctgacaatgtataaacttgggtttacagtttatatacaccacagttagggatttccatatatcctccagctagtcaagaaaacctttgtttggagttctttactgactattgcatcatccaaatttattttttgcctatgaaaactgaaaaggtgaagaccaaatttggaaattcacgtgtgccaatgcagatatcaacatgaacaaaagaaaaatacatgtattggactttggaaagtaaaatcacagacctattctggttcaaggtcagccataagtggaattgtaaagaaaggccagaaaataatatatggttcatactcaagaacaagaatggtcatatcatgtacaaaatgaattgagctaaaagataaacagtaaaatgctatggtttttattgttagcagacttccactaattataaattaaaggcagtcagtaatacccatagattaaaaagctagttgaaaactgagattcctgtagtaaatattaagcgttgtgtggtacattagtcacatgtgtataataaagacaataaatccatgtaagtacagcaatgatgaaatgtgcataaagcagtttgaactccacagaagtaagcaaagtataaatagatagcatgctcaggcacagagaaaagcaagtgctattttagcacttgagctagtgataatttattgttcaggctctccagttgagtcaatgtttatatggtgctatatattaactgaaaccaaaatagtctgtgcacatcactgtcttggatagattactgagtgatcagcagaaaccatatcaaacaaccactcccctacgagtgagggatttataatatttaaaatattcatcctaaagctccaagctgttttgacagttttgtctgttcataaatattcttcaaagagaggcagtatggcatatgtaatggaaaaagatagtaaagtggttagcattccaaactcaggacccagattgcctgggttcaagtcctggctctgttacttactagctgtgttgactttgggcaagttacttaacctctctgtgcctcagtttcctccttagtaagtggggttaaggatagtacctacctcatagggttgtgaagccgaaataattaatacaaataaaacatttagaataatgcctgacacagagtgagggttactacctagactctgccacagatcagcagaatgactttagataggttacttaaccttgacctttggtttcttctttgtaagatgcaaaggataataaacatcttacagtgtgactgtgagaatcaaatgagataccatatggaaagcagctagccctgaaggaaacacttcagattttcttcttcttgtctcttctcatcctttcccttgcagggatatttgtaaggacactttttttagcatctctgtatgtcaagcactttgttcctaccccactcacctagccttgaccatactttgtgaaatcacaaatagtcagacgttagaacccaaagaattgacctgaagacctgtccttttatcacgacactgcttttccatagaaatacttccttcagaaatccttttaagattaatgccacccaattctggcctactcacttcttgatcagtgtgggctgtattttcatttgtgacactgaatatgtttgaccatttcatgtatatgttatgtcttcccaaccaaagcctgtgttctgtgagagcaagcatctctcataactccctctggttagcctttcttgcctggctttcagtctgattggatcagaattggacaggaccggaggatttagcaggtcaggagtgattatcagctgtgaagttggcagtgtcgctaaggagtggaaccaagatgcccactgcttctggggccacattgatcacattcagacatccagaccctggaaaactcagggtcgtttctgagtctacagtctacattcaagaagaagggtggaaattcaagaagtggccaagaaagactttcaacaacttactcggatgtcatcaggggaagactaagagtatggccctcaaggcgccttcaaggatggcattacttgctgaattcatcatggtcggggggcttcaacagtttacagaagccttcaaatatttcaggaagcctctgcttccatcctactctcccctgatgggctacagtctgtattacagcaggaatccttttgcaatgagttgcacttatcttcaggcaaatgccccagatggggatatgaggttttatttacagtctgcaaaatttccctaaagagattggtgcaaagcagagctctatggacttcctcctggcatgcttgaagatctgatctgttcatccctcaaaggccagatccatctcttaggggctgacacccattaaaagccaactatataggtgttcaaacaagaatgccagtgtattcatctgtaatgagaatatttcagattaatattcatgcttgcctggccagcccatgctctctctgcagggaagttttcctaggaagccagatatgctgcagaggcagcttggtgagcacagaatctgaatacaggaagttagaagagtgggtcggtgtcaagctgagcccacacgtgcattcccaaggtcttcttaggtagttggtcaaggctccttatccatggccaaggccagcgttggcctctcaaccagcagccgatgagtccctgctctgattggtagctctgtctcctgcaggtactcagttgagttgtaatcaaacacttcaggattgggaccattctgtttctttgcggggcctttttctcttctgctctgtcatgcgtctgtgccactgtggtcctggggatggtatgtttgagggcagggccccatgcaggctccttccacagcataatggagtgctgccttaagatacactcaaagaagggtggtgagagaggtgtgtggttattcttgctaacataaattgcactgtttaatgtacacaagagatgggaaaaagaagagagcaaaagaattctctccaggcaaatgtttactatggaaactgtgtgattacagatgtccatatacaattctcagacatctgtttaagccccccgcccccgccccatgcagaaggcgatggcgtgtttcctttcttctgaactccttccacacatggaatgatgccattgccagcccttgtcttcagtcgcctttttcagaattggtttacttcttgttgtctttgaattttctctcatctagaggctgctttggccctctgaggtacccacgggcacagctgagctgatggccaagcgcggaggccccatctgcagctgtctctcatgaggaacagctgtcccatgcccatggggagagcaagtcctgtgtcccaaacagctctgtgccccacctcaccctcttcgccataatagctcaacttccatgaagcctgctgtgatgtgagccacaacaccaactcctgggtgggggtggggggcattttcctctcctggggcaatagaggagcagacacctgccctcttctttctctccctcactgctagcccacagccaagagggaggtgtccagaggggtcatttcctgccctctctggtggcttgccctccatgagttgctgttaccccttctgcacgctcatctgccagctgatcttacttcgggtggaaggttttgtgtttgttttccttccccagcacttccttgtccatagcaaggggtgggtctgagccccaccatcagtgtgacatgcatctgctcatttgtgcattgacagagattcgtcagtgacctaggcatgcccagctcggtgctgagtgctccaggcagtaccgtggcttcaacagtttgcagaacccttcaagtatttcaggaagcctctgtttccatcctgctctcccctgatgggctacagtctgtcttacagcaggaatccttttgcaatgagttgctcttatcttcaggcaaataccccaggtagggacatgaggttttatttaccgtctgtaaaatttccttaaagagattagtgcaaagcagaactctatgcaaaatttttttgtcctacatgtggtatgcatgtttgtgtgtgtaataaaactgcagagttgatttgcagaatgggccaatgaagcctgttttatggtctaatttatggcaggagaatggagtttgcacagccaccccttgtttcaggctgtttaatatgcagggtggctgtggtagctgctctctcttcttcctgtcacccaccctgtggacatcccccggtctcaagggagcagcatatgtttttccacagtcccttctctgcagaggccagccaaggacgcattttgtccatcaggtgttaggatcctcgctccatgcggtcagctggtggtagctctgtgttttctcagtacagatgtggctggactggcactgggaccacctgatccttcttcacagggctctgtttcaaaccgtgggctggtggccagaccctcttcagcctgagcatgtccaggtgaatctcctgattgtgcaggctgtggctgacagctctggatagggaacagcttccaaccttggctgtccactagaatcagcctggagtatttaaaagttctggtgtccaagccacaccccaaatcaattctgccacactccctaaggataagacccagtgctctccaagtgatttcactgtgtttgcaagattgagactaactactctctgggaaaagagaaaggaggaaagaggaaggcagagcaagataaggggagaagattggaaccagggagaaggaagaaatcaagggctggccagaggtggtgaagtaaggagatgccccccagcaggtgcctggagatccccagcaaaaggacgatgtgcctgccccatctctgaccctgcacttggacgtgaggaaccaagagaggctcagaagaggaggcagggctccttctgtggaacctgcatgcatctgcccttcccatcagacagactgcttcctagccgtggatttccagatccagagttcactggaatgtctcttagcttctgtttcttcatccacaaaacagagacgtcaaatcgtacttgcaggttgtcatgtggatttgataggatgatggtgaagttggacacatgtctgacattctgcaagggaagcttaatgatgatagaccttagaagaagtccacaactctatttcaagttaaccctccccataacttcattctctctgctgtgctgaaaggcagtggttctgaaatgttgttttaggagagctaaaaagaaacacagaggtccgggctcactgacgggtccaggcatctgcatttttcccaagcgccctgggtgattctgacggccagtgcttgggatcctctctacaggtgaaggtcccaatcgcaaagctgagagagagagattctgtgttgctcacagagctttactgccttccagggcttgttttgcacctcctagttgctctttctaatgatttcagtgactgtcccacctcaacataggaaagaggggtatgcgaggcgtgccagggccagcagccacacaggggtaattttggctaggttccacctttcatttacaagtcaaactgagatgaactctaaaactggcatcctccaaattagtaacctgcagccaaacaaggagaaaacgctttttcatttctggtggcagaggtaaaaatgactggtctgtcttgcatgttgcacttgcttgtcctgaaagctttacatttggggcctccgtcgtgagccatgagagtgcatggtgaaacaaagcatcttctccacattaatatttgtttttaaaggcatgaaaagccccttggatcacaatgaatcaaagcgtctgtacactgacacgtttccactgggcattgtgggaatgttggtctgtgggagcccacaggacccttggtggatttactgcttattgtttttgctgtaactataataggaaaagggatgtgtctgcccataggagcagctaccgtaggagccctgagaggcccgggagctggagggctaagggaccttgatgatggagagccccatcactagtagtttgagagccccatcactagtagggggtctaggagcattggctggagaccccctatcctacaatgcagcttcagttccccctgcttctccgaggcagagttctcaccaagggcagtactcagctggctggcagcgaagcattcacgttgccgtggtcagcctgggaaagtggaaaacgccatggagattaagcctggggtggggtgggcggtctggggtggggtgggcggacagcttctgcctccaccttctctctccaggggaagcagtgctgctcagcagcccccatagagccggggaatcggagcaagccgtttgttttccgtttcacaaaggaggagaagggattcctgctgcagtttttgctgaagagcaagacttcctagcaacacccagagcttctgctttagcaaaggattttaatatctcccttccctgctcttccccatttggctagggagctggtgtctgattcagaaaagcaacttggctataggacatcagtgttcctatggctaaaacacattttccataagccgtcaggggttaataaaatatcagctaggcatgtgtagtgggtttggaagggagaagaagggaggaaaatgaaagggaagaaggaatgatgccgaaaggtaagggtttcctaatcaggtgaagcatagtgcttaattgatagattgcgtagatggccatgtgcttttgtaacttggggctctgaggtctttcatgaaagggatagctataagacattcatcacaatactgcagaagtctcattgagtgagaaaagagaaagctaaatgaatgatcaatcagagaataaggacacttacaacagcaatgaaatcgagcatctgttgagctactctgtgctatgctgcattctaaacactataatacctggcaactcatttcatcgtcataagaactctcaccggcgagttaggtactattatcatccccaccgtaggaatgaggatgagagggcttgatcggaatctcttgacttaatcaatgtgagtgtccatccaaggaccacaggtaagattcaggctgggtaaagactgagtcctttgctgagatatgctccctcccctaggtggagttgggaaccttcgcctccttacctgccttccgcaccgcaacatagggctttctgggaaccaagcccataggattagaactcctttggtatcgttacctttcctcacctttacaaatagcaccaggagaaaacatgggaaggggctcttgtgtattatagcaggcacagacagttccaaatatttgggatgagatgagagccccaggggccctagagggactcaggatggccttttcgggggctggaatgtacggtgtgtctgagaatctggcaatgctgccaaccggagcagctttctctcagcctgtctcaaattctctccttttctgcccatgtctagagaactcagacaccttttcttttccctccactccagcagccttactgagcgcattcccaactcacaggaaatgttcaggggtgggtggaccattcattcccactctccattgcagaatctttgtgtgtgaagggcaggaaaataggttaaaacagccattgggcactcatgctgtgcttcaggaagtctgctccaagattcccaagcaggctcaagaatggaagcagagagcaagccagaaatatccttactgctttattttattattattttttaaattgcatgttggtgcttttccattaattttaattgactcaagtcccatgacttttgtgatccccaaatcctccataaactcacttcaactgactttttttttttttttttgccttgaacccctttcccttccctgcctgggaacctgccctttaaattggtcatggctgggattttaatcactcctcaaaggcgcagtgacaatttcacaacaaagcagggaggttgggggtgggaaggggagggagttttgttttctactccgattaagagagcaactgttctctgtttgtcccctggggcccactcttggcaccaggctggggagacctcaaacttggtgttgcaacatccatcagacccaagtgagtctggggctcctcaaaggtgaactgcagctgtttggataaaattctaaaatcttgtttgggagattctcagcccttgttttacaatcgttcttcctggcaaagaaaccaggaagttttactttcccaggatctcaggcaggtaattgttttcccaaactgtattttaatctgatggaaatggacattctttgctctgagaaccttcgcccacatccataaaccgtttgtatccgccttgcgcatgggaggctcgattacacagcgccccgccctcccctgagacgcgcttccatctctggttataatttagggccattttcatttctaaacaacagttacgagccttttagtctcttggcatctcggagtgctttcctgttcagcggcggaccacagccaggtggtgggtgatctcccgaggttgggaattggcaaaatcccttacgcggtgtcatttttaagcaaagcagcataaacggtgacgagctggtagtttctgccataaccaatgctttcatggcccccaggctccaactgatttatcatgaggcctcttgctcaggggacttggctcacgcctgaaacaccagaggccccgagtctgggccctgagctcacactgggactgtgagcttagggaagtggctgcaccagtccttttggaggtgtgcacgtgccctcctcatgcaggctgacctggcggggctcttatggggaggaggggggctgagttaattctccacccctgcactttctggagatgcggagagtccaccacagggaggcagatccagccctccctagtgaattaagtgactgcaaacagagtcagcttggaagcttcaggcagggtcctaccccctatctccgccccttcttcttgggggctgtttcttgacccatcattaaaaatgtaaaagccaaaacgtttcaggggaaaagtccaatttgccagaataactttgttactcatcaacaaatactgatctatcacaccttgtgctaggtgcctccacgctggagaagtagccagcccatttaaaatgtcagcaaagattccagttgtctaaacgcgccagggacaggcaaggaggataagtggtgtgaggaggatgctgggactcagctgaagttggaaagctcacagccggtattcagagaactgcaacagggtcccctgggatattagcacgcggggaacctgccccagcatcagaggccctgggtcaggcctggtttcttaggtgttctttgtgctactcctcattttgtggagaggcatccttggtagaagtgaattttgtaaaatatgcaaaggtatggctgaatagtgaactcttcccctgtcctcaggaaaagcacatttggtacctcctgtcagaggggactcagcaatccactaaagactttttttttaatttattttttacttttgaaaaatgttggcagggtgcagtgactcacccctatggaagcgggtgaattacttgagcccaagagtttgagaccagcctgatcaacatgatgaaaacccgtctctactaaaaatagaaaaattacatgggcgtgggggtgtgcacctgtggtcccagctactcgggaggctgaggtgagagaatcacctgagcccaggaagtcgaggctgcagagagctgtgattgtaccactgcactccagcccagaagatgggagtgagaccctgtctcaaaaaaaaaaaaagaaaagaagaaaaacatcaagttcttcgggaagggttgggaggtgataaagagaggctgattaatgggtacaaacatacagttagatgaaggaataagttattgtgtttaatagcacagtaagttggctatagttagcaatttattatatatttcaaaatagctggaagagaagattttaaatgttcccaacacaaagaaatgataagtgaggtgatgagtatcctaaacactctgatttgttaggtattgtatgcatgtatcaaaatatcacatgtactctataaatatgtataattactatgtatcaattgtaaaaaaaagaaagaaaagactattactgcccttgcccatttacccgctactaccacccactcactcttttattcactgacttattcactgtttgatttattcatcctttctttcactcgttcactcactcattcaatcaacaagcagtccctgaacaaatgctgactctgtgcctgacacggtctaggcaggcaaacaccctattgggagccgacaggaggagggttttggaaccctggtccccaggtgcctgaccacccacattggcctcctaggctgccctcctcaggcccactgggtctctagtgtcagaaaggactggccagaggatgagagacagaccaatttgttaggttaggtctcatcattatagaaaatattgaatagtctgccagtgattttatctcaagcattctcaaaacactcatttccatcctgccattgctccccatgctaataaaggaaaattctttcaatagaccatgccaagtcctgaccagagcgaacagaacagctcgtctagggaagcaggcaaccaaaccacgctgtgggagttcaagctgagatcattttttagatttccctttgcttgaaaattccatccacaattttcacccaccttcccatcatcccaagtcatgtatccttccatcataacaagtcacatctccagtgtgagtgcctcccatgtcacaggcagcagagaagattacagtgaaactattcagagaggtgtgagccccgtagaaagctggagatcagaggatgcccgtctctcaggctcctgatactcttaagaaggtgtctaaatagattgtctcctgagtagtcccaatagctttgctgtctgatgtggcgtggagctccagacaactttgtctccctgagagtatttttgggcacctgtgtagtgggaggaggagagagcaagggttgggaaatctgactttgaatctcctctctatcatttaccagctgattgatccaggccaccccttcacttcctgaagcctgaattttcacactttgggttccttcttaaatccattggtaaaacaggtttagcaccaatggggaccttacatgaactaacagggctggaattcacctaggttgcccagctgtgctggctgcttacagctggctgaagcctagtctgattggcctaggtgcacactatgctggttgctagatgttttgaatatgacttttggaaataatatatgtgaaagtctctaggcagtacaacagatggttagctaattcgactatagcatttggctagtaccactcccacgtctaacttaaattatgtttcataatttttttaatcaattgacaaatggaacaatctttaaatttgcctgtatcttttgagggtcaacaaagaagttattcagtgtttagggctgagccttcttttccagtattttttcatgaatgctagtgatttggttgcccaaagttccagggaatgaactttatccaagctttggagagtgactgaggaagtgcttgtggggggcttgcgaatgacgataatatttgaggaaggtggcttttgacaaaatgtggtagacttcaaacaatgtcaagacagatacccctcaacctggatttgtgggtcagtgtggcatcttaggtgaaaacggcagacatgtgtttttaggagtatgctatatagttcttaatggaattccacaaaatttagtgttttgggggagatgacagagagattgagggaagaccgtagaacttcttaatgcttttttttttttttttttttgagacaaagtctcactcttgtcccccatgctggagtgcagtggcatgatctcgactccctgcaacttccgcctcctgggttcaagcaattctcctgcctcagccccccgagtagctgggattacaggtgcctgccactacgcccggctagttttggtatttttagtagagacggggtttcaccatgttggccaggctggtctcgaactcctgacctcaggtgatacacccgcctcggcctcccaaagtgctgggattacaggcatgagccaccatgcccagcctctttatgctctttataacagaaaatgaatgtaccattttttacttgggtctcagaaaagacaagtatgagttggtgtttaacattagactaggttgtaaattgacaggagagccatccacatacatcagaaaaagaggagcagagaagaaaaaaaaaacaacaataaaagacctgagacatccattcatccacccgtccatgcgtactagaaattctgagtttcaattgtgtttctcattgagttttgggttcatagtcttggctgggtcccttagcattaagtgaaacaactgctaacctaggaagtaggtaatctttgtttatttattatctgtaaaatgaggaacaaaagagtactcatttcatagaggttttaagaattaaatgagtaaatatacatatgtgtatgtgtctatatatagtcatatatacatatagtattatagatgtgtgtgtgcatcctttgataattaaattacagctatgtatcctctctccagaaaaattcacaaacacaagaaacttagcctaatattttcagagattttccaaagccatgggcctcattccaattatccaagtgaggaaaccctttctatactgaaattcttattatgtttttctcacttaaaaggaaactgcaagtcaaatttgattatagtcagtattctacaataaatatttctttgtggttttcatccccctaagatttttaagctcagtcatgtctagaatataccaaatgataagaagtctgatacaaacaagaagtcttgtcctattagagttcatagtaatagcatttgatctataataacagaaaaaatattgcatggacatacattaatctattcctgagcttaactccagatgaggaatcagtttttatatctcatttgtacagggtggagagagatgggcttttttctttcgatttgtttttccacgtctatttagagcaaccaaaataggaaaactgctgcacaggtcttaaaattcacttcctccatccgctttccgaattctgctccaggtctgatgactataactttttatacatgtcatttatttttatttttattttagtctaaatgtctcttcaaaaacaccagggaaaaacatttttagcttcactaagaaaacaaacatgtttaaacaacccccaaaatgttcaggtagagtcggtgtttttggcttgtgtgtattttaacggtgagcctagcaaaatatatgttggaaacagaatttttcttcatcttacatgtgccagtttctttctggaataaaacaaaaaggagaattgatcacaacttctatattggagctaaacttcttgtggttgtgaaaggttatttcaagttaaacaatatgatgtcttttttcagtttttaattacgattatgtgccagtttctttctggaataaaacaaaaaggagaattgatcacaacttctatattggagctaaactttttgtggttttgaaaggttatttcaagttaaacaatatgatgtcttttttcagtttttaattactatttatagacatcctgcgtagagtcaatcaatgggaatgcaggctatggtgcaagtgaagacaaagctgacctaaaggaggaatgaatgcggagttgagatccgttggtgcatcatgacttttctgccttcatgatctcattgaatacttttacattttcaggtagagttggtcatttagatgggaattcactgtttttgttttttgttttttgtttttgagacacagtcttcctctgtcgcccaggctggagtgcagtggcacgatctcggctcactgccagctccacctcccaggttcacgccattctcctgcctcagcctcccgagtagctgggactacaggcgcccgccaccacacctggctaattttttatatttttagtagagacagggtttcaccgtgttagctaggatggtctcgatctcctgaccttgtgatccacccgcctcggcctcccaaagtgctgggattacaggcgtgaaccaccacgcccggccgggaattcactgtttaccattttgatgcctactctcagggcatgattgttgagtccccaaagactcaagtgggaaaataataatattctgatgaaaaagccagatccatctcaccagttcttcaggaccaagcagcatcagggtgtttagtgtctgcgttgttcttgctcaacagacagataagtgaggaataatactcacgagtgaggagatagtagctgtgcagcaagtgagtacgtgaatgaaaggatgtgaaaagtaattaccaggtgaagtgctctgtccatctttagaaattgttcattaggattgtgttcattcactgtgtttttaaactattaatacataagaccatgctaagctcaacatgctctgaatcatgggagtcagaatcatcctgtgccttataggtattagcccaattacaggtcagagttgaaatctaactctgatatataacaaatgtatttgatattctatctaatttgtgtatatatttatgtatgtatctatttattagagatggggtctcgctttgtcacccaggctggagtgcagtggtgtgatcatagctcactgcagcctcaaacccctggactcaagcaatccttctgcctgggcctcatgagtatgtgggactacaggcctgtgccaccactcccagataatttttttcttttaattttttgtagagacaaggtcttgctctgtcacctaggctagtctcaaacttcaaggctcaaggaatcctccagctttggcctcccaagtgctgggatcacaggcatgagctatgtgcctggccatatttattatttttatctcttacagcttgaagcatatttaccatatatggactagctttctttcaaagtttcattttacctgtggcatcatatagctgttttgtgagtgcacttaactagactctattataactagatgttatcaatcagttggttattgtcagtaacatcccttctcatttcatgattataagtgctttgcccttgcaagccttctgaatgctcctgggccaccagttgctaagcattttctttacatgttatctgagtttatcaggatctcctaacctccctcactccagcagtgaatcaggctcattcacaccgtgctagtggaattgcagggtagacacactatgagatatatcagcaggctatttaaatcctttcatttcctaaaaggttaaaaggccagatcttagaaattaaggtgttggtttttgttttttttcttaaatccattaacctggcacagggactgatacttgaaaattacactagtaaactctggccattgtcaaatgatggacacgtatcacacatggcttatgaatacttaggcaaagcatggtttttagacattttaaaagttcactttgaattcagaatagaggaaaacattataacagtaagaaaatctcataaaagctgaatttatatattttactagcattatttcaaaaataaatcgttccttttctaatctgctcaaaaaagtctatttactaagaatacctaagaaaacattggcgtctacctgattctaagtttttggaagaagacactcgattggtgtaactctctatcagtgtccagccaactgttgacagtcacccatgtgcgacctgtagcttgtgagcccagtgaccgtccatgacaagcctgattaatttcatacctgctttgcacattatcgtttgtacttgtgtttccttatgtgcaaaatagaagtacgactgaatgaaagttttaaagagtgcagatggccccatgatttgaagtcttgagcacatataaagggcagacacaaggaaaatttgcagaaggataatgaaatgggagaagaactccaaagtgggacccaatttactggtcatataccgaatgtgacttgcatctcacagtgttagtggaggactttctctgacctggggttgggtcttttccgcataaacaccaaagatggaagaaaggaagcaaaatgtaatgtagctgagctttggatggattaagtcaaggtcatataaaacagttccaagcaaaagtggggcccaggtgtccatattacgagttgctaacattgaacactgactatgcacaaggcaccattccaagctcattgctatattattgtagcccattgaaaacccaagtttctagatgctgccttgtctgcttggtgttgcttagttcaatgagttattcattcattagtatgagagctcacacttaccatgtgcccgtcactgttttaagcatgtcgtatatagtaacatattttatactcccaagaacctaatgaggtatgcactatcattagccccattttatagatgaaaaaaactgaggcacagaggcatttagcagcttgcgcaaggtcatgcagtggtaagtgactgagccaggtttaaagccatgtgtgtgctgttagtcaccaagttaggcttccttccacatactgatcactgattacggtcataatatggctattgatgacatgagtttgcttgttacagttgcaaggaaaacattgaaaaatgtgtaaaagaacattaaaggatcatctctattcttctcaagagataagaattttaaatagcattagaattactttgatgacggccaccggcatctaccccttaaagaaaacgcgctgggcacggtggctcacacctgtaatcccagcactttgggaggccgaggcgggtggatcatgaggtcaagagatcaagaccagcctggccaacatggtgaaacccccttctctactaaaaatacaaaaattagctgggcatggtgtcacacacactgtagtcccagctactcgggtgactagagcaggagaattgcttgaacccaggaggtggaggttgcagtgagccaagatcatgccactgcactccagcctgggtgacagagcgagactccattgaaaaggaaggaagaaaaaaaagagaagagaagagaaaagaaagagaggagggagggagggagggagggagacagggagggagagagagggagaaaggaaagaaagaaaaagaaagagagagagagagagagaaagaaaaagaaagaaagaaaaagaaagaaagaaagaaagagaaagaaagaaagaaagaaagaaagaaagaaagaaagaaagaaagaaagaaaggaaggaaaggaaagaagaaaggaagaaagaaagaaagaaagaaagaaagaaagaaagaaagaaagaaagaaagaaagaaagaaagaaaaacacgaaggggaaaaactattctgtctgcatttaacttagaaaacaagggcctgttgtttctgaccgcccaaaagaagccctccatggaatcgattaggaaataagtgtcaccagggatgatcaggtgcctgcctgtgcctgtagtgctgggaagcccatgttagattctcagaatcaaggctggagatacttcaggagagtcagccagaggctgggaattttgcctgtttattcaatgctgttaggccaataagcagctttcatcaaatacagttaagaccccaagataaagacagatgaccgctgagcgtgttcaatcctgaggacttgggttgttgctagttagttgttgagaatggctccccactttggattccaatagggaaagtgcaatgtttctagatcccaccctcaggtcaccttttctcttcctacaacatgcagaccgcctaaaaagccctggcattccaggaggactttatacttcacagaagatgagggaatctttggaaatttaggcgacagaggccagacataccaataaacggagcagtccacatttccccccagttggaaacagatcagaagctttaggcattggaaaatgctagccacatagcattctgagtttgagcatctcgtggatgtctggctgtggacgtcagctatggatgacgataagcctcctgtgactctccatgcagagtcatcagtccgtgttagaactgcagccagcaaagaatgacctcagagactatggatgtgcatcctccagggcctcagtccccacctcaacatttggcctgggcgatcagttccagtgttgacaggtggcagctgctggtggtccaaggggacttaggacatttttaattgttttgtagacatggaggtcttgctatgttgcccaggctggtctcaagctcatgggctcaagtgatcctcctgcccatgagccatcacacctgaccccagtcctgtttttaaatgtgcccagggaaggaattctaaacctcctttgtcagacttcactttggcaaaatgatccttggtacattggcaatggatggaacaaggaggcatgggcactcttgacacattctccaataggcccctctgcctttaggcagaaccacctgcccattccagccagatggcaacaatcatgttgttgttgttgtttagagaaagggccccactctcttgtccagcctggagtgcagtggcatgatcataggtcactgcagccacaaactcccgggctcaagtgatcctcctgcctcagtcctgctaattcctttatttatttttttttttttttgagacggagtctcactctgtcacccaggctggagtgcagtggtgtgatctctgctcactgcaacctctgcctcccgggtttaaatgattctcctacctcagcctcctgagtaggtgggaccacaggcatgcaccatcacacccagctaatttttgtatttttagtagagacagggtttcaccatgttggccaggatagtcttgatctcttgaccttatgatccacccgccttggcctccccatatgctgggattacagacaggagccaccacgcccagccaacatccggctaattcttaattttttttgtagagatggaggtcttgctatgttgcccaggctggtttcaaactcttaggctcaagtgatcctcctgcctcggcctcccaaagcactaggatgatagtcatgagccatcacacctggccccagtcctattttatttttaaatgtgcccaaagaaggaattctaaatctcctttgtcagccttcactttagcaaaatgatccttggtagctaggcttttcctatagcaagaagagaaatctgacttagagagaaaagttatgtatttaaaatgtcctagaaggctagatggatggatgatggatgttggatggagagaaagagaaaaagaagtagataaatgaatagatgatattcatgatagatgaatagatagatgaaagagaaagggaggtagatagatgaatgaaggaaggcgagaaagacaggaaataggtgactgtaagagacagccaaccccctagcaatgagacatatttattatagaattatacaccaaaggaggcctcttaaaacccattcaaaacagaagccaccttccttcgtgctcccatcacctttcccacatccctctactccagcaccttctcatgttgcaacattagaatttgttagctgttggtctccctggctggagcatgcgaccataaagcagggattacatctcattctgccgtgtagtctcagcatctagcccagtgcctagcacctggtcagtgctccatggaaggaaagacaaaaggaaagaaggaggggagggaagtacatcagtcaaccaatatgataaagaaacctgtataagacgatagtgtcccttgtcaggaatgcatcatttctaatgctgcaatcattaatgttttactaaccaaacttaacctatgtgatacctcatatcccgtcggtaagctgtcatactccaagtcaatacagtgatagcatctgcccagtgttggaggggtgtgttaatgctcactcctgtttaacactgttctaagggacaccagttcattattatactgtttgtctcctaaataatttccaaaaaatgtatttcaccagggttccctgttaatatgtatacgttttccatgatctgatcatgatatcgtatgggcttggccagtgagagctggcgcagtcaactgcagggtgtcctcccagccagtgacagtgtggcttctgcaggtacctcgttccccagtcaggatatgcgtgctgtccagggtccagggacgccgtccctgccccgtccagggtcctggagctggcttgactcctcgccttacatcccccagtccaaatcctctcgtcttccaaggcccattccaaggttggccaagtttctcctcctccacagcggatccttctccccactctgggagctgccttgtctttctccttagcacttcctggtgtcacatttcttcctgccaaccacctctctctggggcatgggactgggcagtctataaagccgtgagtgccccccaagcccacagtccccctccgaggaagccagccagcagctggtcctcatactgagggccaggctttgtgtcctgtgggtctgcaaccctggccataaccagtattggatgaaggacccttgtttaacaaaatgacagtggacttgcttcaaggcagacggcacagctttaaagcgatccagcaaacgaactctgcccatttggggcatgtgatttttgacaatgactgtctggctcaattagacccaacctgggagtgaactctgttttcaacattgtcatatagcttgtttgttattcggacatcccctcgggcttagattccacccccctcccctgcaagccttctctagatcctaaggtccttgaggacagagtcttgctcaatctctttttgtctcccgccagtgtctgggccctttgcatccctttgtaaatgtttgttgcacaggtgactgtaaaacacctaggcccgaggccttcacccccaaggagtcagtttctccacggctccttttccggttgtgtagccatttagcctgagagaggtttgggataggagaggtctctccaggattcctgatgagtgtggatgagcctgctgagcagggtatggaagcagaagcagccattggccagggatgtggttggagggataaacacagaagatgcctgcggctccccaagccagggaggtctgcagctaggggcctggaagatggagacaaggcagtcagagaacaatgaagacagagccagagccatgaaaagtgacagcagcaaacccagagagagggacagagaccaacagagtcacacccaatgaggttcatccaaaccaagacacttccctccatggttgtcagccctgagctcctgtttcctcccttgggttgtaaattcctcctgagcagtggttgtgtttattcatcttggtatccttagagccttgcagggcaccacatgggggctggcacatggtaggcgcccaataataattttgaacctgaattgaattaataaaaatattcttctatttttatttatttatttatttattattatactttaagttttagggtacatgtgcacaatgtgcaggttagttacatatgtatacatgtgccatgctggtgcgctgcaccaactaactcgtcatctagcattcacattttcttaatccagtctatcattgttggacatttgggttggttccaagtctttgctattgtgaaaaatattcttctattaattgacttgaggatttcacagtctctcttgaaaatctatctacagggctaccaaggtttccattaccttgaacgctgacgttcacgccttaaatctaactgtgctttcttgccatggcttaagttcatttctcctccagtggtttcaaatgcatggaatgatttttcagccattcaggaagaaggaatgctgtgtataaagcctggattcaataaagccagatttttgaaaaacagctctttagcatcttctactacagacactggtctgggcagggctttttattttattgaatccagctgaagagcttgactacattaataatgggcttcatttccaaccactgcctcccagtctttccccctaaaagcctcatggtacttaagcaactgctaatacaggaataattgtcagtggcatcacttcctgccgtgatttgaccaccaggatgaggttttcttcttgtacctaatctggagttctcaggcataccatgtctggggctgccagatcatatttaaaatttgtaagcaaatctaatggcagctgtgatttgagttgtattgagtttatgttgagaaagtaggatttgggaagattctcttgggtatgtagtaatatttttctggagcaagcctacctaaagattgcccagaggttcaaatctcttatttctacagagcatggaagggtggtaccatatcacagggtcctgagggcggactggaagattttactccattcatttcaaagaaaactctatttgttcagctcccataccaccaccatacttctttctgaagcttccctggaagatgacatctcaccatcagttttctttacactggacttgactcatgatggatttagtacacataactgtaacatggtatccatacagaagataagctcctctttgcttcaatgaaaaaggccatataaaagcacacacctattaacaggaatatagcacagccactaagagcacagactctgaagagtctgattgccagattgccagagtttgagtctagcttagccactatgtgactttggacaacttccctccaatactttgatctcctcatgtgtgaagtggggaatataatagtgcctactttttaaagtcactatgaagtttaagatgaatggatatttgttaagtgcttagatcagtgcttgtacacagtgctatataaatgactattgttgtgtgttttttttcattttactgaatatccaatacattattcctctccacataacttcctactaggataaaaagtaaagtttctctttcaggcaacatgcaatcaaatttaacagctggccaaaagtttagtaagaccttgcttattacacctttttggcaatattaaaataatatttgtttcaatctaaaggttgcttcatctgctgttatagggctaggcactgtggggccaataggagtgaaatatgtgatacccctcccaaaagaacttgcaatcaaacaatattggaaaatataagaagtgatatattaggtagcaaaacaaaactgaagagcagatgtgatgaactattggagaagtttaggagatgtagacattagtgacagcttgaatggtcaggtgaggaaggtaaggagattttcaggtgggatgagctgagctggaagaatgggttaagatttgggtgatgaaggtaagagtgctcccagaaggtaaagatacagacagtggtaaggaagggtggccagccatggtgactcacacctgtaatcccagcactttgggaggccgaggtggaccaatgacttgaaccgaggagttcaagaccaaccttggcaacatagccagaccccatctctacaaaaactagccagacatagtggcacatgcctatagtcccagctactcaggaggttgaggcaagaggatcacttgatcctgggaattcaaggctgcagtgagctataattgcgactgcactccagcctgagtgacagagcaaaagtttctcaatttaaaggaaggaaggagggaaggaaggagggatggaaagaaggaaggaaggagggaaggaaagaaggaaggagggcagagtttgggggtttgggagggtgaaggcatggaaatgaaggctctggtgtcttccttggaggagcagtgaggatgctgccctagtggtagccaaggattaattgtgccaagagcatagatggtgctagaaaatcaggcgacagtagctggattatgaaggtcttcacaaagcaggcaaatgagttcagatttggtttaatagaaaataggaagtgagaaagaggtaagaaacacgatctagaatgctggccagctgtgtcacccgcgtgcctgcctgcaccagtagtgtccccgagctgggcctgacaccattctttggtgatggtggaataaaggcaagttgaagaaataaaaacatgttcatatatgtgagttcccaagacaaaccacagcagatcccaggaatgtgtttctgattgagcaatgaagacgtgttggtggggttttggttggggtgggtgtgggtgtcatctctgtttcatgaggtctaaatttctactggctcagaaaaagaactttgagcagttttttgtttatatgggtcatcatcgtcttcaatttttgtggagttttctcagagcttcttgatggtctgctaatactaaaataaatatattaggccttttgcctgtctcttcttttctgtcactgggtgatggcctttgtttcctctaatggacacattccagatttgagtgcggagcgggcagtccctggctgctcatgtctgacatcgttccctccctgtgtagcaaagggaaatcaacagcacgtgggagggggaatctgtgttctaagaactgctttggtttacacatctatagataacactcaaccagcactgcaggtcacatggaccggctggtgaggctgaggatgagtcacttttaaattactcatagagaaagaaatatgtttctgaaagccagagtggttggcttacacatggaggtaagagagaaagcaggcagcttcataaagcactcagacctcctgtgacagctgacgtggtgtgtagtgcgtcaggtgggaagacggggccctgcgtcctcagcaatgtatttggaggtgaggctttttgttgatgggaacccctgtgctgggacttgggggtatttaggatacatttccatctagctagactttctcttacagtcccactttgtaaatggccctaggacccttgattaactttcagtaacacagtctagtggtgaacaccaagccatctgaggctgaaatatggagaagtatgtcagtccaacagaaggtcagatggggaggggcgagggagctttcagaaagtcttggagtacaagggcctcagctgagcctcgaaggtcttcattcgttgcaaagaagaaggaattctgtcccaagcgagatggaaagatcatctgagcaaaaagaaagcatcagtgacagaggctgcaacttcatttcactggctgagtctaaatttttttcacaggaaaaaatatacagaagacaagagaacaatcaccaaggaagcccaaggcactgcttactaaattggtccaagggggggatttcaccaaatgcaaatgaacaaagaacaatacatgtgactcaaaatatccgttatgctcttaatacttacgagagggtgtgaggcagggaggtgaccttttcaagggttgaaagctgtcaacttttcaaccacattgttttcattgctgggagattgaagacaggatcacctcagggtaccattttggaaaagtgatttaaaaaaaattaaaaactccttcctgcataatgttttgggacattttgaattgtttttgccgtgaagacatagaattcaggtgtccaggaaatactgcaaccttttatgagaaatgaatacccagaagtctagagctgcctggcactcactctggcaggtcttccacctctggtccctctccagcagaagggctagtgagcagtttaggacccctggagcaggggtacccttacccccaccccaaaggaagcgatgtggcttttttctcgcagccccgcccccatccctttgacaggtcactagaacaacagagtgcccaagtggagacagggaggaatgtgatggttggagggacctaaaaataaccatttttccctcatcctgaatgtgctaccctgggccagacattccctgaagggctcctctgaaatctgggaaacaggaaatgctaagaaaatctctaatttgcctggtcatgtgaactcctctcggtgttgaaacagaattttggaagaggggactctgcactgtggttgagccctcctaatcagagaacatttgcccctatgagaatatggtggatgtgactattcagcctcaacttccctctttctaaacatgtaaactctgatgcctaaagaacaaaaccagaaaagaaacccactcggtcttagttgcgtatctgagtgccgacagggcggctgagaggggcccacgtgcctgtcgctaaaaagcccctttggcatttcataacaggacccaatcccgcagacttgtctgtgcaggctcacgcaccatcttcaaaacctttactacctgtatttgtagtagatgattaatgattaggctttcttcccacacatttggctttgataatctccactcaaaaatattcagatgcaaataatttaaaaacaaagtggctccaagggctctttctgggaggatggaaatgctgcatatcttgataggggagtgagttaaagggatgtatgcctttgtcaatattcataaaactgtacacatgatatattcattttgttgtatgtaaatgatactgagaatgaaaactcttaagataataaagtgggttgagtttggaaaccagaaaaagtggacacgatgtaaatgaccccgctgaaaacgattcgagttggccagcagaaactaagaaatgcgtacgcgtgggcagtccccactgtgcggggaaatctttgcaaggtgagcagattcagctcagctcatagaaactccagctgattctgcacattcatctgtgtttttgtaggtgtttttggtgtctttgtgtccatttctgtttggctcatttccctactcaattggattttgacttctatttcctgaatacaacacccccgcaatacctaatatcccaggcctgtgaaaagtgaatgcctaataaatgtccactcactcactgagatggactgcttctcctgtctctgttacattctatcaaaattagccagtgcatttggccctaaatgcatttgtaaaaatggaaagtaaaaggagaaacattcatacttgtactagttttgagaaaattcccagttatctctgcttctaaaagaaatccgtttcagaacttttacttgggaaaaattgcttttgcctaacaggaaaaataaaacatagactccagacgcagtgatgttcgtgtgaaattaagaaaacagagttaatgttgatgtcttagtggaggcgaaggtacgcttcctttctctctttttcccccttttcaaggcaaatcagaagaccgggtgtggaaattcctgcaggtttgctctgtgtcggtttgcacgtttgtagatggagtttcatgctttttctcactagtcagtctttttgtcatcatctcatcttgaaactagagaggaagggaatggaagggcaaattgctaatatcagagacctctggaaattccccttttatggtacatgagtatttaagaacagttctctttcagttgtgtttttgtgattttggtgacactcagtgggcccagccctgcctctagtcagactccagtgtccttcagcagctctctagggcatgggctggaggcagtgggatggggggttaacgtgaattgcactgctttggaaaaacagcccaagagagatcctttttttaaagtagataacctgagcataaatctatactcacatgatttttaaaaattaacttatctagcatcttttataaactgataaatctctcatgaattaatgactcaccagtgcctaaatggtgggcagacaggcggcgctataaatttctcttggcattttgtgtgtcattatatatgataagttccagtaatggcctggcttcattgaaggttattttaaaggaagaagctttttatcccacatggtttcaggcaataccttattgaagatgacttagaccttggattctggggttggaacaggcttgtgtccactgcctaaacagggccagcacagcttcgtggggggcctctggaggaaggggccccaggaaggagtcaggtctttctgctcactggctgtcaggctgcctgggggtctcggagggtccagagcaactgatggctggtgtggaggagagcgtgtgacagccagtcccaaggccaggctatgagagactatgctaattagtgaagtccctggtagggccaggtcactcggccaccaggtaaaaagtaccaggttatttctgccttggcagaaggagaaggtgcatgaatattactcattaatacacctcaaggaaccactaggttagacaacaaaataccttctgcatccactcccctattacttcctcactccccaaacatcctttcagtctgctcctccagcttgagaaaccaggagggtcttcctaccgagtggtgcctcccgagcctctggggtacagcttgtgaccctcctcaatcaaatgaatcccagggttccaggccaggtgagtatagatggacttggagcttttcttatgaaatgtcttgagctgagtttctttttcctgctacgccgaactctgtatatgtttgtttttgttctaattttggcttcagaaaaaaaaaagaagaaaagaaaagaaaaagaatgtttgggtacagtgtaaaagttttctcagatccagattggaaactccctcatcactctgaaaccggacaggtgctgagcggtatttgtttctctgtcaataaacagcacgtacttggcctagacataaactcctgcgggagcagtggtgcacatgggcctatttcagtgtttgggaaggactgaagggccctgaattaggaggaaggtctgcttctcaccccttctcttttgatcttctgatagagaccacatagtgttctcttcatggtattttgatggcatatggcgtataaacacaggtgtgacctttacacagtgcactgcgttacaattataataagtgagaggagataaagccagctggagtttaaggttaacgctgaaaacagcgaacgctaattttcactgaaaacaatgtcacagagcaaggcgtaggtgccccttttcaactgccgcgtgcatggttctatgaacagccccaggtgaagggtttccatgaaataagccacctcctggggtacagaaatacttagtgatgcatcctctgaggatcccctttgggaccaccctcctgggcggcatatcccaaatccttgtttggatgggaagggagcattaggtaacttcacttggaacaaggtaccatgattatgtctggtcctgttttccgtgctgacaggcagttcacctctccgggactcagtgtccttgattttaaaataagggactttgaccatattccttcagtttcttgccttctggttttttacacaagaggctcagcccagaagcctaaccccagatgcatacttaattcctcgggaaaacaaaatatttgtcagacccacaattaacttaattgtttatttgtgcaaaggctttcttgtttagttccaggacttgctgttgaaatttgaaaaagggtggccccagattcatgttcacatgagtagctgcggtagctactcaccagctagctcctgggagagaaaatggagaagaaagcgagggaagaaaacggagggcaaattctccaaggtttactcctccaccagagagacgcctcctgggcaagcgtttctacctggatccctggctgcccaggaaattggggaatgagggctttgggtgtggagtccccttggccattatgaagtccatggggttgcagttactgagcagagttagaggcattcctgcacccccacccccaacccacaacgtctggacttgggaggagattccttggcttctgaaagaagcttctgtttctgtttacgtaaacatcaggtggacgggggaggtggacgccagggtgggacgttcttgcagtgctcagatgagggtgagactggaggggccagtacaggtgttgggcatttgggtagcacctaacaataatctaaggcagtggttctccatggggatgactttgccttccaggggacatttggcacggcctggagacatttcgggttttcacactagacaagggtttccgctggcatgtcgtgggcagaggccagagaagctgctaaacatcctccagtgcacagggcagcccgtcctccccacaacaaagaattacctgacccagaatgtcaattgatctaagttctaaagcctactaatagtttgtaagttgaaagcactagattgacacaaacgggaaaagttatttgcagtttattttcctgagggacaatgggctgccactcccttccatgctattgctgggcaagactctatgttggctcttgctttcttctcctctttgaacacccccctcccctgccagcccgtctgatgccgtccaagcctttttttttttttttttttttggcttctcagcaagcctcatgaatattaactgggacactcagggctaaaatgatctctggtcttacttgagaaatgccctcaagcaagaaaaagaacaagagtcccaagaacaccaagtgcccctcaccttggtcacaccaatggcccacactggctggggaggcggggaagggtcctgggagagggaggatgggcctctaacctccaaggagaacatgagtgagggccccaggaagggagagggtgcgacaagcactctggagaaagaaaggagagggttcaaggtgaccctgagctcggggcaagatctgcagggcctgcaattggcagagtgcctggcatctggccaagcagccctccctctctcttccccgctccaccacctgctcctggtcgctgcattgccggttcctcccagcctcttctcacctgctcgctctaacgtccgtctcagccaacagccctactcttccctcccaagccaacagggggaagcagagagcagcagaacagcctaaaggcaacaacggcagtctctttaccgcgcccaccctgcactcctgggcccctgtggcctccaccccagcagctggaccctccgagaccctccttttcccaccaagctcacccccactaagggccctccccacgcaatgcacagcacattccacgcccacccgacatcaatcacgtcctgtctcgtgactcatccgatactgttgacttgctgtacagtttctcacctttgcaaatgagatttgtcgcctcctcaagttgactgtccctggaggccaggagacgtgctgtggccctgctgtcccgagcctttctcagagtctcatgttcagctcagttctgttgattggggacaaaggacactgccatttgccacctctgcccgccctgtgccgacctccaccagacgtttggcatcatgagcccgtgtcgttctcaccccagcctttgtggttgatgttgtagcgtcctcttattcttatagatgaataagttgaggctcagagatgttagatatcttgggtaaggtgaagctgtgaagacttgagaacataactgaacgttctaggctccttaccccacacggtgttgccattccagtcccagaaggtcctgaggttcttttgagatgtgtaatgaatccatcttccttgagcataacacaatctttatggacctgtttaaatagttttaatttccatgtgtttactcattcattctgcaaacatgcacacagcttttacaaggtgccaggcactatcagaacctgggaaaaccaagatgaagaaaatgtagccagtgcccccaaggaggagagagacaggtggcagtgagttcactggtgagccttgagggggcagaataagaaaagggcatgatggggaggtgggggcttggtcaagaaaggcttcacagaggaggtggtatttgagctgagtgtggagaggtgtgcaaaaggcagagtggcatcccagcctgaggatgcatgtgagccaggatctgtagaggaacgaggctgcagctgatgctgccagtaatcacatggagttcaaggcaagcagtgggtgtggggagaggggagtctggaagcgtgggtcagggccagctcgccctgtggataacaggagccactcagggcatttggataagagagagggacgcaactgctttgtgggtctagcagacaccctgggaatactccagagggaagctgaatggggcaagatgagggaagatcggttgggagcttcttgccactgtctaggtaagccatgcagtggggtgaacagaagtggcttctgtaagaccagaaagaggagacatcctaagagacttctgtaaggtggagatgacagtgatggtgtgtccataggaaaagaagagggaggagttgaggatcaccccggtttttctgctaggatataggctgagggctgtcaagggggctgattagacccttagaggcagattttgggaaggtgtaatcagttccctttgtgctgtgttgggtttgatgtacctgatggatatgcagatctgtttggtcgcaaactagggtttgaggttcaaaagagattcaagagtcatgagcctaaaggcttcacaatagggttatagcttaatcctttctgtactatgaagacttcatgaatgtcccaaaatccacattcaggcctgcccttcccagagtcatcattgtcttctagaagcctagtttgtcccatttcagctgccctcctctggactcaccactggctttttggagtggccaggtctgtgtagagaattctgaatggaccattccaggtggggacctcatggcttagtacaaggtccgatgttcttgctgttgggtaggaaatcctgccttgatgagtctcaggatttggctggccgctctgccctgacgatttcaagaaatcacttctgctaactccagaactctacttccaggcccctagctgataatatacaggtattgagcttcatttgaattttttctttaagaacttaccttgactaaagatgttagaaaataagatcctaaaattaaaaattacggactctgcaaaaagagcttaactggcttcaaaagtttcacacaactcctttcatatatgcattttctgtaagctacttgtaaataaagaaggtacctaggaaaggaaaattgccatctctgacagttcaatgcaaaaatgagagaggaatgagagggagtcatgactgaatcttagtgcctttgctgccaggcacttcacagaagtcatttcatcctcctgaccactcgacaactacagccttttatttttctctgttttatgaattcataaatttaggctcagggaggttaaataactcatctaacatgagttagatttaagcattgcagagaacgagaggagaactgataactcattcaactcattgacgaatctagtaatttgcagagttgaggttcaagcacagatctgtctgactctaatgtgtgtgctctttcctctccaatgctactagcatgggtgagctgtgagcattctggagagggtgaaaagtgggaggcagaggcaaaagctgagtcaaatagttttctcagatgagagagagtgggcaggcagtggatattcgtgcaagcaagttggacgccgtcagaaatctgagctgaagttatgtgggtatactcacgtcttgtagtctccgctgaaggacccattatcaaataggtggaaaatacaaaaattgaagatatggtgaagcattatcacctgatcaacccagcatcctgctctcataggtggtgtacaatttcacccagcccaagtcattatgtcttccaggagaaaaggaggctctagtaggcactgaggacaagcacatgataagctattgttttgcctcctgggaatacttggttggccctttattttttagtagcaagaagatttaggagtagcactctgtatgtatgttgattgtttggctttgtacacaaatgttagaaaattaaagaatagatttggtcattgtcatgtctgtttgccctcaccagacttgacttagatatggttctttaaagtctcaggcattttagaataactttggggaaggtatttacgaattaatttttaaaaaaactctttcattttagaattttcttaaaagagatatgtttttaaaatttcaaatacctagaattgggcaaacgaggtgttgccaagtagaggctctgctgagcaaataatgaccacatcaaaacaccagccccaaggaagcaggctccgattctgctcccagagcagcacattggtgtggtgtcaaatgcatgtttctaaagaactcaaacattgttttctcttagttagataaacaaactccttgatgtctatttatgactagttgttagtgagtctcttggaagtcatacaaagcagtgagaacaagaaggtgttttgcaggttggctttgagtaaagaccctctgttttgatcagggtcttggatgccctgctcaatcccctactcgaagttctgagggcatttctctgattgtcctccaaaactgtcctgccaactgctatagattaaataggtaaggagcagctactaagtttccttcttccctcccatgaaggagcccggccatgagatttagccaatgagcccatttaactctctgttttctagctcatttatccaagggttcagtgcaccactggaaaccttcatataacagaaagccagtgtttggggggcatttggtttcaacttgcttgtgtttgagcatttatatttataatagtgctaatctctaagggactcacatcgcattaagagctttatcttaggctgccacggaaactagcatgtaccaacatgactgagaactatgagaaattgggctgggcctacagaaaattaataagctccgattttcatttaaattatcttttccatgagattttgttttgaaacccacaaagtcgggccaagccattagcattccctatgcacacatttatcctccccctgtagcctatgctgtcccctcccctcgcccccagcccctcatctgttatcgccccccatctattatcgccccccttgcctgagtgaactcgcccttctctgaaccgtcatggccaccccttctgccaccaggacattcttgcttgtattgcttgctcctgacctcatagaaggaaaggagtagttgcatttttctcttgaatccaccccagggttttgatcatgccagtcatgttacagatgcccagtaatttctgctgggttagatgttagtcagttgcagggtagattggtgttaggggaggtagcccggccataggcaaaaaagtagcttagggtcaccgcagtcagtgtggagaagggaattttggggggaaatctggacagacgaatttgaccaatctatgaggctaattatagaaaaaaacacaagaagggggaaaatttctttcagtaattagagagatgacagagaagcagggaatgcccctgattgcattatagaagaggagatcaagatgacttcagaagtcatttgctgaaggtacaaagagagctcaaggtgaaaggagtcccattttccttcttggtggaggcgcagcttagtaacctttgaggagtgttgcctgtcttgctaggaaaaatatgacaggagtagcccagtggaggttggagacctaataccccttctcacccccaaacctgataactcattcttaagcatcaaatcttatgttatagtccaatatttctggacatttttctgccacaaggtctccagaatgtgttagcttagcttcagccttataggaattcatatttaaatcgacttcttttttcctacctggagactgctggaatatcagactaaaacagctcacgggaaggctgagcagagtctaattctagaacttgtggcatgttcatgggacacggaaaatacatagaagtgatggtttcacagagaaagggaaaagtcactccagagaaaactggagggagccaagaaaatgcggagagaaagtggggaatggcaacctcagacgcagagggaaagaaaaacaagagaagatgtacgttagcaataaaagaaaaaaaaccatcacaatgcccgttgggcaggaaagtgatttttctgcttttctttcagccctcctgggcccacagtattgaagataggagcagaatgcattcactggtgtccactcttcagctgggtgttgctgaagaagagagaaaccttagccatcttgccaccaggtcactctctttctttcgttttcaggctgacccaagcaaaataggggaaaattgcatctggacaaaggaaacttctctttctgtacctaaaagcctcatgtcaggctgggcgcggtggctcacgcctgtaatcccagcactatgggaggctgagtcaggaggatcacttgaggtcaggagtttcaggccagcctggccaacatggtgaaaccccaattctacaaaaaaactacaaaaattagccaggcatggcggtgggtgcctgtaatcccagccattcgggaagactgaggcaggagaattgcttgaacctgggaggcagaggctgcagtgagccgagatcgcaccactgcactccagcctgggtaactgacagagggagacgctgtctcaaaataaataaataaataaataaataaataaataaataaataaataaatgcctcatgtcaggagaaccctttctgtagagagccatataattaagcactgtgtttgttccaaacaaaaactagagaaagggttaaaaatcaatattattagtgacatctcctctcttcttcactgttaatcatctgccggtcactgtcataacagtgttatttttcaggcctgaaatgaaaattggcgattacatcaagcaaagagtttgaaaggaaggctgggttactgcatgattattcggactctccctgtaaatacgtgaatagttccagcttcccctcacatgggttgagggtaacagaatgacatctccctgggctagaagagaaacagagacagaacaagcgaaagtcgtctggcaccagccaacagttgcaacttatacatatagcccgggaccggtatgggtctgtggcctgttaggaacagggccgcacagcaggaggtgagcagctggcgagcatcactgcctgagctccggctcctgtcagatcagtggcgacattaggttttcctaggagtgcaaaccctattgtgaactgtgcccacaagggatctaggttgtgtgctccttatgggaaccgaatgcctgatgatctgtgttggaacagtttcatcctgaaatgatcccccaccccattcgtggaaaaattgtcctccacaaaacacgtccctggtgccaaaaaggttgtggactgctgacataaatgagcttgattcttttctcataatgtaaacgttatcaaagagacagaggtgtcagcataagcacgtcgctgctccatgcacacttatgacttcgtggctctgggcaggcccgtttagctgggagtcatagctacatttagggaggccgcgtgattgagtggaaaggcaggatattttatgtcagaattctgggtttgagttctggtttcataattgattaactaggtgtccttggaaaagttacgtattcttggtcatctctaaaagaggggtgacagcagtaataacttatctgtggcttgttgggaggaccacactagatgatctatatggaagcactttctcaacaacagcgtgccatgtgaatatttgtttttgtttgtaatagatacctctataataaggagaatgagaaggttattatttcatcctgtttgttcactgtttttatttaacaactttttttttttttcctactacattccaggcagcaggccagaggccagggaaattcgttgccacttcacagtatctcattgcatcattgagaggtttactcctgatccagcaccgaaagaccatttttggcctttaaaaataaagttgaaagtccaagagccagaaagattaaggattaagctaatttttaaaataacaaatgttttcttatattcttttctcatttatatggtgctggtaattttttaaattagattttcatctgggcattttatattaaaaatgatacagttccctgtcccttgtaattgcatttcttttgattttcttttattatgactcgcatatcactgacacttttttcctggaatgttaaaagtatacatcatctggctaaaaggaaaaaatactgacttaataaaaatggaaaagagagagagagagaaaatggatattcttctcttttggttccaaacaaggcaaagtcctcattcctcgttcttcatacatgccaaggttgatgtcacggatccaaaccagttttgagttatctgaaatgggggggagcggggaagcgcagttcaacaatcttctgaagcttgaaaaacaaatttgtcacagtctgataacccaaaaatgactgatggattttctctgcattttccaagcagggaggggtcgggcatggagaatgaaacattctgagaaaagacttaaatgtggaaacttttggttcaagagggtattctaggagatacaagaaatatctcctgggggcatccaaagggaataacactgtaatcttgagtgatgtatggttccattgcccgaggaatagggatgaaaaccataaactcctttggttggggtattaacttatcatcaaaagttaccataaataatggatattgtttatggctgagaagtaggacacatccagagaagacatcccttaatttttcataaaatcatctcagtgttattggaatatgtttttcatgccatttgagctgtcggagtatctcttgggtagattcttaagcagaaatagttgggactttacaaaccctgcctgggattctaatgtctggtgccatgaagattttggcttgtgtttcttttgatgtctagaatatcaagaacattcctagcttctatattacggcaggtcacgtcccggcttcttctagtaaaatcccctctaggattcaagcctctatttgcaccggtaataaatgtgatggcacattgcgactttgaatgcaagccagcagggctgcaggcacctgtttctcccagtgccccaactgtatcaaacccttttcatcctccctgcttttgatgcacaaacataaaacggagtcccagaatctaaaagtgatgtcacttgagtgtcaccaaggacctttagaggaccatggggcatctcttcctgttacaaatgaggctctcaaagcctggaaaggtgaatccctggaccacaagtggaggaactgagaaagggtgcgtcgacactcagaccccacagcttgccattgtgtggcttgtgatagaaccaagacatcagaacagaccagcttatccggttataaatctaggataacatgatgagcttcagagccaggggttgagctctcctgggactcctcccctccaaaggatgtgttccattgccaaacattaaaagctccgaattcttgttttctcgccaaaaggtattgtagacatgatggcagtgaaattatttttttcgcatttaaagttacccttaataaaatcactttcttcaggtggtgtaccaagttagtaaaacatacctgtttgaatctatattccatcaaccatgaacttatgcctggggatcaaaaatttcttaaaacccaccaggcgtgatcctaatacttttttcacagtttctcggggtgtttcagtaggttaggattacctccaaagacatttaaatgatgtttctggttcaaacggaaatgaaaagcacataaaattgtaagacataagaattccaagaatttggcagaggtgaaaacacacaaagaaaagatgaaatttagacgtttttattctgctcctttatccaacacaaatccctctccagttgtcccataaccacaatgccagcatttaactcctcaagggttaaaggaggcttgtagagcgggcctctggctgactccagcgtggatcgcaggcctggcgtcctgtcagacttccacggtcaaatggtaaccacactgcctctagttacctcgctccatttcttggggggctcagggacagccgccatttccccatcagtgtccacgaccagcgtccttctgccaggaggcgggctggaaggtccctcgcagctatggccaagccctggctgcggctgcagaagtctcacttgtttcactcggccaacacttaatttctttatgtatctgagggagtggggaattagtgtcttccaggaaattcaggctctgagttttctgtcctagactacaacaggcaaatggagaacgggttgtggggatcggagctgaggaatgaacttcagctgataaaatgcaagacaaggagggaacaggaaagcaaaggacaaagtgaaggagaaaaaaataaagggaattttggcagggaaaagggatttgggagataggacgggagtcctgtctgggttatagtgaaggcaggggagagaggtttgggggatcttggggacctgggccgtgtccagccattttttgtctcccaccaactcctcgctgttcagctaccccacagagcagggtcttgggcatcctgtgtgctgaggacagagctgagcttatagtcactgtgcatgaaggatgctgtgattctgcttttttgtttgttcatctttaatttggtgtattagagatgttgcactgaacacattccctctcagcatgcaactgccaaaatgctgaaagaaagtgtttggcttgttgggtctgactgcaacaatcacaaacttgccttgcaaacttctggccttccagtaacacatcgaacattaaaggattaaatgcttggtgagcagagctaggttcttgtaaaacacttggcaggtaggttcctaggaatttaaaggtatctgcctttgttaaattatgaagattttttaaatgtgagtagagaaaagctgtttccagtcatgaggagtcacgaggggtgcctccaggaggagagagaccatgcaagaagcaggtgacggggcagtggggcgagcggcccagagaagcccccccaccccctggatctcttgggcagtggggcgagtggccagggaagccccctgtatccccctgggtctcttctttgagggcttatgctctgtccgtggtgtggagccactcttgttcatgcacgttgcagacacaaccacttttggtccagcaagaatagttgagctgatcacttgaaaggatcaaaatccagttgccactgtggaagctctggggccacatattttaatattctaaattaggcctcaagttggatttgtttttgtgactcaaggaaattttgttctctttcacattctagaattccctgtgaagcagccctgtaaataggagggcttttcctgaataatatggaaagaatttctctttggggatttgagtctatatcatacaacattttaaaatactcttgagatggcacgtgcagccctagcaacagggccagaccacagtcaagggcttccagagtgtgccgcacacgttcccgtgggatccagccttgcacagtgcccagggcggcgggggcgggggtgatggggaaggtcctgtgactggtggtttctccatggtcacagggtcttctttctgttgatgtggccccattcgctctgactcacccctgacggcatacaccggcttgctttaggacccaccagggtggccccaaactcccatgccacttccttgccctgaaacaccatccttggttttcttgcttttatttgaagtcctgaggcctcagctcctgtctcactttctgtccgccttccagcccatcttaaacactcttggtacatttcttgagcgttccctgtcactcctcgggacttcctgtttagcctctcatatttattgctccgggggagccggagttggatcttgtatgtcttttctgcttcctttgggagaagcaaaatatagttgaaaaggtacatgcctggcagtcatatagtcctggattcgaaccccggctttgctgcaatgagctgagtgactttgagcaagttgtgtgacctttctgatggcagtctcttctgtctagagttgtttgtaaaagccaccttaatgggctttggcaccacagttaaatatctcttgtcatcccagatttagtgcctagccagaagtagatgctaaataaatactttttaaagtggtttgcctatggttggattgctcgattcagatatgtccaaaagatagatcaaagctagaggaaagaaagagctaaaacgagctatccaaagttagcgccaattatactatgaaaaacatgttgcctgtggatccaagattggccaaggggtttcctcagtggaaatagcaatttgcttgacctaaaatttctcttgaagccttcaccagcccaaacttgagcttattcctacgaccttaggtgtgcatatctctgagtcatcccattggaagagcgtttactgagtacctgatttgggtgatgagcatgatgtcctgccttaaggagctcattgtcatggagtcaagctcactatctcccctgcagcactctgcacaatgctgtgtgcaactcaggcggtcagtaaatgtttgcatccctgaatgcaacctgagccaactcgctccaaggtttctgcaatggcagcaaggttctgccagtgctacacatgcataggcatggccactgaccactcagctgccagtcccacctggaatattctggctctgccatttttgcctgaggaatagtcggtgtataaaggccccgtagcacagttcaaattccatttgcaatgcagccagcacatacttgcatcccttctgcaggcagggtcccccaggctcgctgctgcaagctgcaaaagtgtctgaccggtcctgagcgtttgacgggaagtgacagttgccttggaagtggatctcccaggggcacgacttttctcgtgttaagtgcccactgctgacaatgctgacaggccttgtacagtgggcacgtgtagtgttctgaccttgctcctgcccccaggaggccagcttcactggcttcactgtgagagcgtgtccttgggtcaggtcagccagctgtcaactgtgcccctgtaggttgtgctgatggaagatatttcagcccctccactcacttaaaactcatccatgattgctttcagcttctctttttctctttctctttgtctttctgggtctctgggtctcccgtttctctctctgagtttctgtttttgcttctctctctagttctatatacagcagtatccttcttgcaacagaaagcatactgtcagaggtccttcgccgtaaacagctattcagatgagaggccacgccagcgtatcttgtccatatgttaatgagccaggatccagaaccacaggctgacctggcccaccatttacctgtcctggtactaacagctgctgccactgacagagactgcattttccttgtgatagagaggtctgctgtcttccctgggcacaggaagactgtctgatgaggaaggaagaggattgtcaaagagccaagcagtgttccttgaaatgcatctggttttattcatgttgagtctttccaggtgaactgaactaaatcataaactacaaaatgaaagcagatttttcttagcatgcccatatggagctcactgaggagttcaccaccatccgtcagctccccttgtcccccagagcacagaggatgtaattgttcttctcttcctgatcggtagattgatggtgtggataagaagcctctcccatgggcttctcagaggatcatcgcagtcactttgacggtcacagaatgacccattgagctgcagaactggggagctgggatctgagtaagactattatacgttggggtgcttttgagtgggatgtaagcaggctgtgaagtttcagccatttgtgacttacctgccccaaaccaagaacaacagaaccagcaccatccggggtgcatctggtcctcgacagatgtctgggcctgcggtaggtcatcagggctccctggagctaatgcagtgtggagcttccagaaaagatgcccaggctgatttcttaaccagtcccaaaaagcaagtgccagacaaggcagggctggaggctggcagtgcccagctggctgaggatgccgcatcctccagcctagtctgctttgctctttttcttctacataccctcctccaggtctgaggccactttcagcaaattcctattaggacatgcaggttctttgtactccccacaccaccagcctcagtcaacacttactgatttaaacaagtgaaaaccaaacatttggcccctaactctggccctccacgtttaataaatgaaggactccctcccctcactgcccccagcagcgatgtcctgatgacagcgattaggccaagctgcagaacttaacaagcatctgctttcagttcccatttttggcgtattttcatgaattaactcttgcagtgacaaaaatagagggaggcagcctgggccatgccccgtgttcacgagtcacatggcaggtacaggagccacggcacgcttggcccaaatcatgaccgacaagtagagcatatttgcctgtcgccaatccctgtggagcacacagtgattatgttctactcacatacggagacaggtatggacagtggcgtggggtggggaggagagccacatgtgtggctccagatcccaagaaaaaagagttggtggatctattccaaacgccagtctgcctgtggaatccccagcccctgtcaggcagtggagagtcctgttcggtattgaatataatcagagcttcccacctgctccctactttaagccacactgatgtcaccagttctaattaaaactggcatgagaggcagagggctttgtgggcatatgggggttggggtctgggacaaataacttggattatgctcataaaagcaaagagattggaagcacagaggcacatcagaggtcacagcttcagtgctgtgccaagaaaggcctcctcctaactcacagcaggagggtctgaggccaggtggggagaagagcagtggagaagtggcggatggaagagatggaccacacagagaggaagcaggagatcctctgcaatagttacagtaacacagctctggcacgcaccaacagaacccaagtcacatcctcaaggatgcacgagaaagggtgaagaataaggtcactaactaggtaagcccagatggtagagcggagagagacttcttagaggttcgctacggcggagttttcagatgaggaaaattgaaggtcccaggggtgaagtgagctgctcaccttacaagtaggagtgccccgattgctgctcatgcatccgacccctaacttctcatccagaacacaaaccatgccacctcctactacagttcttcctttttttcttttggagaatgacagtggtgcacattttctaaccagcagcgtctcattcctcattacacttgtgagccgaggatccatcacaagccagtacttctgtggaattccatatggtataaaaatagtttagtccctcttcatgtcgtgtaaggaacataattaagctcttttattgggatatagttcacgtgccataaaattccatttaaagtgatcagcgcattggtttttagcatattcaaaaggttatacagccatcacccttagctaattccagaacttttccatcactccaaaaagaagccctgtacccattagcaatgactccctagtctccccgtctccccatctcctgggaacctctaatccactttttgtcttgatggccttgcctattttggacattgcatgtcaatggactcatagacagtgggtggcctttgtgcctggatccttcacttggcctcatgtttttgagggtcatccatgttgttgcatgtgtcaatgcttcgctcctttttttggctgagttgtaagattccattatgtgggtagaccacattttgtttatttgttcatcagttagtggatatttgggtcatttccacttttggctattatgaataatgctgatgtgaacatttgtgtacaagttttcgtgtgaacgtgcaatttcaattcctttgggtgtactaggagttgaattgctgggtcatgtggtgactctgtttaactctttgaggaatcagcaaactgttttcccacaatggctgcaccagtttacattcccaccagtcatgtgcaggggtttcaatttctcaacatccttgccaacacttgttattatctatttttaaaattagagccactctagtggatgtgatctctccttgtggtttcgatttgcatttccctaatgactaatgatagtgaagcatctcttcatgcacttactggccatttgtgtaccttcactggtaaaatgtctaccagaatcctttggccttttttaaaatttagctacttacgtttttattgttgagttataataattaagttttttgctggacatattttcatgtccaacacaatatcataaaagtgttaagtttgtcactttatgcttgatacttccccccgaaacagtgaaatagcataagcccaaaacaagagagggctgagcaccacaacaggcagggccctcggaagctctagccaaaagaaggtaatggaatgaggaaggtaggaagaaaaatgaagaaacttcgttttaaagccaaaacactggaaagcaggtgactgaggcctgtgtgtatataggccctttctttagggcctcttcaggtgtgccttaaaatgaggacaggagcatgggcctgttctctcctggcaaggccactgctgggcaaatgggcctgcagacaagacacaaagtgctttgaattcagtactaagaaaattatcaggcccatggaagccactgggaatattaccaagcagttactatagggcagggcatgtgtcttatttagctttaagctaaatactcagcaccttacaaaaatagtttggttactgaatgaataagcccgctgaagatgagatttcaaggtcatatagatacggcctttagtctctcttgttatggtttattacactaacctggtgaaccaaatagcataactattaacatatttttagcactttttgctataaatgcatttctccacctatttcagaagtacgtcttttgaattactggactgaccacaccttcttgcaggagggacatgagcccacaggtgccctgcagtatttgcatagctagtgcggcagtagggaacttggttctgtgcttccctccagacaccatcttctaccccagcccagaaggtaattagactaaggaatcctctgaggtccatctctggaatagccagctccggctgaagtctccattagcaggtggttggggccaagcttcctctgccctggcccatggcataagccatctttgcacattattttcaaactgtgaaaataatgccagagaaaggaagcacccatttgggcttctcatttttcagcctccccagctcctgagggcccctgcctgatttgcattcttagctaaatttgcataacagaacacaccagaacttccctggaccaactgtggtaagcgggcaagttttgtttttgttttgtttgggtttttcatctcctgccatgtctccagcaggtttcttgttacatccaaatgacatggagattaggtttcacgaatgtcattggcccatgtttcaaccagcccctccccctggacccagagttcctccaagatcaacccccaggcactggagatggctttggggagcagccttcgccagcctggaggaaggcaaatccttgtgcttctcacgctcccgtgcctcttcaccatctccggcccaggcagctgtgtgtccttcagttatatgctcaagggttatttttttccctttccttttcccccaaacccggaaacaatattttgggagtaaagggagggtgcgggaggaagagtcacaggggacagaagcaagcatgcagctgccaaagccacactgctctgcagacggaaccctctagactcattcagcacaatgtggctgtggaggaaatcctgccgagccgatgataaggggggaaatggagtcacttcctcaccagctgctttattcaggtagaaaaaagtcctcacttccttgcgtgtgctctgccggccaccactcccagccgccagtgcggcttgctccccctcttgctctgagccaactctggtgtcaggagaatcttgcttggcttcatggagcgctctttctgcaagacaagtgtctgtctaccccacttcctccttcatgtcctttctctttctcctggcgttctctctcacctgacggttgcatgtcatagattctgtgtggccgcagtagtcacagatagtattgccaatgagtctccagccctcttggtggaatctaggatcaggacatacccagtggtctctatgtttgcatagatgtctagaaacagcctttgacctctggtcgtctcccctgccctgcaccacaggcaccaatgctgcccctcttgccaatgccctgctattgtcctttcaccctcttaggcagcacttgtcaaagtttgtcttcctaatactccaaacacagcagcagtctccttgacagaggggttaggggccaaatgagtttggaaaatgctactccctttcttggagaatcaagcacctgtgagtgggggtgataatatttactaaccaatatagcagggacactgaccagtcagatccctctgtgtccttgggaaccggctaaccatcagtccctgggaggaggacactagaggctgctgctgaaagaaaaaaaaagcactgaattttatctaagccagtcctttatttggtctctgaatactccccttttaaaaaaatattatctattaggatgtttgaaaaatctgccatatagtaaaacaaatcagtttgtttcagctccacaaacatttgctgagttcctaacgtatgacagacacatgctccagggatccaaagataaataaaacatggtcctgcacctccaggtgctaatagttgaatggggaaggcagacatgtaaacagatgatcttcgtataatactgtgaacagggaacagccgaggattatttagctcaacctagggatttggagaaagttgcttgcagaaaatgattgagctgaatctctgaatgaaccaaagttgacttaagagtgacaagctgagcaggagaactaggttggagccagagcattgggaaccttagacttaagcatggaagcaacagatttgattctgaatggatcactctggctgcagtacacagaagagatttacaggcaaagcacaagactcagacagaggcagagagatcagactggaaatcacagcagtgatcctggggagagaaggtaaagggagagagaagtgttcaggtggtaaaattggcagtgcatctactgccctgttctgtcctgtcccctggcctttaccacttcagtgctcactaacttcacctccagctataagagatgtggcatctgtatctatttccttgattggtacttcacctgtgacatggccagctaggagtgctggggtattgacattccataggagcaaccttcaaccaatgaatagcaggagttggtgtataaataccccagctccctagtccctcagtgggttaacaagagatgcatggtctacaccggccctcagatttccctggcaggagtaagctctgtttgccggtagcaataacttgcttgatgaggtaactcatgcatgagtcttttcctttttttctctcccttccctgctccccttagagttcctagcatcatctcccaaataaaccacttgcactcaaatctttgtcttagggtctgtttctaagggagtctaacctatggccatgggatttactgttgaatgaatatggggcatgaggaagagaaaaacatctaggagactctgaggctgtaggtttacttgatgccatagccaggttgaagacaggaagagagggaggcttgatggagggagtgatgatagcttgagtttggggcaggttgatcgaactccctaggggatgtcttagaaagcaattggaataagtatttgccagttaggggagaaagtgagactggatataaagatgttaggaacattatcataggggtggtatataagaccaagagagtgaaagagattggtcaaagagagaaaagaaaatgtccagacagaagcctgatgggcagcatcgagaacttatcagaataggccagggaggaggtgcccctgagggagacagagaggaaattcttcaggaggaaggaggtagcccaaagggagcagagtcacggaagaccctcagtggtcttggtgtccggggcatcagagcacctactaagatacaacctcacacccagtgaatttagccacatgggagggtattggtggtctctgtgggggtggtttcagaggcacagtataggaagaagccagactgaatgggttcaaatgtgggtgggaagtgagccaatgagtgtggcttggcagcttttctaggagggcagagacagagaagataatggttagggtggagcacgcatcagcacagacattttgaggatacctgaggccagaaaggaaggatgcgattgaaattgtaattgagagcagggacaattgacggaggaaggttcctgaagcaatgggagatggtggaatcagggtgaagtgtggagaggagcagggaaggacaggcagaaatggacatttgtgcatgggccagggtggaaagctgtggtaattcttgcccaatgatcccagttttctcagagaagtaaaaggcagtgttcactgccaaaaggtgaggaagatgtgtgagacaagtggtggctgttgggaacagtcatcaaaaggaacagaaaagatctgacaaagaataaagaattgctaggtggtgtcagaactcactgagtttagagaccatgaatttccagcagcacctgcctgcaaggttgggtaactttcttcagcaccacttggaagcccagatgagacttgttttgggctggagtccaagttggggcagagaggaaggtcgggatgggaggaagcaagttgagggaggcagggaggaggttccctgggtagagagaagaaccagctgcttgccagcattctaaccagtgacatgcaggaggcaggtgaaacccagccttcacgctcctgtccaccacgaatttccttatgaatacacactgtaaggaatttgctttacctgtcaaagtttcactcacctcacctatttaaaaaaagagctaatatctttattagacattattaaaccaattcagggaatctgaacatactttgaggttccttccagcccagagttttctgttacagtgattctccctttccttttttcttcctaaccctaaagttgtcatgagagaagagatccccagaggtccccatggagacaaaattataaactcatgaaaaatagaaaatatcaaagtcattcgatagctgtgtttgatttcccattggcatggtctgattttctttttactttcttcttactgccgatgagactctgcagtctgcaggaacaaaatggcggcacccattgatttagtttagttcaaatgtgcacatagaggcattacctctctctagagtgtaagctctttggggacagggtggcttttctcccttagaattcccttcgattgtataacgtctgcatgcatagtcagctcaaagactgtggaatgtagctgaatttcgaatttgcttatagccagccaagccatattaaatttccccagtatatagagagctgagaacacacactgagctcggggcctgaacctcttattgcaggcattggtctgaggggcagagctcatgagagttcttctgggccagggtctaaggaggccctcacttaaccgggggcctgttgcatggttctaggtcatggctgctgcctgggagcccatgtctccccactactagacatcatctcccagcatttttgtctgtcaaattatggagtctggatttttttcagattaagtaagcacttagaatgtaacattattctatgtagtatatattgaaatatatttcataaatagtaatatacatgtttgtattgaattagaaaagacagctaaggaaaaaaatcagaatagcctcttaaatgccatgtcctcatgcctacttctgccttcaacgataatcactgttaacatctttgcgttttcctttatattatttttttctgtttgtaaacgcgcacatgtatatgttaggtttttacagaagtggaatcgtgttttgctgaccgttttgtcctgctttactcaatatgaccttaggaacacaatttcttgccaataactatagggtatgacttttaatgctgaacagcactccatcatgtggacgcgctgtcagtcatctattttcagacatttgtttccaggtttatgctattatacataatctgtgcactttattatttttccaaaataaataactggaagtgaaattactaacaaaagctttttaaaagccttttgatatgcattaccaaattcaaaaggtctccatgtttacctttacctgggcataagggttattttgggacccccgcccatatccccaaccgcatgccattcttttcagcacttagaattaaccttctcttccattcttgacaatctgacctttttaaaaaaaaattctcattttaggtttacgtgaaatttctcgaagtggaccaggggtggtggctcatgcctgtaatcccagcactttgggaggccaaggtgggaggatcacttgaggccaggagtttgaatccagcctggccaacatgaaaccctttctctactaaaaatacaaaaattagccgggcgtagtagagggtacctgtagtcccagttacacgggaggctgaggcagaagaattgcttgaacctgggagccactgcactccagcctgagtgacagtggctccatctcaaaaaaaaaaaaaaaaaaaaaaattcttgaaggttctgaacggaaaaggaaaatgttggaggatggctgcctcccaggtgggagtgctccatggcccggaggggtgaggacacctttgctgagtttaggagtcttgaccctggtctgttcccgtccacacctacctggcctggttccaaacctgcagcaaggctgcggctgggagtttagccatcctgtccccttgggccagccctgggtggaactcagatcctctgtggcctctgaattggaaatttatggggaagccactgtggacagagccaccagagctgaggccctgcccatctcctcctcataggaggagccggtgccagcctttccgtgtgaacctgtgatccgtgaagtcgggtaagcccttgccagtcctgacatgagcaagggacacagagcttcctaaatatatagactgggattttgtccgaatcacatgacgacccaggttttctttttccctctttgttgcttttaatacataaaatgagcatgtgtttatttaaaacagctttcaaactcaaacaaataatgacagactgttcaaacagacttcggaaatcgccccaatcaggatgtttgaaaaatcaggaagactttctacgaaagaagctttcaggtcattttagtcccgaagccgcagggtctcctttgcactttggaattgtagaagggcaaagtttagaggccagctccaacctccagggggttaaatgacttgccctctagccctacactctaataatgtgtaaagaaggacagataggtaggcattgtattatcacttcccatctttgaccagaacacgggatgtatacattttaattcataattcctatagaaattacggactatcctcagatcagaaagctaagagaggaaattgcttctgcaaaacggcaggctcagcagaacttcttgggggaagggcaggttgagtaggtgcggagcaggtctgcaagaggacagacaagagcaaggtgtttgttctgccacgagctcactttctgtatccaatttacaaatggctttgagtgacctacgttaatcttcacaataatgaattttatggctatggatgaagtaaatgaggctcggggctgggttatctgctgaaggttataaactaataaaatatcaaagccagggttcacccacactcctcctccaagtcccatgcccttctcagccccctgggatggcaacagcatctctatgctgaggctttgggccaagagctgctagtttagctcatctcactctagaaatgacattgttctacgtaatgcatatcagaaatggcctgttaggttcatgagaagcactgttatttgtgtgggggtgagggtggtgagagggaattattccagctctgaggaggtggggatatttgggacagcatttcttctgctctccagcactgtgtgccaggccaactgggagaaaatgccagctggagtatgtccctgcatcctccggtttcccaggatggcttcaggtccagacaggacaaatgatcaggggcttagtctggttcagattttgccacacaaaactctgttgattactaaagggattcagagcccggccactgaccttctcaatgtcaagccaaattgcagacaacctattgccagtgccctgacaaatttggggtgtcttttggctgggctattgggggtttcagcctacccatccctcagagagagaagcatggatgggaggactagttgacatttgcagccgtgtctgtgatgtcttgggttgctccctggaagaggcagagttctggcttgtggagaagtcctgactccttcctgccccactgatccctgcttatatggagaggggtgtgcatcttggcagacaatcatgattgtgccttagctctgtgctaagagcactaaacacacattttatgtacgtctattgcctcgcttttctaacactgaaatttagaaatgtttaacaatagatatttaaaaagaagaagaaagcccttgcgccctctcctggtaaaagttaaccaaggacctccaaagatgcagaaggcccactgggttagcagtcgctggtctgggctagctgattgtgctgatttgaccaatgctgttgacacacaggatgggtcatctgttcttctatggtctgtgattacagagcatcttataaaccagagtttctcagcctcggccctgttagcattggggggctgccctgtgcattgtgggatgttgaacagcatccgcggcctctgcccactagataccagtagcaccctcaccccaaatcatgaccactaaaaatgcttccaaacattgccaaatgtcccctgggggacaggatcactctcagtgtgaccctcgccctaaattcttgcctgccttttgtaaaaggtggcattggttggagggcaatccatgagaatgtgaggatggctcaaggcaagcccttcatgatttctggaagcaatattgatgactggttaactgaggtcacttctaggagtttgtttcaaaaaagcaactgaacaaatagacaagaatttatatacaaaaatatatcatgatattgtttataatagcaaaagttttaaacactataaacatgaattttttaaagtatggcacattttatatatcatgaaaataattgtataaatctatatttaataatgtggaaagttaccctaacaatgctttaaatcctcatcaagactacctcaggattctcagaggctgttacatatagaaggagtaatttcaaacagattcataagcatttgggtaaagcattaagccaaagaccaatgattgtattcagaaagcttaagtgaacaaacatttactacgcacctatagtgcaccacaaccatgcccagcatgagggagacaaagagaatccctggtcccactgctacagcccttgccccagagaaagggaacccctctgtgcactgttggagcccctcccaacagcgatgtccagggtcatggtatgttactgtttcctgtaataaaactgtgtgctttgagtcagggttgttgggaataatgtgaaactattcttgttttcttcttcatcctgaataaatcagaagtaaaaagaattcatttactgatttatatattcaaatattcattcagaaagttgtccaaatactcattggacccaaatgtgaaacataatctccccaaaatctaggaaatgagcaattggtgatttgctcaatccaagcccatccagagggtagactttgctacaacacactacagacccgacttgagatggagagataggaatggaagggagacactttttgtctctcagggacctgcacatccagtgacacacccctgatctcctgccttgtgagatccacaatttgagtaaatgcagagttgtggtcgtccagtctagccacccccaagagaaaccccctgacagctccctttccccaggagaaccttgaccttagaggctggcactgcaccagtcaaggccgcccttggcccctccactgactgagcccttgactgaccaaatgctctcatagagctgccgttagccacgccagggcatcagcagagagaagggtgctggtttctatctgggttcaaagcctggctctgccacttgttaaaaagtctcttattccctgcgattctcagctttttcatcttcagaacagaaacaaataaaataacttcataagattggtacaaagaattagctggatgagaaagcgcatgcctttaatcccagaactttgggaggctgaggcaggagactcacttgagcccaggagttcaagaccagcctggaaagtatagtaagaccctatctctacaaaaaatttaaaaattagccaagcatggtaatcctaggtactcaggaggcggaggcaggaggatcactcttgagtccaacagttcgaggctgcagtgggtcatgattgcaccactgcactgcagcctgggcaacagagcaagactcttgtctctaaaaaaaaaaaaaagaaagaaaaagtttggtacaaagactaaaataatgcatgtcagacatttgataagatgtcaacactcaatcgaggagtgtgacggtcatcatcattgctagattttattacttttatggatgggcatgctagctaaaattgcaaaacctctaatattttctaactgcctctgctgtttttctcctcggcccttagcactctctcctacaccatgtgataatttatattgattgctgtctatactgttccactcaatggaagcttcgtgaagtaggaacttttagtctattttatgcactgctgtatctctaagatggctggcacgtaaagagggtctcaataaatatgccttgaattaatgaaaacagtggtttctgaatcatggcctccaaagagcatttgccttttcccctctcacccttctgaaggtgcccaggctgccctggcaggatgcctctttctctgtggggtggcattctctgctctctctctaatactctttctttttcttccctcctctcccccaactgcaggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactggttgtgcctggaattgtttataatgtgttaacatgattttgccctgccattcatcatcattacacaagactttgaaaagccttcttaacaagccagtaaaatcaccaggaccctactctaatgaagccctcagggaccaggctaagggattgccttacaggtgaaaccaccttagaaggagactcttgtttcttggtaataaccctcctggttaggtacaagatagaccagtcttgagttctactccctgggagagctactgttgctgttgagtgtgttcttccatatagaccagagatcccagcctctgcattttataagatgaaatgtgtatgaaaaagagggaaataagctgaaagttctgttttgaagtcaacatttttagatggaaccaaagcagctacttgctttggagcaggtgaaccctaaatggcaagggatctgatgtttcccactgggttcaggtcctgataccctaatcctcaacccttcaagtcacatcacttagactcaattaaaaggactctgatagtagcattcatctgttgagcacctgctggatacaacactgtatgcatactaccttttgctctcaaacctttcaaggtaggtattggcctcttgtattttgtaggagataactgagactcaagacgttgaaactatatgcccaagttctcaataatcataaattacagaggcagtatttgagccctggtgtggctgactccaaggtccatactccatcctttgaatcggtagcctccaaattgctgcacttggaaccatggtggcacagccttcccaaggagtacccaggcatgggatgtttagaagaatcaatgttctcaacacccatgggtactccttcataaaccgatttccgtgagcacacccctgagttcagacaactctcctcactctcccctttcacaatcatctgtcacacttctcagaagagggacacactcctccctctgtctgaatctaactgtgatgccctgcggtactgagtgtctcatactggcccggagagctgactgtgtgcctgtcatcccaagcgtgtgtcagtgaggtcaggttagtggcttgaaattggccttggtggccgggtgcggtggctcacgcctgtaatcccagcactttgggaggccgaggccagcggatcatgaggtcaagagtttgagaccagcctggccaacgtggtgaaacgccatctctactaaaaatacaaaaactagcagggtgtggtggcgggcacctgtaatcccagctactcgggaggctgaggcaggagaattgcttgaacccaataggtggaggttgcagtgagctgagatcacaccattgtactccagcctgggtgacagagcaaaacatgaacattaaaaaaaaaaaaaaaaaaagaaagaaaaagaaaaaaaaattggctgtggtggaagcctttataccatgtaaacgaacaaaagctataaagcagggctttcttttctttgcctttttcttttttccccagagagtaaatttacctacacaccactgggcatggccctggagtgttagaattcttgggttactgaaaggcatgatttgaaatcctggagctatattggactgtaatgactggggagcaaatctttttggaaactggttttccaattctttgctttcaacaaagttgaaagagtttctagtgaagacagccgatagattttttaatgtgacttttgaatataccagaaattcaaatagttgaataacgttgctataacaaaactctttccaatctcatgtagttgttacatgaacagccctcctcagagcttatatccgtaaagataaaaaacaagaatagactcactggtgaacactagttccctctagcattatgtagtttttatttatggttatgtgtctttctggggatggaggagagagggaataaactagtcccatctcttttaagagatttatttccaataaaatttaaattttatacttaataattatttgtcaaaactgtaatatatttgtgcatttttatgagttgggtaatagtaattgtatactcaactcaggaacacaaaaaaccttatggccacaaaaatttacagatttgccatagatgatcctgaggtaaatcaattttaagaaattgtaagttgtaaatttagttgtaagaaatattatattaggataaaatgagaggcagaattatgaatttgaggagaagaaaaagaaatgtaaaatgtccaagtgtcaaaaagtaactcctatatttttcatgtagggtattgagtatcatgccagtatggtatttcgattccaatggatatcgtttgaaaatgatgtaacaaatttatttttaaaatgtgaattcttaaaataacttgtcagacaaacttgttattagcctgtgtcagaattctatttcagactggcctcaagagaagaggctcccagcaagccagccaattcagtgattcttttttggaagagacacaaacagaaaaaagaaatggcaccacaacagaagaacagctcgagactggttggcgtggtttagagagctgagtggagaccctgacttctcagcagttcttaatcccattaaagtctatccggaaattacccaagcattttatcaggaatcataattacttcatggaaggggttacaaatgacatcatacaaaaaagttctgccacagacagtttgggaacaattttctttcttatgctattaaagagtgcattggaaattatatccttagcaactattgacatttaaattttaaaaatgaaccgtcatacatgggcaagcgtggtatatgtctttcaaactgctgacaagggggccttctgtcaagttggggtggcacatcggctgattcatcagaagaccccttcccggaaggcccctccaggcactcctctggactttattggaaactgaaaagcagatactacccagcggagtattttatttaaattaatctttctgtcagcaccaaggaaacaagtaattggataaaaataatagttgtaataattactcaatctgggaacaaaaagtaaagccttaaggtcactaaaatgcatttaaatgcataagcttaatcttggctgtagaaaagtatgaaaagctaatcaattttaaatgttaacattaaggaatctcatctgggaaaaaatgggggtgaaaatgtgaatttgaggagagaaagtgccaaatttccaagtgttaaaaaagaacttgtttctgtatgttttatgtagatagttttcaattatcaaaccattgtggtacttagcttccattgtatacatttttaaagtgatataaaacaaatctggttgtgattcctatcaacataggcatgagccactgcgctcagccctctttgtttttgtgctggttcctttgtgaaagttctgctgttgaagtgctccaggactctaccctcaaaaccctctacaatcccacatttactggaagaatgtggagaaggcaatggatttagtcacccttttttggtgtcccaccacacactgccaccaagtggaggacggcatctcaggtccctggcaacctcatactaagaacggaggatttgccagacaggaccatttctgggccaatttggccattcagcaattctttttggaagagatacatacacaaaaaactattcaactgtatgcaaatgtatacaaactgtaaatgtatacaatgggaatctaagtccctcaatgatttaacactcaaacaccatctacatggaaaacacagaaacaagttttcttgtaacagaaatttgacattgtttcttttactccccaaatttacattttttacccctctccccctatttaattttgggtgctattttttaatgtttaaagttgattagcttctctactttgctacatatgtctctctggttactaacaccactctcaagggaccttccttagcaaagcatgggccatctgccctggtgagttcaaacatgactgctgggatttttgcccaaacaactgagtggatagtggtgtcatttattgaattagaaaaggattgagaaagtgaggtgagtgaggatcagatctagtggaggagaatcaagagaaaactcttgtcagttgataactccatcctgtatctctcctgagtgccagactcatgtctaagtctcctcttgaatagatagtaggggtctcaatctcgatacagaacttcaatcagtcatcagcatatggatagtatatagacatggatttgtgtgacatttcctggggaaggagacagtaggtgagggtagggtcctagagcacttccaacagcagaactttcacaaaggaaccagcacaaaaagagggctgggtgtgttggctcatgcctgtaaccccagcactttggggggccaaggagggaggatcaattgagctcaggagtttgagaccagtctgggaaacatagttagaccatatctctacaaaaataaataaataaataaaaattttaaaagagaaggatgtctaaggaagtaggaagccttctattatgattattgtgtcatcatcttacttgaatctcacaggaatttcatgaagtagatgttattatccccattgtccagatgtagaaaatgaggctaagagaggtacattagttaaggtaggctaaattaggctgcaataacaaataaacctccaaatataagtacctcgacaaagagatgtacgctcatgccataatctaatgtaggttgggaaactcttcctgagaacctcttatccaggaagtgactgaggaacccaacctctttctattttgtgatgccatcatcttcaacaggaggttcacaaacacctgaagctgtcaaaacagcaaatgcaaagacagtaaaatatgtctcaatgggttttgctccttcacgctgaatgtcccagccatttacaagccttcattatcctagttgcccccatttgaatgcacttaatttttcgacatccctttagaagatgacaccaaatgaatatcattccctggtcagcaactgtcctgtcccaagtgctttggggctactcccttcctagcctggaagccacatcttagtgacagggatcagagccacattcatgttttacccagtgttctgtattgttgtctgttacattgagattgacattaaccccagctcttttttttttttcatgaaccactaggatgcctgtgaaaatttacacaattgatttcttttagcacaaactcaagtcttgacacctctgtaaaatttcattttcttggtctctgccctccatgccaagccatgtgaacattctgagtctcaattcttacctgtgtctcattatctagccctccaaatttgtgtcgtctacagatctgataagacagtcttctacacctttgtctaagtctttgataaaattacaaaacaggtcaaggccaaaaatagagccctgtgctgttctccaaatagctctccatcaaacacagactataatttcttctttttatctttttgcacttcataatttgctgaataaaggcaaaagaaagagccaagtcttcttctttctctatatcatctgtaaatatctgtgcctgtttgtattctttttgttgcaaacatatgcaaaaattcctttttgttattttgcattaaaaaatggtagctcattgcccaccttaccatacttgtcattagttttttctgtctgtctgtctgtatcctgaatcacagctatctcagcccacatccacaatgaaagccatagccccaaagcaatcaggccctgttcttttctctcactgcctatagcaggtgacttgactttaattacagactcctttcagagtctcctacagctcctccatggaccccacaacaagaatctcagagggtgactgtcaaaaactctgaaaggcctgagtttttccctacttgcaagttatcaagtcggtcggccacaattttatggatgctggttgaaaacgtaacactcctggggtcagattactcagtaattgcagttgccagagttatcagcatatttaagtggggtccccaagccccaattctctcaggaaaatgtggatatgacagacacaatgagtcataatataggagaagtctgaatttagggagcttgaatcttctgtattaggcagtaagcatgtctgccttttgttctggaaagagatattatctctgtgttccaaggctgttcgctatatacgtgtttttgaaaagagtccagaacagagcaatcagcaccttacttacaacatagacagaaacatgagagatccatggagaattatccatcagcagtgacacaggacaagtctactcttgttgcatgtgaggtgatcaaatgcaatgacagcaaaatatatccttataggcattgctctatgaagccaaatgttctagccacaatctcagccctacaccatcctagttcctccatttggacatatttcacatagcaacatctctttaaaactccaaatatgatcatgtttccctaggcgagaactgactctatgctgctgatcatcaaagtcaaccttaagtcctcttttttcagccacctgctgtccacggacactggatcttgactatcatattatctaaggccattcatgggccaaatcaaatttacaacctactcccaagactaggtccttcctcagcttccccttcctcttgctggtatcatcatttcctcaggtttccaggttcaacaccgtaggcacctcagctcacacagtgctcattttgtgggttgatgaatggatccagccatttgacaaatatgtgttgagcttcatgcagagggtggtgaggtgggctccaggctttataaattattaagacccaggctgggttcccacaggtaaaccataaacatttctctctctctctctctctctctctgcagccaagccttggatctttctgtttggaacaccagcttggatgctaaggagcaatggatttttctccgtattctttgtttttccacagttttgagcttactccatctcagagccctgcaggcaggttggggtagaagccacaaagattattatgagtaaaactcagcagcaagcagctcaggggagctttgatcctctctcccaaggggaacatcatctcctatatccatgtggaacctctcagctggagaacaaaaagaggaaaaaagaggaataaaatatttatagaaaagttatttctcacaagcaagcatttgttctaagagcttttagaaatgtaattatttttctccttcttgggcttttctgtttttaatatgaaacactttaaagtcccctggttcgatttccaggaagcaataatccattttgccttgggtggagtttaggagagaaactaggtttcagaagtgaatatgcttccactgaaaatgccacatggagctcttgcctcttctttaatgttcttgcataacaagaatcccattcccaggggaaagcagggtggaccagcggtctttctttccaccctctactgcaagtgtctctgtcctatttgagccacagctggactcctggcctcaccctcacctacaaagtgactgtcatatacaaagggtaaacctcgggaacagcactacccaacagaaattaaatgtgagccacaggtgtgagccacatatgtatttttttttttttttttgtcagacggagtctctctctgccacccaggctggagtgcagtggcacgatctcggctcactgcaacctccgcctcctgggatcaagcaattctcctgcctcagcctcccaagtagctaggactaccggtgcatgccaccatgctagggtagtttttgtacatttagtagagacagggtttcaccatgttacccagggtggtcttgaacccctgaactcgcaatctgcctgcctcagcttcccgaagtgctaggattacaggcatgagccactgtacctggccggcgtatgtaatttttaatttgttagtagccacatttaaaaattttttcaataaacccatgaaattaattgttaaatatattttatttaacccaatttatcatgttaacatataatacaaaaattttgagataggcatgtagggaaaactctcaaactgtgtctttcctctaccatcataccacaacaatcatcaacacagaagacttctgtgacctaatgtatgggtatttttccccacacaccaagcagggaacactagctggctgtcctctaattcagttccaacactgtctacctggagaccttgtcagatcccacaggttgagggctcagtccccaagactgcctccgaccacaccagtcagaagtccaggcctttggaactgctgaccaacaagcttcaagttggggtccccagagccccctctttggcttcagtgaatttgctggagcagctcacagaactcagggaagtacttacttatgtttaccggtttatggtaaaagatattgcaaaggatacagatgaagagacacgtgggatgaggaatgggggacagggtgtggagcttctacgccctccctcggtgccaccctccaggaacctcagcatgttcagctgtctggaggctccttgaaccctgtccgctgggtttttatggaagcttcatgatgtcagcattcctttccccagggcacagggtaggaaccactcataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtagagtcctgccctggggcaggtgaaaaggggcagaagtaggtcagagacttaacacacccaacatcataataaaagatggtaacaaaggctatgcgagtcacaagccaggaaccacggaggaaaaccagtacctatcataacaccacaataggctattttttttttttcatactaaggctttgaagtcaatgtggaattgacagtggcagcatatctcagtgtgagtgagccacatttcaagtgctcaagagccacatgtggctggtggccaccatgctggaccatagcaccggaccagaccctgtgtacagatgtttgacatctcatgcacaagtgatgtgtctgcaaaacgacttcctcttcaggcccccgctgctccccacctcaccccatacttgttaattaagttgttaaaacaggaaaacatcttctccaactccctcaattctcctttttcaagcttaatccaaaaaggttcttacttttgaaacagttgttatcagttcaaaggggaaactaaatctgaaatgtgtccagtggaaggattgcaagtcctcttgacaggcagtaaactcttgatatcaggtcagggtttgaattctggcttgctaagtgcacgactttgggcaaaacatgtggcctctttgcatctttgatcatcagttcaatgggttgtgacacttgtcccaccatattctaccagcctcatacggggtagtggagtcagggagatcaaagtgatgaatgtgaaagagttttcatgccacataaaatggaaaataatattatttattatgaaaaaccattaaaacattattttctgtgcagctacagaaaataataaatccacaatagctacgcagacagtgtaaagattcaaagtaacaaactgaaccaaagaagcaaattcctgtaattacacgtcaacaattttctcaactact

SEQ ID NO: 1955 - DNA, 2859 bp, Homo sapiens
cgtggccccgccgcgctgccgccgccgccgctgccagcagaaggtgccggggctccgggccctccctgccggcggccgtcagcgctcggagcgggctgcgcggcgggagctccgggaggcggccgtagccagcgccgccgcgcaggaccaggaggaggagaaagggtgcgcagcccggaggcggggtgcgccggtggggtgcagcggaagagggggtccaggggggagaacttcgtagcagtcatcctttttaggaaaagagggaaaaaataaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccccgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggtaggtgcacttggtgatgtgagtctgggctgaggccacaggtccgagatgcgggggttggagtgcgggtgggctcctggggcaatgggaggctgtggagccggcgaaataaaatcagagttgttgcttcccggcgtccctacctcctcctctggacaaagcgttcactcccaacctgaccgataacgcctgccatctaaaagtctttaacttgcttgctagtcgtggagatccaaagatctagcgtttgtaatccagtaggatgtggtggtaaatggtaccccttcagtgtttctcaagctgaaggtccaggagtccccaggaccaccgtttcctggcttgagcagcttgttggaaccggagggaggtttcagggactgcttatgaaccagataccaggttgggtcttgacagtctgcatcccaaacaagctcccctgaaacaagcccgttgtacactaaaattggagaacaacccgattagaagaatagactccacagaagaccaagggcatcatcaatcggtaaaattttccaaaagaggaaaaccaatgtaagtctttttccctgaaaaacttagttgtgtttgtaaagagctaagttgacattccaaagtccttggactggaatctccagtgtgtgccatgttcccagtgggcgtgatgaggtgtcctgaggagtatcaggctatggctttgctaccttgtcagtgacagaatttgcatcggctgcattctttgtattctataatttgtgtatggtttaccagtttgctagaatgttagaatcttttgtttttcaccactcagagtggacctaattttgtggtcggctgaaaaaaatttgcatctaggtatctatgtaaagtgtagaagaattgattcttagctgtggattatcttacccttactttagttgaagtgattgatacctgtggctttgaagaacatttgtgagatgatctttttctcgtactgtgctagatagagctttcatcattataccatacaattgtacttttctgagattctttgttggagggggtttagttcctaagagtcaaggattgtaatggagatctatatctcatat

SEQ ID NO: 1956 - protein, 205 aa, Homo sapiens
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWVGALGDVSLG

SEQ ID NO: 1957 - DNA, 111206 bp, Mus musculus
  misc_feature (1)...(111206): n = A,T,C or G
aataatgtctaacggtgagaaaacctttcctataggtatttcatttcaagacccttacagatgtgaatagtttactttcaggtaaagtactctatttttgtatagtttcaatttttttttttttaattgagaaaacagaaagtttatctgtaagcaacttctaagattaatcacgacactgatttgcaataagcaggatattcttcaggtttttttttctttttgaggcagtcttaccctgcactacaggctggcctagatctcactatgcattctaggctagtttcttaccttgtctcagtcctcctgcctcagctttctgaatgctggaatatagggtgtgcatcaccacaaaacacacacaatattctaagctttgtggtaaaaatgaagttacggtttctcactgcttaacatattcttatattaaatagaaacctcaacatagccgggcgtggtagcgcacgcctttaatcccagcacttgggagacagagacaggcagatttctgagttcaaggccagcctggtctacaaagtgagttccaggacagccagggctatacagagaaaccctgtctcgaacaaaaaacaaaaaacaaaaaacaaaaaaaaatcaaaacaaaaaaacccaacaaacctcaacataaaaaatactgtgtttctggactttcttgcagtctgtgcttcaatagcatacctcctgtgatgagatcataatagtagcagtggccgtcggctgtcacgccttccacccatccaccctttgaagcttctttcttcttcttcttctttttcttctctttctgttgatttgacgtaggggtgggttggacagtgctgatgactggtgatacagttggctctgaaatgtctagaaaaaaaagataaagaggggcacctgtgtctttttaaatgttctatcagtcagagacctggcaaagcagccaccctgtaatcccagctcctcggaggctgaggcaggacaactatgtgtttgagaccagcctagacaacatttttaaaaagcaaaacaaacgggctggaaagatggctcaaagattaaggccactggatgcttttccagaggtcctgatctcaattcctagcaaccacatggtggctcagaaccatctgtaatgggatacgatgctctcttctggtgtgtctgaagacagtgacaggtactcacataaatgataaagctttaaaaaacaaaacaaaaatgtgacaagattctctttgggaacaaaacacattataatgacgttatctgagatacaatcatgcaagaatatataagggaagtttaataagggttattacttttatcaaacaataagtcaccctagggtctgggaagtgtgtgtggcccagtgccagtatacctaccaagaatgcctaaggctgtaggtttaatctcaacaacaaaacaaaaacaagacaaacaaaacaacccataacttatcctaatcttcatccaaaacaaatccatgtctggtgatgtaactcagcagcacagtgtgtacctaacatgcataggctgtgggttagacctccagtcctggagggaggaggaatccagcagtgaagaactgatgtggaaatcagcaagcacataatttaaacagaatggtccagacacagagccaactgaagactcctggtgcttttttactggaagcagtacttagcttaaaggaaactgagagtgatggtgcatgcctcccagtccttgggatgcacaggtgggaggctcaggagtttaagaccatcttcagtgaccaatgtgaaatcctttctaaaagacagatatcctgcccacaccaacaaggccaatgctgatgacaagaggaatagggtactagaactctggggcgtgtcaacaagttacaaaggcaacattattaagccattttccactggcgtctcacttcttcacaatatacatttcaggtcagacatggtggcacatgcctttagtcccagcacttgggaggcagaggcaggcagagctctgtgagttcaaggccagcctagtctacatagtgagatccaggacagccaggggccatcaaaatgaaatcaatctatctatctttccttccttcatttctctatgaatgaaattaatgttttcaacaaacacttctccaattctccagaaacctacctatctaattttgcctcccaaaatacttctatcttcagttgagtgtaagtccatgcttgtaatcccagaacttgggaatgtgtctaacatcacaccgtgagtttgcagggtatctgaactaactagagagactctcattcattattaaataaatggctttttgaaacatgccccttcttttccttaaatactaatttagaatacattaagctaacaatttttcttatttaacgaaagcaatattctgcttaaacccataattaagagttctttttattagagactaaagagcatcatttcatgctgacaaagctggctcagactgagcaggaaggcctcccccattggcctctgctgtaccaccaggtactgatcacatagccaatagttccactgctgcagtcctccttggctgcagaagacaactttttatagcgccatggttattaatggagtcgtgactggttagatgactgagaataagtgactgctgctgtgtgacaacccaatactcattaagggatcttctatatcttgcctcgtccaaagctcaggaaacctctatcaggaagaagagctggaaagaatgcaagagccaggagatagagatgttgtattgtgactttctctctctgggtataacatggctaccctaccactttcttggagtagagaatagcccaagctagtcgtgacaatgaaataaacaacatgatacagtaatgatcaagaatatgctgacgggggggggggggggggctggtgagatggctcagtggttaagagcaccgactgctcttccaaaggtccctagttcaaatcccagcaaccacatggtggctcacaaccatccgtaacaaaatctgatgccctcttctggagtgtctgaagacagctacagtgtacttacatataataaataaatgaatctttaaaaaaaaaaaaaaaaaagaatatgctgatggtcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtccctctaagtttttatctaccttctggctttggcctgctctctctgcttctggtccataatgtgtacattagtgtccatttggagcacgcagcactgtgcagtagtggtgggttgagacctctgagcctgagacccacggctggcagtctgtcctgtaggctgttttgttgggcattttgtcatgagaaaagtaaccaacacaatctgtcacggaagaaagctcataagaactccctgctctagagcctaaactcaacaacacagagatgttcaaaaacacgcttacctaaactctcaataaactgcctgcttgatgtaaagtcaattatttgtctacaaaagcacctgctccattatagctaattatataagtagatacaactcagttttggccattttgaaaatataattaaagtactagtttgtttacttttttgttttttattgaatagtgcctataacttaatgagttgtaacaaagaaaccacaaggtgttagacatgaatcattcagttaggatggggcttggactagtaactgtcaaggcgatgtggttgatctgaataaaaaagtatcaaaaaaaaaaaacccaaaaaaaccctgaagcattaaaagcaagatggctcagtgcacaaaggcgcctgccactgagcttcatgactgagcttgatccatggatctcacatggtgggaagagaggactgactcttctatgctgtcctctgaactccacatactcatcaacacaaaaacacagagaaagaaagaaatgagtgagtgaatgtaaaaagtaaaacaagccagcatggtgactcatgcttttaatttttaaattcagttactcagaaggcctaggtagaagtctcaccagttcaaaccaccccaggatatatcaggttttacctcaccaccaccaccaccaccaccaccaccaccaccaccaccaccacagcaccacagcaccaccaccaccaccaccaccaccaccaccacagcaccaccaccaccaccaccacagcaccacagcaccaccaccaccaccaccaccacagcaccaccaccaccaccaccaccacaggaccacagcaccacagcaccacagcaccacagcaccannnnnnnnnnnnnnnnnnnncagcaccacagcaccacaggcaccaccaccaccaccaccaccaccacgcaccaccactcaccaccactcacagcaccaccaccaccaccaccaccaccaccaccaccacagcaccaccaccaccaccaccacagcaccaccaccaccaccaccaccaccaccacagcaccaaagtacttcaaagcccacattcttttcttttttttctttcttttatttttcgagacagggtttctctgtgtagccctggctgtcctcgaactcagaaatccgcctgtctctgcctcccgagtgctgggattaaaggcgtgcgccaccacgcccggcctaaaagcccacattcttaataagactatgatacatcgtaagagcactggactattccaagtgcagagctcccacgtggaaacgtaaaagggcactgagcacgggctgtacagtgcgcccgctgatgtacctgagggtaggggtaagccgagccttttcagatcctcttggtacgccttcagggcggctgcctccatggcagcaaactccttggatgccttttcttcttcctttgccttatccaagcttttctgtttaatctgggtaagacacgggtgaaggcaggagtgagcacagagagcaccactgcccactgcccactgcccactgcccactgcgcaggaagagaacaaagagcaatggggttacctcactgatcctcctggccacattttccttgtgattctttcctctttcatgaaactcaacactctggaaaacaagaaagggaaacaatcattaaattgtaagcacagggatgaaatataaaatcataatggcagggggctggtgagatggctcagtggttaagagcgccgactgctcttctgaaggtcccgagttcaaatcccagcaaccacatggtggcacacaaccatccctaatgaaatctgatgcccttttctggagtatctgaggacagctacagtgtacttacatatagtaaataaataaatctttaaaaaaaaaaaaatcataatggcaaaaaatagaaaataactagtttaatataaactgatcttggatcaaatgatgctggtggtctaagcagactattgcactctcccaccaggtgttctctggttcttaaaacaagcaaggatgaccacatcagcgggaagacatacacagtactctcctgactaacccagggaatacaggttagtgtaaaaaggacttgagacacgatgccttttaaaaagaaagacgtcacagctgggcagtggcatatacctgtaaccccaaaaaccccagcactgtgaacactggtcaagttccaggccacctgaagctatttgcttaagtgtctcaaaacaaaaagagaataacaaaagtgccctatctccccaaactaaaacaaccaccaccaaacaaataaaagccacagcaacaccaccacccacattaaatgtcaaaactggttaagcctctagaatttcattgctctgtttttctaagagaaataaaaattatccttaaagcttggcattagttgggcagtggtggagcgctgttttaatcttttaagcactcaggaagcagaggcaggcagatctctgagttagaggccaccttagtctacagaggtagttccaggatagccagggctacacagagaaaccctgtctcaaaaagccaaagcaggtaaaagactttgtttttaaaatattaagaaaaatagatacttaaaaattccttgtttgggcaggtaagatggcttagtgggtaaaggtgcttaccaccaaacctgaccaccagattcaacccccaggacccacatgatagaagaacagactcctgaagttgtcctctgctattcgcataccagagaacatccacaacaacaacaacaacagcaacaacacacagacacacactttaaaaaattcctcacattgtgcaaaatgatgtagtaaaacaaagtgactgtttgtagcaacaatcttgtagtttatctactggagactgggtaagtgaactgcgtgcactcccacaggcttttattgaacagaaaggcagcacacagttccctatgtactgacatgggagacaccttcaggatacactgttcagttaaaaaaacctctgtaccctgtgaacaagatggaataaaatacatacacacagaaacaatgaaaggatggacctgagcaaagggggaggtgacttctgaagagtaacataattagatggctggggacagggatggctgactgagcactggggcctacataaatatccagaagttctcacaaattatagatgtctggtggaaagaaataagaagtaccctaaaagtcctgtcaatcaaaccctgtatgatgtattaatggagctattctaatatactcctcagagtacctctttaaagctagagtttgtaaggcaaacagttgtctctattgttcctataccgagttacttacagctgattataccacacaaagaatactgtattaaagcaccattcaaaattaaatagttttcactaataaattactagatatgtagggagatgcacacagacctctagaaagataatttattttcataactcattaaagttattttattgcataggtacctcctgggatatttttttcaatttatgtggttttaaaatctcatggcagttttggtagggattagcctaagccaaataaaatatgcacaatctttagcacctactagcaaagccaaagggaagagcaaaactcctctcaaagcctaagatgatttagtagtgtgtaatggcagactgtagcacaaaatatggcatcattccgtggtgtacaatagttctgccaagtaatacgttatgtatatgcaagacactatagggtttgctttttcaagacaggatctctctgcgtagatctggctgtccttgaactcactctgtagaacaagcggcccttgagctcggagatctgcttaatagcctctggatactgggattaaagatgggaaccacctctgcccttgctgaccctgtagtttttcaaaacgtattttctgggtctacgcccctgtgagtgtgtaaggacatgagcatagccgctaatggaggtcagaagaggctgtcggacaccctgaaactggagttacaggtagtgtcgaactgccatgtgggtactgggaactgaacctcaaccctctgcaagagcaggagttgttactgactgtgaagccatctctccagtccccatagcccacagcttttgatacagtagcttgtctgattgtagaatgtctaagagggaagaaagccagctgacgtcttactttatgctttaaaagttggatctaagtggtggtgcacacctttaatcccagcactccgcgaggtcagcctggtctacaatagcctgagtttcaggacagccagggctatacagagaaaccctgtcttgaaaaacaaaaaaacaaacaaacaaacaaaaagttggatctaggagtctagccatggtacacaccttttttgccagcacttgggaagcaaagccaagtagatctctgtgggctgcgggctagcctggtctacagagtgagttgctgtctggaaaccctgtcttgaaaaatcaccgcccccaacccccttgcaaaaatagtgggctcaaggctttcagcataaggtatattacagctgctccctttgtatctcaccagggaataatgctgttctccttcctgtggagaacaggaaaaactacaatattcctttttaaggggcaggtattccataaacaagattatcccactcactgtccatttcctcaaagtccccagaaataatttggccttaaaatcaaagtcagattgatgaaaaggagaaggctatagctttcataagaggaatcaaacaaaagaaacctttttaggttttgaagaataaagagcactatacacgaaagtggcttatacacactaaagtcaaaaaaacaacacatcacgtgaatattttaataaaaatttcatacaggcctattgtctgctatccagcacttgcagtaatcacagaatttctttggttgtgacttccagtagtcggccctgaaaagataaaaacaactctaagcttatccaaaaattgaaaggaatttttacagttgttaaaaaatgggatataaggctgttttcggacttctgtcttagcaaagcagttgtattatttatgtaaagctaaagtccgtggaaaactgctctccggtgaaggtaaatcacactgcaccgagatgaagaagtctcaaagtatttctctttcccgtgcccttctagctaattcattcgttctggggacgcgaggctgggaaaagcccctggacgtctgaggccgcagcgccaccccggccccgggcccgggccccggcgggcgggcgggggcggcacccgagtccccggctcctgcctagagggcggccgcgtctccgagagaaccggccccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcagctccgcgggcagcccgcgatcccgctcactgatgtccgccggtggctcaagccaggcacctctcggtctcggcgtcccccccgggtacggcgtttccacgggtggactacggcggccgcgacggcccaacccgcgcgcgcggttgtcaccgcctcttcccctcccccacggggcggtactcgcggcgcctgagaggtggggtcggtataaaggggttgaggtcacccagaagggacgaaagcgcgacgggaccggagccgcgggccccgagcgtccgacccaggctccatcccgcggtcctcacgcctcccgggatccagaacctccactcccgagctggctcgcagccgagaggctcgatcgcctccccccagccccggccgcacgccgccgttcccacagccggcgccgccctcggctttgccggcttgcccgcccgctctgtgaccggggagcagcccgggacctgacggctgagaaagaaaggcgcagccgcccgttccgggagcgcacggggcgcccggcttcggctcagaactttccaggggcgcgcaccggccccgctcctcccccccgccacgcccgcgcgctccgccgggctcgtgcccgcgcgtggggcagcggccgcgggggcggcttcggcggcgcgagttgcagcagagtggctgagtggtagcggcgctgacgctagtcaggtgggtcacagcagtgcttgtagcagcacttcccatatggtctagcggttaggattcctggttttcacccaggcggcccgggttcgactcccggtatgggaacagtgtcactttttgctctagttgagtttacttgcttagtggctctggctgacttctgcagccgtgttcggggtgagtttgggagcaggcagtgtagttgctcccgtggatgggagcttggctctcggaggccggaggagcgcggcggccgctctcgggcccgctgcgagaggagtttcgctttccccgcggctgtaccccgccctcagcccgtacttttccaggcgctcgggaggtgatgattaacttgggcctcgccttatctccccccgcccgggtgccccctcggcccacaccctgctccgccgcccccttcctactcggcgggccggggcgtgcccgctgcgctccagttactgtcaacagcggctggagaccaccccgctgctccctatcgccagacccccgccgatcccttgtcgccggctgggctctaggacccccgccgcgtgcacccgagcccggtccaccgctccccccccccccccagcaaccctcgcctcaaggcttttgcagaatgtctcttattttccttctaactcccctttcctcttcaaacacacggcaaactgcggagaagaaaaataccactgggatgagatgtcttgaaagaacagagccggctttcccggaggctgtttggagcgtcactgatttaaaaaaaaaaaaaaatcatgggatggaggtggagcttggaagacagaaaattagcccggagactggggaggggatgttacaacaaagttgcactgtacttttaaatatagaagccctgtgtttattacaaagaagcggcccagctgtgtcagcagcctgagcgccgtacacgaaacaaaagcgttatcataaatgcaagttgaaattagaaaattggggcagctgtaatgtttagtctgttgggcctttgggcacaaataaggaaaaactgactccggcggatgagtttctggtcaaaaccattactgagcagaagttttggttgtttgtgtgttcccaacaatattttatagccttaactggcacagctgagtttgaaaatagctgttaatgtgatctatgcgattagggattaatgagcctttcctcgtaaaaattaaacctagaaaactcctttagcgaatatttaaaacattaacacaagtccttatgcatgtcaggttccccaccccccacctccagatgttttgaggtgcctgctgaacagcaggcgctttaggtaggtgggtagtggctggatagaatccctttggcctccagtccttagctatgggatcgtgcgaaggtctttgacctgagtgtagtggtgtcttctagctttagagccgtaagcgtgtcaccatcattatattactacgatagtttctccgtgtggctcgagatagcctagaactcactaggagccggagctgctgaggtttatggtcctcctgcttctgcctctcagcagtgggcctgagggtaaggtgagtctgttcagacctcatctcagtctcacgtaccccagggtagcctcaaagtctctgcggtgatgaagatctcctttgctcttgcacctcctgcctcttcagtgctcaggtcacaggcttatggcaccagactcgatttttttttttaagttaattacaattccttatgtttatgaatgtttgccttcctgtgtgccacctgtgtgcctggtgcccagggaggtcagaacaggccagatcctggaaattggagcaatgggtggttgtgggcctccctatttgggtgctggggaatcaagccttcatttccgcaggagcaacaaatgcttcgaacctctcgagcagccgcctaggttctccagagcagcacattctccacagagtgtagataggttagaaccaggcactttgttctagatttggaagaaaggactcctatccctgctttgtttaatttttgcaagtatttgaccggtgctgaataaagcctgtgttatcatagatggaagagtaagtgatcgccggtgggcatactgcatgtttggggtgagtttaggacagtggtacggtgagagcattcctccccaagatgtcctctgtctagctctgggccaggtggggaacaggcaggcagggtccgagttacacacaattgttcctagaggtggggtggagatttggctcagggaagggcaagaatagagagtgtttgccctgcaccttgaagaactggttggatttctcccagtggggaatgtaaatcataaaacctgaggtggatgagactgggacccggagactagcaggaagtaggggtcggtaggcatgcggtgcctggggggagctggtggcagagcaagaagagaggcaggaatttcaaactttgcaagtttgaggaggttacacattcttttaatcaagggtcgaccttttatatcaggagagttctgcaaacatttttgactctttgttctgtgttgttcttgttattgtgagactgattcttactatcatagcccaggttagcagatgtgttctgccacacccagcttcgtctctgaaaagcttgagtgtggccgtggtgtgtgaaacaagaaatcttacttcaaaagactcagacagtagaggaaaacgcagactgttgcgtgcctgtagcttttatgtttaggtgttgaatattttcaaatcaatagaatggaaaagcgattaattagactttataaggatgaagactgggtttttgttgttgttgtttttggagacagggtttctctgtaaagccacggctgtcctggaactcactttgtagaccactttgtagaccagcctggcctcgaactcagaaacccgcctgcctctgcctcccaagtgctgggattaaaggcatgggccatcatgcccagtgaagtctgggtttaaattatgggagtgaattgcaggtgtcctttgcaagaccttaataattcctgaatagctgggaaataatatttgataaatatctgaagattcttttgttgggttgctggtgtctaaggtgctctgtctagaccacaaatagctagctgtaccaactgagtgctaattcacccaggccatgtggtgatagttgctactgtcaggtgcagccaggagaggtgtgaaagctccatggaaagggaggagtaggagacaaggtgagttaggccaaatccagagccgttccgctgccccaaggcctctgcttccccatttcaactgcctgtctggccatcactgcccctcagccaccgttggccttgtggctgactcttgagtgtgcctcggggttttattaacacttgttcttctgcctccacctcccctcatctcaggcctgcctgcctttctcagaaaggcctttctggacacattagccagtctctctctttttagttactttctggttaatttaccttgcttgttcattcatgttttctttccttgcttgcttttggctgcaattaacctgttcacctttttttatattaaaaagaatattctctcttgtccctctcataacccctccatccctctgttgagaagctaacttgtaggactcagttttctctctctaccactcggacccctgggatacgactccggttgtcagccttggcaccggtacttttgcctactgagccatttcactggcccttctccaaattttgaaaaagattcctttatgtgtatgagcatcttgtcacagggatgcgtgggtaccaagagggtgctgggtgtcacagaggtagaggaggttgttcaattccttaggactggagtcaccactgggagctaagaactgaacctgggtccctttaagaacagcaaatgctcttagccactgaagcatccctacatgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcttttctttcatcagggtagtgtgaggataagtacatgtgtcgtgaggtcagtcctgctcaggttataccacagagaagttggacctgcactgcactcgctgttggtgcaaatgtgtcatggcacagtcaattggaaacgtttggcagttccttaaaatcgtaaacagaatcaccacatgttcctcagaagggaaaacctctgcctccgttacaacttgatgtaaatgtttacagcgctttccctcctaacaagctggaaaaggcccaaggatgggccagagtctactgtgtgtctgtgtagtgggacactagctggaggtgaggcaggcatggagatccaggccacagaatcaactcttgagtttcaagcatcttatgcttagtgggagaaagcaggtgataaagactatgttgttcagccctgtgtggtgtggtgacacgcgcctgtaatcctagcacttgggagttagacgcaggagggtctctgagttctaggccagttggtctgcatagagaggagtactataggacagtcaaattctgtctcaaaaacagcagtttttgttttttattccatttatgtaaaatgcccacaacaggcaattttataaagaaagcttgctttgaagtagagaagagatggcgggtacctgctaatgtagctatgtttaggtgcctgagagactataaaataagattttagttgatttacaactctgtaaatatacagaaaagcatggcatggcatactttatttcttaagttgtgttacatgcttgcaaaaactatgaaaaaggattgaagtcaagcctatggaatgttttatctctgaatatgcttgccatttagattttacctatcttagaataacggggggatgtttgaggagtaaaggtatgaatcctagattgttctaacagtgcagctcatcctcaccaagtccacaggtacagtgtacagtgtacagagaaaggcccactctaaacccaagcacttaaagctctctgttttcacatctgggtctgtgtgagcgatggcacaggccccttgtgggaagcagactttgagaagggcactggagatacagccgggctctcgtgattcagagccggtgcgagacaaggctttcagaggaagcaggcaggcaggagcaggagcactttaacagctgtagcacattctgcctgaagcgtgggagagtaggataggagtgggaaacaaggttgcaagagtagattagggtcagtggggaacaatgtcggagctctggcaagttctgctgcttcttttccctggcctctagggtttttctagtagcctatctttgtacctgtgggttttgcaccggccctgacctatcagcagtgtgactctgggctggggactttgactttttcctttctgtcaccagacgcggagcagggcatctgcgggtggtcaggaagcatctgaggccaggttacaaagtctgttgagaagagttcatgctgggaggcggcttgattcttggcaacttggagaagttctggaatttggagctaaaggagtttgcctagctaggaaagtggatttctggtaacgtgagctaatgaggtgaatttgatagcactgcgcaggtcagctggagagcgagcctgaggatcccttccacaccttgccttgccggtttctactgtcactttccctggaccaaagtcggtgcctgccttgaggagccagcttccctgcttgcttctgggctctcccatggtggctgcagcttaacagaaggatcgggttcacaggcttgcccgaaggaaatctttgagacgtcagaaagtaaacaccctcaggacagtggggaaatgaagcgtgggttcgggttttggacagacaggcaggtttcactcatactgtggatcacgtcgtttttgcacatcctaaggtgggtttgctttttgcacacttcacatttgctccaggagccaagactctgacactgccaccctgtggacacgtgattcagcacttcaggaattaaagggaaacctccttcgtttgaaattaaccgtgttagaactggctgtggctcttctaccttggtgtgtgtggtcaagcttattagataacaagcttaaagcttatcatctgaggcttctacataaagagaatgaaaatacagtagctttaaaaaagctctgaaggccaggcgcgctgccacacacacgcctttaaccttagcattcagaaggcagggccaggtggatttctgagtgaggccaatctgctgtgcacagccagccaaagaaaggcacactgagagaccctgacttgaaataacaaaggcaaaaccctagaaatccaagcatactgttcagatagtaaatttctttgccccaaaaaacttagtgagtttttttttttattttttattttttaattaatgttattgggtatacctgttgtttttgtattcgagacagacaggttctgtctagcccaggccagccgggagctgctctgtagccctggacgtccttgggtttgaagttgttcttctgcctagtctcctgataggagactttaggaaagagctccatgttgctcacactttgtttctttaaaagtcactgtggtatgtgaggcctatctaaaatagtgttgttttttttttaaacgtgtactgatttccttttcttgttttgagatagggtctcactatgtagttcagatactgagttttttcaagtactattttataatagatgtggaattgccctccaggccccctcccccctaaatgaatgtggcttcttatattttattgtatgggtaaaaattcttccatgttggatgcccttaatggtacttacataaagaagtgaatattatatgctatttatttaaaataacagtctgctttaaaattgacttaaaatgaatggggactgggaaggactcacttgccttctgtggctcgggaaatggcccaggcccggagtgtacaaaataactttcccagcagatgagttgtttacagcccacgatgtcgtaaatggctaaatggcgtatgcgcttgaattcccagaggtgtcggcctgggtggggtggaggcacttagtgttgagattgtgtaaaggctgagtgggctggagtgatggcgcaggccagggagccttaagtgttctgaaatccacatggaggaagctagctgacgttcttgaatcctcatccttcccataaggcacctggcacctaccttagggacatgaccctttgttactggggtaactgcaaatctaagtgttaatgatttttgatacttgagtatttctgagttgttttctctaaggtgtggcacggtgaacatggtaacagactttaaatgcttcgcttgatttaactttccacggcaaatatgtaggattgtgggtaatatctcacagttacttcttgctaggtatatggtttacattttacaatcaataaatagcttttgctttcaagtgaggtggacagtctttttaaactgtgaagcatctgggtgcttgtggcaataggtgaatcacgtgagctgtgctggaggccacggtggaaaacagacaggcctgtgcagtgagacccttcgctgccatccagaaggcagaggccagtgcttccggaggtctgacgggtctattgtcatacctagtttaaataattatcttgaggggtgcgggaagcatgtgcagatcagaggacacttacggagttggcaccttttcctgtgagtgccaagggtcaataatattagagagacgtttatgtctcctgcccttttttaatgactattcttttaaaaattgtaagcacactaagcatgagtgttcagtcgctgttggcctccacaccaggctactcttggtgtcggcgtttgaccacaaggcgcttgctatagtggggaaccctttactttcatactggactttttcatccatgcaaagaatgaaaggcttttccctttgaaaagtaattctagcttagatgggttggaattttttgtaaggcagtaactatttaataaagcttgtatatgaattttaatgtttttgaatgtaaactactcccgactaaggaaacaacagttatttatttatgtacactatcactgtcttcggatgcaccaaaagaggcggttggatcccattacagccggttgctgggagttgaactcaggacctctggaagagtgagcagaaagtgctcttaacccctgagccatctcactagcccgaaacaccttttattctcatttcatttttattttatgttgtgaacgtgtgtgttcttgtgcatgccacagtgtgtatgtgtgggtcagaggacaacttttggaagtcagttctctctttccatactcaggtcctgaggcttggtgacaagtcctctgcaagtccctgacatctcacaggacttgagtaaattatcttcaatttaaaatgtttttgctctcttggttcctcagatactttttagctgagtgacttttgaatttaaaaagtcttttaaaattgtcttaaattttttatactttaatcttttgtttaaaaaaaatctcttcaggatttgcaatctggaggccaggaaaattttaataacaggatatgttcatttattgttctgtgaagctatttgtattctatttctggatttaatcaaagattttttttttacctttcaaggctacagtgttttgttttgttttgtttttttcttgtcagctttcccaacgtttgtttatcactgatacctccgtgccaaggggtacagctcactctgctgaccaggaaggatggccttgctactctatccagtgtgtagttaccagagctgaggtggctgggaagggtcggataggcaggtgctgactgcaggctaagctctggttgttaggggaagggcccttctgtggagggtgctgggtgaggcagaatcctggcttaattgagaactccacactcctgggttcccttttataattcatagaaaccatattgtcctttaaaattcctcattgatacactatttctttgcattatcaatacctactagaaatgtttttagtttatcaagcacgttttaaagtgtttaaccctaaagttatagagaaaaggcacattaagtttatataaaaggtaattaaccaatgctcaccttccaagatggctactatagcagctgttggcatggtgaaattgcgagccttatgtattgttgtaaagaatgtaaaatgattccctccaaagtggattatctcataaaggtgtttatatttctgtatttatggcaacaccagtgtaattaatccaactatcaattcatgagtgattaaagtaaagtgaagtgtgtagaatattatttagccctaaggaattctgacacatactatgacatagcatggaggaaccgtgaagactgtactgagtgagacaactagtcacaaacaatcctgccgaggaatctcactcacttctgggtatctagagcaggaggtcatggagagaatacttggtgtttgcccgagaaagtgagggcttgtgtcatgggcatagagtttaagtttggaaagatggctggaaagaattcataggtggcataacaatgtgagtgtgttaatttttacagaaccacatacttagaaccatggttgagatggtaagttgactctttatatatattttaatttttttatatatattttggcacaattacattttttaatttttcttttttatgtgtatgaacattttacttgcacgtctgtgtgcatgccctgtgcgtgctggtgcccgcagaggggagaggaggcaacggcggatcccttggaactgcagtccagatgttggtaactgcctgtgagtgctgggaactgaacctgggtcctctgcaggagcaagtgctcataaccactgaaccatccctccagccccgctcccaatgaacaggttttttgtttgtttgtttttttgtttttgttttttggttggtttttttgtttgtttgtttgttttgttttttcgagacagggtttctctgtacagccctggctgtcctggaactcactttgtagaccaggctggccttgaactcagaaatctgcatgcctctgcctcccaagtgctgggattaaaggcgtgcgccgccaccgcaaatgaacagttttaaaatagaaaatttgattttgtattttggtgttctttcagaaaaacaacccctaacttacccctctgatcttacttcaacaaagaagagttattgacaccaggtgaacgaggctctctcaccagcaaggaagcagttggggcagaggactccacccggtgttttgtgatgtgagcttctgacacttttctacctggagatagcaccagaactcaagtttaaggttccccaaggtagcttcacaagacaccaatccaaaaccctatgctgttatatttggttttctggttggcaagctactcatcaaagctcttacaactccttcctgggatgactaaatttccttgagtagcacacagaagtcaagagaatctggttggctgttatagagagtattacaagggatacagatcaatggatgtatagtctgagtttatggaagaagggatgaagatggaacctagggcccttttccaggccactacacttaagaaatttgcaggaggtagctcacatccttcatctcagtgctgtggaggcagaggcaggcagatgtgtgtgagttcaaggccagcctggtctagagagcgagttccaggacagccagagctacacaaagaaaccctgtctctgaaaaaaacagaaagaaagaaaagaaatcactctcttgggggctggagagatggctcagtggttaagggcactgacggctctaccagaggtcctgagttcaattcccagcaaccacatggtggctcacaaccatctgtaatggggttctgatgtcctcttctggtgtgtctgaagacagctacagtgtactcatatgcataaataaatcttaaaaaaaaaaaaaccctgtgttcgttacccagaaacttttgaattctgttctttgtgttttattaagatgcctttgactgtctagttggattggcagagcaaggaaacctagcaaggactcttcagctttagtattctgtccaagagatgaggagcttagcaccttgtgccaagttggagtagggtccgtgaactcatgaggcttggagacagctgacagatgaaagcttgtaaggcctttcctgggaagttagtcacaagccagggacttagaagggaaacagatgcagattttgctgtgttagaggtatgcaaattgttctttagtgtaaaggacatctgtaatgggatgaaggtgctaatttgactagtattagatgttatgtgttggggaaatataacaaggtaaatgcttgtgaaacttaggttttagtggaaaaggtagtttgaaaaagatataaagctagccttaagttttatgtgcatattaattacacacactcccgcccccgttggaatgagaaagtttccttgaataaagggcttttaactagagacctgaagagagtatgtcttggctaggagatacagggtagggggcatcagacgggaaagaggttatgggaagacttttgtaaattctctgtcgctagaaagactatgttttgggaaatgaaagaccttgagagctgtgactagaaagatagtgcaaccttgtcatttgggaagccgtgacaggaggatcacctgagtttaaggctggcgtgggctatatccaaaccttgggagaccttgtttggggagggggaagatataggatgccaaatatcagaacatacagggtgttaggccatggaggacagtgggaatggggacacaacagacactgagagagaggtggtctcaaaaggaaacatcaacaaaaatgggggtacataagtagagtgtgaggtaggagtcaggagaacacgtgtggggcttttatgtccagcctttaaaatacccatacagtaacctttaaatgcctgtgtttgaatactgagagattaagttataaatatgtaaatacataatttataaatatataaataagtattcagatcaccatgtggcctgttaatatggcaacatgtatggaaagggtagattttaagggatttaagggaatttgagcccaaatggctcttacatttatatgacacacccgctagaagccctagatgtggatagatttgcccagggacagtctgggatgagtgggagccctttgaccaagatgtttggtccttcagtgctgagtgtcaaagagactgggcaagaaaaacttagaaagagtctagagcaccgttttagtaatgcaagatggtcctcaaggtgctggctgctcttagtgctgggaggctgctcttagtgctgggaggctgctcttagtgctgggaggctgctcttagtgctgggaggctgttgcttttagagcagattgagagtcaccatgggggcgggatgcagatgattaggttggagaaggaatgggaaatgaagaaatggtgtgcccagacacagacaggtcttccaggaagtctggtgtgacacggatggaatgagaaaggacagcggctggatttaaaggcatcagtcatcaggatgtcctttttaaaagagaaacacgaattcacagaagtatcttctatataaggtccacacaatacttgaggaatgcatgccttgctgattccttaaacaggatctgctgaattcagctgggaacttcccactgtggtgtaattacactgatttagtgtaattgcggtgttccaggacagtgtataatggctaccaccaggccttgttgaggttcaaaggtctgcttgctgctggagtaacttccggtcatctggagagactcctggtctgagacctacgtttgagtcagtaggtgtaggactcgggagtgtgtgcttgcatgtgcagatgactctcacatgtgctggcccacgggatcgctgccccatggctgctctgctctgaggccttctgggttatgggttacatttctttacttattgttttgtgcatggggtagcatctgcacagaggtcagaggataactcttaggagtcagtttcctccttcctcccagggttgaactccattcaccaggcttggtggcaaggacttgtatccaccgagtcatctccctggcctcttttggatgattttaagtgcagagcttatactgagtgactgtcagctttcaagacctgcctggaattcaggaaaccctgtcttactcccctaacctccatcaagaggtgaaactagcttgacccatctcgctggttatgaggttgtgtgcgttccatgtgggtccctctctagagttgcttctgtactcccctctcctccctgtatcctgaggagcttcctcagacccccatgtctctggactacagtaacttcctctgctaatagtcccccgtctcagcctttgtatcagaatgtcttatcgttactctggtcagtggtcatctgtccacggaggctctccctgaccaccccagggcaaagtgtcttggtcattttctggttctctctgttgagtttcttcctatgcctgaattgtgcaccacagtattttaagtcactggaatagggcctggcacagagtagatacttaagtactggatagcaaataaagatcaaaatctgactaaacagactaagtctgctactgctgcccgtgatttcatcactcagagatcatatgtgtataaaggcggactgagcagccacctacaccattttaatctgtgtatgccatttgacagtatcatctttccatattgatgccactttataaggactgtcactttttggtctttgtagtatgtagtctttctgtgtgtaagccagaagtcagtactgtgtgctccctttttgtgttttaatctttgtatttttaaaggatcctttaaaaaaaattagttgtattatctttaagtgtatgtgtgtgtgcgtgtgctagtgttggtgccctttggatctagaggtgttggatcccatggaagtggaatgtcgctgggaccaagctcaggctctctggaagagcagcaagtgctctttaccactgagtcatctctccaattccactgtaccttgttttgggggacagcatctctcactgaggctggagcttatcgattgaattagactcactggccattgagctcccctggccccagcccaccaggactggggacacagatgtgagatgcacttggcttgctcttgcctgggtaccgggtgtctgagaagatcctcgtgcgtgagtggcctgcacttcacccaccacgctctcttctgcaagaagacagtcacttcacaacggaatgagacagtccatatcatggaccatgctttttaacagctcccaattgatgtgacagctgcttttacatctattacttgaacagtgccatgaatctttctacatattggtgtatacttttattttgttagaaggaatttctaggtttgaagctgtttggtaaaacatatagtgtggggtattttgattgtgatcttgccttctggactgatagccttccctcctcagtagagagaacgagggcatttgtttcccttgtgttctctgcgatcatctgatttcggctaatttgtggatgaagagtggactgttttggggcactcagtctgagactgtcagagtgagtatcttttcttgtgtgaagtgtatgcacgccccacaccttcttttctattaaggtaattcgacttgatgaacagatttttaagctctagttttattataatttttcccccatgagagagagtttctgggtttctctgtgtaacagctctgggtgtcctggaactcgctatgtagaccagactgtccttgaactcacagagacctatctacctctgccacaccaccgtcgggctcatacttacatttttactattactactcttatttatttactgaatgcctgttggaggtggtgttggagactgaatttgggtccttcgaaagagtagtgctcacttatagccactgagccatctctccagctcactccttttctcctgcccgagcctctccagtgacagggtcacagctctgtcccaagatgtcaggtttatgcagcactggagaccaaacccattgggaatggttggtagagacttttatcatttaagccaactacccccttcagtcctcaattttatttgtttttaaaacagattttcttttttaaaaaaacttaatgtgtgtgtctttgcatgtatgcatacctggtgcctgcagaggtcagagatctccggaactggagttagagctgggtatgagccaccgtgtggctttgggtactgaccctgagtcctctgtaagagcaggaagtactcaactgtagagccatatctccaacacctggtttttatcttttgaagtacaaaatttgctactatgcatatatatatatatatatatatatatatatatatatatatgtgtgtgtgtgtgtgtgtgtgtgtgtgtgtgtgtgtgtgtgtatatatatatatatgtatatatatatatatatatatatatatatatatatatatatatatggcattgtttatttcttaggtcctttggtttatcttaggataagatgtttgtaagattttataggtcaaatatcattccttcctttaccttttttccctgcctttagtattatatctaggaagagaaagagatttcctactaattgctgtatagatgttgatttgtgttgtcttctggtgcttttgtttataacatttagatctgattgtgatgcagaaatttttaaaaagattagcaggagtgtgaaattgttggctaatgccaattagtgacagatatttcctttcaggcaaaatagaatagaaatattttcatcaatgccattttaataataatcttaagtttgtacatcctgttgaatctcttttcttgttcctgttttgtttttgagacacggattctcatctcagactggtctggaactgctaagtagcctgtgtttgaccttaccatccctgtgccccgcctctgagtgctgggttacagggaagggctactaagcccgtggcctagctctgatctctgttaaaagtttgatttcttgacacggggtcttgctcgatagccctggttgacctgaccttatttttttttctctctctctctgttttttaaagacttctgtatttctgtacttgttcttctgctggacttgagcagaagcttgaaggtagtgcagacatgatgatagcaaaagcagagaaggtagtgaattctagcagcttcttcattgtgttgtaactgtcagaattctaaatctttgtagcacattcttattcttgtatctcttcctatgtttgatccttcatctctcttaaagactatttttttaaaaaaagatttatttatttatttatatgagtacactgtagcgcgagcaggtccaaagatttatttattattaaaaataagtacaccgtagttgtgttcagacgcaccagaagagggcgtcagatctcattacaggtggttgtgagccaccatgtggttgctgggatttgaactcaggaccttcagaagagcagtcagtgctcttacctgctgagccatctcaccaaccctaaagacttacttttgactggaccgagactaagaagtagaagatctcagtgagaacagttgacatttcttggcagtctgttcctggcatttttcattctcttggcctgagagagtttagtatgttctgtatagcctcctcatttttctcagtgtgttgtttcttcagagccatatgtaagtgtttgtgtcacaggacacacagagtgataagatgctaaatcttggctgctttggtcctgggcctcttaccatctttgtttaagggctttcttacatcatgttggtggacactgacacctttagagagattgaagagcttttggattctgctagctcttttgggcccccctgccaaggaacagtgttatgtgtcagtgcggccatcccctgccccctcacaataatgctcagagtgatatccaatgcgaacgcaaacagactcgcatttcagatcttcttggcctgtaatagtgattctcaaccttgaacacagtccctcatgttgtggtgacacccaaccataacattatttccttgctacttcatgactgcagttttgctactgttgtgaccttgatgtgcaggatagctgatatgcagtatctgccttggatcaagaccctttgcttcccaggaaaaccatgtttgttgttctaccgttgatttgtaccacagaacccttctctccagccagagcactagcagctacttctgtggccatgtgcttctcacagaaagtgtagagctggcctttcctgtccactttagtcagcttttgacagctggtggctgggaagttctttgtgccatagctaaccacctagagggtctcatgaaaagaacagctatccttacagaggggaaaggcctcgctgcgttgtttaatctaaattctaaagttgaaaatagtgctggtgagaagctcagtggggagaagcccgtactgtgtatcctggttaggttcctgcagtaaacaccgtgacagagtcaacctgggcatgcaagggtttgcatggctgacacttctacatcacagttcatcgtgaagggaattggaggcggaacctgaagcagaggccatggaggggcactgcttattggattgtttctcttgactcactcagttcgctttcttacacaagccaggtccatctgctcagggctgacgccatccacagtgagctagggacttccttatcaatcgtctatcaaggaaatgcaccaggggcttgcctatgggcaatgtggaggaggtgtttccttagccgagcgacgttttttaccaaacactgctggtttgtatcaagttgacaaaaaaaactaaccaggacaccatgcaggcctgacaactatgttccatctcagaaagccacaatggaaggaaagaactgtctctgaaagttttcctagactccaccccccatatgtaccatggcatgcaccctcccatgtaaataataactaatttaaaaaaaatcagaatattttccagggtttaaaatttgaggtcttctatcaaaagggcaaagattctggcttgataacgggcttcttaagtcctgggttacttttcctaaccacgtggccacagccaagtcagtcgtgtatttattgagttaggttttgtgtgtgtgcagcacagcagagggcgagtcatactttttgagcaagtaggtaatatcacatatgtgtgttgcttgactgggtattcacatttgggtcaactcagttgggagtagatacatattctagggtgactaggccctttctctatgagatactcatatttcagtagtgacaaaggtgctttcagcaacaagaaaagtcatacgagctgggtgtggtggcatataacttaatcccagaactcaggaggcagaggcaagcccaccagcctgggctacatatggagttgccggacatcgagggctacatagagataggcagtgggggagtttcgggggaggagggggagaagagcagaggagagaataaagggatgaagggggcacacgtgtgacttggagcctctgctgggtaaggtttggttatttcatggccagtgcaagtcactacactgatcctgtattactacatgatgaagttgagtccttcttgcttggactgtcacccagggtggccttgaacttgaggcagtattcttgcttcagtgttgggattataaacctgagccaccacaccctgcttacacttgtacttctgaattagaaggcaggcaaagtcatattgcatacagagaaaaaaacgaataaactggtagctgccaccacaccaatgtacaacgagaaataaagacttaactatgaccatctaacagaaaaactccctaggcagtgggaacagcttgttcaaagactcaagtcagaagaatgcctggtgtgttcatgagacagcaaggagagaccagggaacagcaggaagcagtaagataagatcttagcggcatgttggcctgtgtctttcagtctggtcagcatctaataaggactttaattttgtgttcgaggaggaactgtggaacgattttgatgcccaagagtgggatgatctgacttatcttttatctgcattacactgactgttcttttgagaatagattaaggaaggaagcagagctgaaggaattggtaattggaccaaatgagatggccacagccttatacaatctggaaaagataagcacctttccactgctgtttgttttttttttttttgttgttgttgtttttgtttttttctgttttttttttttcgagacagggtttctctgtgtagccctggctgtcctggaactcactctgtagaccaggctggctcgaactcagaaatccacctgcctctgcctcccgagtgctgggattaaaggcgtgcgccaccatgcccggctctccactgctgtccttaaggacaccacaatctacctcaaagctgaaaatggtgaatcctctcctaagtaatgcatggcaaatcctctcccaaatcgagatcctaccaggaacactcttaagggaagaagaattcagtgctgtattcaaagttgttgctgaagcacagctgaatcctagatgttcggaagctaaagagcctctccttcaacagtagtgttttcatgttcagtctttgtgggggtaaaggagactctggcacaggagatggcatggccatggcttcctgcagatgagctgctgagagaagatggttcttctggctacatttcataccttatctttcctccttcctttacttttgatattacctcttgtctacccttttatactaaatcttttccttgatatttgccttagtcagtgttctcttgctgtgaacagacaccatgaccatagcaactcttaaaaggacagcatttacccagggctggcttaccgtttccgtttagtccattattgtcatggcaggtgacatgcaggtatgtggcacacaggcaaacatagtgctggagaggtagctaagatctggatccacagacagcaggggagagaaacactgggcctggcttgaggttttgaaaacccaaagcccatccccagtgacacaattcccccagtaaagccacacctccaagtagtgccactctctgagtctatgagggccattcccgatctaaccatcacagtattcggatttgcagtcagcttccccaatgagtcctaagaccctgtcccctgagcttttgtcattcaggtccaggccattcactgtacatctcctagagcttttcatgggcaacactaagaaaccagctttctctctgttcttctagtcccaagttctctaaatttataactttctagagttcttgctctattatctgcaaaaggggggaggaggtatctgctctttatgaaacattaacagcattatgaaacatcataagtgaagcctaggttaagcatcttttttgaatattcctatattatttgtgtgtgtgtggtatatgcgtattagtaagcgtgtgagtgctgctgcccatgtgtgcccatgtggaggccaaaggtcagtaattacatcatttctcctttccttttcctcccccagccttttcatgtactacttctctctctaaaatttattacttcttttcttttaattgaacacacactctgtttttctctcttttgtgaattcttaagtacactcggctccatccatatgttacttgtatatatgtgatttcagggctgaccactggatacccaattggataaccaattgggaggctcttctctagggaaaactgtttctcccactctcagtattcgttggttgtctgtctgtctaggtttggggtcctgtgaaaatttttccatccattgtcgaatgactactagtggtgttcttgttccagtcttgtttaagtgggcagtgttgttgagacttcatgggtatagcttccttgacacttctaggagctacaacctcatagaaatctgcctgttttcctgactcttagagtaatatttctgtccccatccctcaaggttatctgagccttaggtgtgggaattgtgctgtgtcagttgggcctgcgtactacatggctacttattctttgcattttgattggttgtgcttttctgtaataatctctgcctgtggcttagagaagtttccttggtgatgggtgaggacaacacttatttgaaggtataaagatcactatttgggatgcagttaggtgttatacttactggcttagtgaagtggtgggtgtaggttctccaagatcaacgatcttaccagctctgggtagttggctaggtttgctgtaccaagcttgatttccttcttgttgagcaaaaagaccttaagaccagttagagagctgttggttactgctaagatatatgtcccacgattgtacccttatggttagggtgccatgctagtcattgtagttcctacttttatttttttaagacaaagtctctcactgaacctggaatttgtgactttggctgttgtcttagttttgtttcctgctgctgtgataaaatacctggatagaagcaccttactgaaaaaaaagtttcatttagttcacaatctcaggttcccatctgtatgcggtacttttctattgtaccacatgccatgaccaaggcaacataataaggaagaaagagtttattttggctgacaggtccagagggacatgtctatggtagccgagcagaggcttggcagctagcccgggcatggtgtctggggcagaatcctgagagcttgcattctttgctgtaagcataaagcagagaatgcaaacatgaaatggcacgaatctttaaactcttaaaacccacttccagtgatagatatactctctcccagcaaggcctaagcctccccacacagcactacaaacaaggccaagtgttcaaatgcatgaacctatgggacacattctcactgaaaccacaccacaggtcttcatggccaggaagtgaaggcagcaggaacttgaagcagctaatcatattgtagccactgttacagcagagagcagtaaagtcacatgctgcccgctgcctgctgagcttgctctctctattcctgtactgttcagggtcctctgcctagggaaaggagccatccatccacagtggttggcttttctcaactcttgttctaatcaagaaaaatctcttaaagatatcccagaggtttgcttctctgataattcccagcagtgttggcagttaaagctacgcaccagagctctaagtgtccagtgcgcctctggcagctccctgtctctcccttccacacctcagtgctagggttacagctgtgttctgtggtacccagctttttctgtcgatgctgggaatttgaactgagttccttgtgccacaggcattttttcccactgaattatctcctcaggccaaatatttctttgcctaaaactttgacaagcctatttctcaatttgtgggggctgtgtccatttaggcttgaaagggccatgaggacaaaaataatgggaatgagcacttttgggtcatctgtcgtgggtattcgtttcaacttaaacagaagttacctgagaacagtgtgtattatgtggaaggggaaaaaacttgttgttgagtcaatatctagttcaacttatgattcatttagcaaatatttgttaagcaactatgctgatgtagaaataccattagactaaaagaaatagccatcaagacatggacacaattgatgtaaaatagagcgctcttcagttgtttcagcaaagtaggcagcaagagctctagaggaaaactactacatttggggtctaatagcagcacttgagaggcagggatgagagagaagagttcaagagcctcactgaatagtgagtttgagactgtcctgggcagcgtaggaccttatttgaaaaggacacacccagagtgagtcctctagtgctttgtgtgtcgtggtgtgtaagtgtatgagcgaacgcatgtgtgcttcatgcttctgttagaccctctacacagtgttgttggaacatgagaaaaaaggtaatgaaaatgatgagagaagatctcacaggagatttattaagaatggtttaagaaaggtgaggtgacaaatgtgatgtgttctcagctggtatgttcagaaaatctagattataggcgattaaagatgaggttgcaatagggtaaagcaaggtcaagatggtaagacatggattgaaatgtcttcaataggttctgatagacaagtctttaaaattattttatttcattattttatgtgtggggggtattttgcttgcatgtatgtttggatcctctggagctagagttaagagacagttgtgggctaccatgtgggtgctgggaatcgaacctacatactctagaagtacagctagggctcttaatcacctttcctgccacaaatagtttctgatagttggtttgaaatttgaagatcaaaatggacccttacatgttgggccagggctaaggtagccctctgtaggttgttggttttgttgttttgggttttttttttccctctttatttggtttgtttccttttgagacagggtctcgctgtgtaggtctggaacttactgtgtacaccaggctggctgggaactcacataggcctgcctctgttaggattaaagtgtacattaccattcctggcacctcttttgttttcagtggaaatcaatttaataggtcagagaatttatgagaaattccttaatatacattattcttgaattgagaaatcagatattgatagaagctataggcatatatgttagaaacgagcatgggttaatttatataaattatagtagcatcttctttatttcttttagatgctgtctgatcagcataggttaaacctgtgtcctccgactgcgttatgactcctcatgctttgtgtggttatgttacttagtccataccaccagcagtgcttgaacaggtttttttttttaatcagtgtaatttttcttcaagaaatctcatataagtggaatcatactgtatataggcttttaatacaagtttctttcagtaaaatgctctgagcatcatctaattgtatataatggtaactcctttctgttgctgaggttggattatgtgctagtgttttatcctccgattttgttaacgtgtgtgccttggcaccatcataaggaatttaagtgaattattttgtgaaacagggatggtctctgcaccttttagagaagttaacacagaggcttagagcttacatatgtaggcctagagtggacaactggttaatagtagagttgggactcacactgtggtcatccactctgaagtcagtgtcttaaccattagtctactgggcaaatggttaatgttagtttcttgattctttctgcatgctctgtgtgtgtgtgcctgtgccgtaaggtggagaggccagaggaatcaggcgctctctagccctttcaccttattcccctgaggcgaggtttctcgtgtgttttaggccagccccggagagtctcctatctcttccttgcagtgctggggccgtaggtgtgtgnnnnnnnnnnnnnnnnnnnngcttaaataaaaataagctgtaattcttaattagcataagtatgcatctctatgagaattcaggtcatgataccattattccttaacctcctctaaacagaatctttgttttttagacaacaaataccaaacaaaattggcagtggttgaaattacttaaaataagaggtgcggcttctccgacactgccttaggtttaattaagataggtagttgtcttgttttttgtatttaaaagcatagaattttgccaggctattacagactcctaaagtcctagtactctgaagctgatgcagttcaggcctaggttacataatgaactggaaacttagcagtgagaccctaatgaaaaaaaagaaacagaaaaattttaagaagaaataagcaagttttggtgtgaaaatgtctcttttactttaagcctatttacttaaatatcttgtcataaaattatttctagactaataacagcttttattttaatgctattttgttctgcaatgctgagggttgaacataggccctcacacatgctagatacattctgtaccactgagctaagaatacaaatttaaaaatatatattttatagagactggagaggttgctcttggagagacctgggcttgattcccagcacccgaatgacagctcacaactgactgtaactctggttccagggattacaacaccctcttctgacctccatgaacaccaggtagacaagtgatacacatacaggctaacactccaaagaataaaacaaatccaacaaatcaaaaagaaaacccatttattagtaaagtataattggcataatttcatttttgaagattctataaaatttacattactggctagtgtatgaatagcttcctgccaattatcaaaaatctggtgaagaaagggctaggaaaatggctcagtagttagaaacagttgtgcaattgtgaggatctgagttcaaatctcctgcacaaacacatgcacacaccatcagtgaatgtgaggtaagaagaagagtgcactgatgtgtatttatgccgctcacaagtgtgactcagccgcacggtgtggctatcaggacaacttgtaggagttgatttttccttataacttatgggacccaggcactgaacccaggtcatcaggcctggcagcagccgttgctttctaagccatcttgtggaccctgagactttttatgtgtctttagtaggactttgttctgcaaacagcagcctaagcctgaggatttagaaaggccatagaatcaaaagacagaactgaaaggagtctcaaaagtccccaggtttccatgctgttccaggctttaacaagaacaggaaatgggactgggatttagctcacaggctgaatgcttgtttttagcatgtgcaagaccctgggctcaattcctaggattgcaaaaaccctaggagaaaacagaatgcctggggaaaaggctggcttggcaaagcacctgcagggaagctggagggccgtgtgtacattcacagaacttacaggaaaagtttggcctggtagcctgttcgtaaatccagtcttcagaggaacttggggggaaggagacagatctgaagcctagctgaatctttggtttagcgggagactctgtctcaaaaaataaagatggtgggcccggagagaaggctcaacaggtactgactcatcctctagccccacagcgtttgatctacaccccattcactggaagaagagagctgacctctccattgtacatagggcacctgagtgcccacatacagatcaatgcacatggaaaataaagggttgatagcacttgcgaggtgaggcaggaagatagtataaagttactgcatgcacagtggacggttctttacaatagaaaagcagttttgttaaacagcacccctttctcacccttctccccaactctttaagtagaaaaaccttcccacgattataatcataacaaaataagccaccttttaaaaataccacttacctttgttttgggtacagatgttttgcttgcatgtgtgtaaataagtgcacacagatgggcccggtgcctacagaggtcagagaggtgcccggtcttctggagctagagtttggatagctgtgagccagcacatggggcctgggaatgaaatctgggtcctcttcaagagctgcaaatgctctcatctactgagccctctttccactccccaaactgttatctttaacctcacttctgtctgtctgtctgaagcttctctcatcagactgtctccttttagaaccgcattgtgtgacttttccaggcaatttgcttctgcttttcctggctagagaggacagaggtcgtacaaaggaacagtatcatctgagttcagtgcactgagccagtgagcttattggggttataggagcatgggtgagactccagcagctgagtcacagagaaagcacccgtcctacagggatgagtcaggatttaggagagtgcaatcgcccgagacccccaggcagccctcgaccatggaagggtctcctccttcccagcagatgacatgacgccagggagctgcaccggatcttctcattcgtatgatcttcctgtgcttttcagtcagggttcttaggaattttatgagctctcttgtatctttaggagggaatttttcaatcaggaaaaaacatttataaaatgggactctatcacacataaaactttttttaaaaatacctatttttagccgggcgtggtggcgcacgcctttaatcccagcactcgggaggcagaggcaggcagatttttgagttcaaggccagcctggtctacaaagtgagttccaggacagctagggctacacagagaaaccctgtctcgaaaaaccaaaaaaaaaaaaaaaaaaaaaaaaaaaaaaaactatttttatttatttgtacatgaggatctctccctccctccctctctctcttccatcctttctttttgtttgtttgcctgcacatatgtgtgtatcccatgtgagtgcacgaatctcttggaactggagttacagatggttgtgagctgctatgtgctgggaaacaaatcccagtccttttaagaatagccagagctctgagccatctctccatgttccaccccgatttctttttctttttctttttcaaaaaaatcaatagtaaccttcatattgctaaaaccagttgccattttgcttcagatctcatctgctttggtctgagatcagcggttgacgctcactcacctcttagtctgtgtttactcctcagactccatgccgatagggtagatcttgttttcctcctccaattctctgtggtccttctcggccacccttgtaagctctttatcatttccccacctctaaatgatggagtgtcccaggagtctttagtatattatctgtaactatatgtcatgcgcatgtgcctagatatatgctagtgatccccaaattgtattacttgtttttaaccttattttataacttaaattatgatagaaaattaacaacacttcagtactgatttaaagtcagtacatcttatgttacacgatgaaagagtaagaggaaagatatttgcttaatgtgtgtgtgtgcacatgcatgtgtgcatgtgtgtatatattcttatgcaaatacattcttaacaaaataggagtttctgtaagtggtcacttcctagtgttgtagctggcattactgacactctctgctgcttgttctgtattctcttggtcttcaacaagtaccccagcttgttgtgccctagggctgaaaagttgatgtggccagctgaaagtaaactttctggctcatttatggagaataaggtgtttgctaaatcggtagctccttttcaggtgccagatatatgaatttgctcaaggagtgaaactgcatctggttaagtttacaatatggttattgtttcccaagatcatttccagacgggtgctgaggacggcctaacaactgcagtctgtcttggttactgtgtatatggctaggggctagaacagtgtctgacacacactcagtgctcagggcacatttttgaagggtgagaatgactaagagtgcctacagttagtaattaacattgagcctggaacatggagaaaacaatttatatgtatagaccctccttctcaaaattaaggcagggtctctgaaccctggttggcccagaactcactgtgtgctaggctggcctcaaacctttgtcttactgagtgcgaagattacagggatgcaccaccacactgccatctttttcttattttaagataggacaagagtgggtcagtgtttgaggttgtactgaaacagcagcctttaatgtatttccctgaaggctctcataaaaatctcagtgataaacagaattgaaaagccacctgcctggatagaggatctctaaggtgtgttcaggcttatgatgataaatattttcaataattgtaaactggtctgttgagggacttcttcatgcagaggagaccttttacgtgagggttgagtggatgttcagtagacggttggaatgaggtggtcaatcccagcaacacagagataaggaggtcgaacagaggtgggggaggataattccaaactccagcaggattcagtaggtctggactatgtgtatgtgtgcatgtgggcatggatgcttctgtgcctgtttggtatgtgtgtatgggagaaaaagtgaaggaaatgtgtgggcagagaaatggagttgggtctgggaaaagaagaaaaattgaagtcaggtgtcagaagccttgagtaccatgataaacggtggtgttttgttttgttttaagatggggtaattgggtcatctagtctaagtacttgccataaacaattgaaggaaggaaaggtttattttggtctatgatttcagaagattcagttcatggttgcttggcttcatgtgcctgggcagaagatgacagcaggggtgaggggtggaggctgctcttagcttcttgaaaaataggaagcagagagaggggggaaataggaagaagccaggctgaaatataggacaggtagtgatctacttctgccaactagggccacccctcctccctttttaccaccccccagtaacaccactctattgtgaatatataaaggggtagctccattgattacacccggaccctcaggatctgtttttggaaagacaaggtatttcactaactattgaggtatttcctcctctaatcaagttgacaacattagtcattatctgaagttttctgttagctaatctctaacttgaaattcccctacctcagcttccagtattggaattacggatgagcatagctagcctggcctttgttttgattcttggactcagagttgtttcttctctctccccatctcctctttccccattgtgaactaaggtcactatcgttggtagagttgtttttcagcaagactgttggtggtggtagagctatatatagggcctcactgaggcaagtcaggaaagcagtctcctattgagctgtagctataatccttttagataaaaatgatttcagtggtcagaaataggcaggagaataccatgagattttcctttgtactgagttcccagccatcgtgggtccttgcctcaaaaagagctgaggggctggggtgtaggctcagtggttaagaatacttgttgcagggctggagagatggctcagcggttaagagcaccaactgctcttttaaaggtcgtgagttcaaatcccagcaaccacatgatggctcacaaccatccgtaatgagatctgatgccctcttctggggtgtctgaagacagctacagggtacttacatataataatacaaaaacaaaaaaccacttgttgctattgcagaggacccaggtttggttcctagcacccatatgatacacatggtaccttgcagtgtccagatacagggaatctgatgtcctcttctgactatcttgagcgccaggcacaaaagtggtacatagacatatacacaaactgctcatatgcataagaatatatttttaaagctgagacaggatgattggcatgggtttgaaactagctcggactaaaagatgagttctagtcaacttgcctagagtataatcctgacacagaaactgaccagctctgtctgtaggagtgaattacggatcatgtgatacatacatgtttaacttcatttgaaactgccagtgccttctaaagtagatataccaatttcccaacctaccaacaatgtacaaaggaatagttacaggcttgggaaatgcttagttggtaaaatgcttgctgtgtaaacatgaagacctgaggtttagtgccagtacaggttctagtacagcgtaagctggtcttaaacatgctaggtgactgaggcttagagtgcaggtgtggatcaccgcgtctgatgttcacctttttgaaagagtaatcttaatctcaggatactattataatgttcctatggggtatatatgcacaatttattgacttcccaggacggcagtggcttcaaacttaagtgtgtgtgtgtgcgcgcgtgtttgtgttgaaccccacgtttcacacatgcttgctgtatgatttgctgtactagaggggtacgcttagccgtaaagacttttatttgtttatttatttatttatttcagcattgtggattgaacacagagcattgcacatttggtagttgtcctaccactgagtggtaccctctatcctgtgtttgtttaaaaaaaaaaaagagttttgccgtgtaactaggctgtttttgaacttgctatgtagcctgggcttgatttggccttgtgttcccttccctcagcctaagtattcgaggcatgtgccgttgaactctgttccaagcccttggtgtattcctatgtgtgtgctcacctgcatgtggagggcagaggtcaacacaggtgtcattcctcaggagccacctaccgtgtttttgagatagggtagatttggttaggccagctgaccagcaagctccagggtgttcattcctcatgctaggcaagcacttggctatggagctacatcccaacccaaggtccaggatgtcacctgggtgatgggcctcacactccagttctcatgcttggaggtgagtgttttactgagctgtctccccaggtccctgtttcaaggtgtagtttgtttgtttgtttttgtcattttaaaaataagtgttgccatttgcttatttttttaaaaaatctttatttttatttcatatgtatgggttttcctgggtgtatgtctgtataccgtaaatatgcagtagtgcctgaggaagccagaagagggcgttggattccttggcactggagttacagacactgagctgtcaagctggtgcttgggattgaactcagatcctctggaagagcagtcagtgctcttaaccactgagccatctctccagcccccattggcttatttatttcatttatttatttatttatttgtatcatccttttactttttctaattaacttataaaagtcagattaggtttacatggatatcacccaaaatattagctgtgggaaatgagctttccagtgaacagtggacttcttgctattgactcagagcagcttgttccaaggtgtatggagtatgaacattcattcagatattccgtagtcaaaatcgatttatccttttcctttgtgtagttaaaaatcaatttattaagtcctagagattatcttagtaaaaagaaacttcagtgaaatagaataaataggttatcttgatgaactagttgtatgctcactgaggggccagggtaaacagtggtggtaatgttttggtggcgtgtctgacctggaggacattgctgtagtgctttgcccaccagtgttggagacgggagcctggtacttagaaggcttgtgaggcaggcagaaagctttattccgcaagtgaagctgtggctctgtcttggaaatgatacagttatgcactatgattgcactggtaacttttaaaaagtatttatcttcctttctttctttctttctttctttctttctttctttctttctgttattattattattattattattattattattattattttggtttttagagacagggttattctgtgtagccctgactgtcctggaactcactctgcagaccaggctggcttctaactcagaaatccgcctgcctctgcctcccaagtgctgggattaaaggcgtgagccaccactgaccagtatttatcaacctttcaattctacttaaaattgttttgttaagttggactgtctaacatgaattttcaaaagttcttttagccacgttaattgacacttatttttccactgaactttggattttctagtgaattttatctgtttaaagaacctataagtgtgcgtctggcattacagtttgctggcttctccagattacatagccatatatcccttcatataagggttaatgagtagccaggttggacacacccgtccgtccgttgctgtggtaagacacagttcgttctctcctttcatccctcacgttttctttttatagtcgtacttatttgatgtgttaattttactttcttgtagcttgtcattctattttatactgttaattttcaaagatggcaattagcatgagttagtggcaatttaaactaggtagctttgctcctgggctctgcctcgctcctgtccaatgcctggcccccattttcacctgtgcatttgcatgtttgacctagcagaataattgggtccacagcaacatgggcgtgcctaccttagaaacacttagtttcatgtgtgactcataagctgagcagacttccccaatctgcaggagccattttaacagcacagaacttgccgggttgctttttagtttcaagcccagaggacgaaacctgaagacaaaagtttaaaggtaacttgtgattttgtatgtttgcttctggctgtttttgagtcgattaaacagccgaggttcttacctgtggcagaacatggctgaatgtattctttaactctgataaaatgcacgtagtgagtcacatgtctgtgcacttcagaactatgggcaacaaagtatttaaatgctgaaaagtcctagctcttcccctgaagcatcttgtttatttcactgcttggtattttcctctcctctaacttcacataaaggagagcccccaccctgcaaagcaaacctgatccagttctaattaaaataaacttagttgactcggaggggctggctgagaagtaactcttcagtagactcatgagattctgatgctgagaagaaaatcaggaacaaaggctttgttacagtatcttaattaaggctgaaatcttgggtttcaatttagttttaagtgttgctcacaggcctgtctatgcttttttttttaagttaatgaattatgcaaaatatttcattttgaaaagcaaagaggtttaaaaactaaggcgagtcctggtaaagtgaatcggtggtaaaggcacattttcagcgaagaggaagccggattggatggattcattcagggtttgagggaagcaaagccttatgggacaggaacttgcttggactatcatccactctggaaaagcagctgcttctgaaggcgttctgtgctaggtcagtttcatgtcaggaacagaaggatgctgcccttcctcattactagtgctaacctgggaggctttttttttttttctttttgtagttaaaaaaagtaaaaatcttttgttagcaggaggtggctcagtctttttctgaatactttgtcatcactgaaacggttatattttctggcacgtatacattgactctgcagcgatattttacttgtgaaacatccgtgaagctaacgtttgggtaaaagtaaactttgagtactaatgattcaggtttgttgtcatttactgttgaccacaatggtttctagcaggttgagagttgcctctagcattcggagtgcatgaagtccttgtaggtttgaaagggacagcaagaagggtgtcacttcttgctatggtggaaggctcttgatactagcagatcccagtaatgtggtcttagaaggagggcagacattttgccagctgagcctcaagctcttctctatcatctttgtttgcatattgcaggtttggttggcttttgactgagtgaaggctgtattttctttaagtctggactaaaacaaaacgaataacaccttcaagttccacctcccccttttcctttgtaaggcttgtgctccacaggagaaacatcaggaggacacaagtaaactagctaagggcatgtacactaagcagaataatttgagtccttaaaattgggaaagtgcgacctttgaagttaagtttgttttgagatagggtcttgctgtgctacttgtctccaattctgtctggtgtgcctcagctttccagggttggggatacaggcaggtgctaccaagcttggctgtccctttcttactaggatttaggaaaatgccggaaaggaagcttgcaggatgccctggagacggagcgtgttgttagttaccctgtgccctcttttcctaagatacataggaagtttaaatgcagccataagaattacagtgtggattattgactggcgattgctcaaggcctcatttatggctgaccctggtgccagattggccttgaactagactaggtattagcgagcgaatgggataaccttgaactcctgaccttcctgcctctctacctcctaaattaccaacatgggccatagttctcctttaaatttggagcacaggagtgggggacaaatgtggtaacacatgtcgagttctacaacagtcagggctgcacagaatgctacaaacaaacaaacatattattattttttactttgtattttcttggcatatattatcgtatataaattataaactttcaagatagcatgatagctttacacgaagcattcattatctatggtcttgatgcttagtcaaagactaatcactgtatttgtgcagagctggatggtattggtgtaaatgtaattaaaggtagttatatttctgggtttagaaactacatggtcctgtaaagtcaaaacataacattttataataaaannnnnnnnnnnnnnnnnnnntttattagcattttttggtatcaaacacttaatggaggtatactatgattaggcctttcatttttaacattaaatatgcatatagaaaagtgcataaagtaactataatttcagtgtttgcccattcacattatcctaggttagaaagtagagtatgtctatcacctgtatttgcttccccctaaaatttgactattttgacttttgtggtaatctttttcttatagttttactctcttgaacctcatgtaagccaagtcccattttcctgcagtggtttgcttattccagtcagctcagtgaagctgactttcggcagcacatctttgcagcccctgtctataccagaacctttaacagctcttgttaataacgttagagtacttctagtttggaagcattctttgatgcactcccaagaacacaggtgcaagagttctgtagcattaatttttcttattgagatgtgtgaagactttgcaaagactgaaggaacagagaatttaagaaaataaatagctcctgttgttcatcatggacattaagtgaaattgcctttaaaacatgtcagtgctgggactggagaggtggctccacatttaagagcactggctgccttcccttccagagttcttgggtttaattctcagcacctcacagctatgtgtagctccgttctaagagatttgacctcctctgtgttctgctggcaccagacaagtgcgtggtacactgacatacatgcaggcaaaacactcatatacacataaaatagtaaacgttttaaaagctgtcagtgctagttggtaaaaatacaagtagtgtggtttggctgtgtagccttgactcctgccgaggctggcaagctccagcttgaagttgctcttgccccaacactgcacaagtcagtgcacctagagggtgtaacggacacccggttgcattatgagggtcattttgagctattaagtgctgacaaggtttctaggtcctttgtgggcctgagaaggactttgagcatcactgcagtactgcgccattggaaatgagccaatagttcagaaactaagtattggataagtacatgatgtcatatccacagaattatgtggccaaaatttaattttattaaagtttacgccaaacacgactttacagtggagtatttttgcatatcggggcacttgatgaagaaatcgacctttttcgaagaaagtgaaagtagaggtccaagtttctgggccttgctcagctcaggccttggaaaaaggggagctgaggaggaggctgctgctttgctggtctaactttactgctttaacgttcacagacaaggggttagcagggggtatctgccattttatgtgctttttagcagtaggtgaaatgcgcctttacattatcttctagtagattcagttctcattacattttcagttcctcctgtttataaaattctttgtcctgtttattaaaaagcaaagctgtctgattcccgtggagctcgttactggtaaggcaccgacgaccgacaagggtgctgagagctgaagcggcaagtgctctcgacctttgagtcatccccccacttctggtttgtttttccattctttctcttattgagacaggatccccctaattagcccaggctggccctgaattctccagcctcttttaacttcagcatcctagtcctggaattccaggcaagcactatcacacgtagtctgcatttctttattgtgttcttaattgggggagctttgggttgctatatagagtttcagacttgaggccaggagtgtagctgtgtggtagactgtgtgcctagcaggcaggtggcctgcttcaatttgtagcaccacaagaaaaaaagtttcagtttgaatataagaagtattctaaggtttgacagagacttgcatttagacacagtgcttcttttaaaatctctgtaggaagttactgcatctatagtctgcatgaagtcagagcaggtttgtgagaggcatcttggaaggcaggctactttgtgcatctggaacacctcagttgtaatgaaagcccaataatcataaattggcttcagtatgtttctaatcagaatatttgatgcttaaagattccttatatattgtgtttatttaaagtgttccttaagcttgttagaaaatgttagaagactctctctctctctacatatatatatatatatatatatatatatatatatatatatatatatatgcagattttactgtttatttgtattgatggtgaatcaaacctagggcactgaacattctaggcaaatcacttctccactgagctgtatccttagtccttacattcttattctttctcctttccctcttcccataccgcttagccttacataggctaagtaaatggtgtactactaaactatacctacagcccaatattccaggtttaaattggaaatattaattagaatattaatagtctttgaaaaagaatgagctatagcctttcctttgaaatattaggcaaaatagaactgtatattcaagccatcatataaggttttatactttagaaacatagaaccttacttaaacctaaataaatagtaaggacatgttaaattctgtttaggaaaaaaaaagccacaggattctcacaatgggcttatgtgatatgaacaatgttgttttggacattaatatagaatgctgaagcctgataaaattatagttgatgtagattatatttatagctaggtaagaattgcccaatattaatagagaagatagctgtactttgcctaaccatgtggtgagttatcattcataaagattattagtttgacaggcatgatcagttgagcacctatttatggtagatatatattacaggaaccaagttttggacatatgagaaagtgggggtagtttgttggggttttggggcacaagtaatctgagactgacaaaaggctgtattaaataaaaacccaacactctaagcttagcttagttgatagagtgcctgtatggtaggcattatgtttggagatggagactagaggatcagaagttcaaggtcatctttctgttacatagagaggtggagaacaatttgggttgtgtgagaactatcacagaacaaccaaccaacccccaaagatcaaagtggcaaattaatcagttgggtgttattgagtcatttggggtagccatgctacctctctgatatgctcagctgcttgctcagctacatggtttctgggtttttttgtttgtctatttaaagacagatgcctactattatacagccctggctggcctagagtgctttatgtagatcagctggcctcaagttcagagagatccagccgcctctgcctcccttgttttgaaatgtttagttagggtggctagcaaatgttactcttcaaattgccagactcctaggacagactttacggtttggggacatgttctgctgtttcattcagttatgtgggcgtggttgtttttgtttttgtttttattttcctacctcttaggcccagggccttttgcatgctctagcaatggctctagtatgttttgtagtttttaactttggagcagggctcttactaagttgcttgggtttccttgcctgtgtagccatcttcctcctccgggctctggagtagccgggtcacaggcctatgccaacaaggctggccacagcattttatcagatctttggtattcattcctaggagtccttcaaaggacatgaacattgttcttttgtctcttagctctcaacaccagaatactttcattgtctttcttcatttttatgtttctgatatcatacttcattgtgtttgcacacaggcaattgaactatttataagtaagatgcagcagagaaggcaggaaatagttgacatttgtatgctctatcttgctctctgcttcctgtcagttaaaccacgaagagaggaacagagacacagatgtacggttgctgctttaatttcccatcagggagcccagttaagcataaaggttgtttcattaaacttcgtacttgttgattttaggggtatgtatggtaggcttcttggtgggttacacagattgcgtggatatctggcaacactttgacattagatataggacttatatgaaaatacaagttttacacatttaagaggtttttccttttgtgattttgttttgttttttgaaaggctccatatgcacttaggctggcattacactcatgatcttcttgacttagcctcctaaacgctggggttataggcctgtaccaaactatactcaagtataccttagtgtgagtgtgagtgtgagtgtgtgtgtgtgtgtgtgtgtgtgtgctcgcgtatgaaggccaggggtcaaccttgggtggcacttcttaggagccagaggtgtcattcctgagggactgtgcactttgtgcatgcatgcacacacgttcatatgtgtgcacaggcgtgtgagatgtatgtacatataggccagaagtcagtcttggtggtattacttaggagtcatgcgttttatttttagaactgggaactaaccccagagcgtgcacataatggggcatgctcgttaccaccgagctgcaaccgctgttctacagagccatcaacaggcttgctgagtccacttatttatttaatgttaactttgagatagtgtctctactatatagaccaagctggcttcaaactcatggaagtccacctgcttctgtagaataaaggtatgcactactctagctggccttatcaagtatatttaatttcaaataatggagggaaatgtaaaaaacaaacaaacaaacaaaaaaccaaatgtgtttttgtggtcttactatggagggtagacagctggatttttttctgtatgccctttaacgttttcttggcttctattgtgtcttatatgtgggaaatctgtccaaactcacacaagtgctgaagacagctgaggaggtgagacaatttcatttccccgttggaaaagcttgttttctactaggttgtcccacctcatttttagatttaaatgttactgtcagcattgctccttctaactagaatgtctccctccccttcacagtctcagaacttagcaagatcagatgggagttatcactaatgaacttgcccccttgtaagggttcctccatctcacaagtatttaccccccctccctcagcatttgtttaatacattcatttacatttagttatctgttcccaatctttcctaggaatcaagccagttaaggacaaagattgtgccctaattgcctttagttttgtatactcaccgaggttgtagctactaagtgcaagcataggtgcactcacacctctgatagctccattctggaatcaaagccacaggctgattaaagaactacagtgtgtcttctctgcacgttgcctttatggtatatttgtaagaaataattgaagcaagcgcttttttcttcctcctcggagtgtgcttttctggggagctgtggatcaaagccagggttttacacatgccaggtgagtgctcagggctcctccactgagctgtgtccttagaagcaaagccttcctgaatgatatgctggtggtagcagactgtagtaagtggccatgaagtttgaatctgtcatggatattgccttgcttcatttcatagccgagtgtcatctattcaaaatacttaatccatatagaacatagatgcaactagtctctctctctcgctatatatatatatatatatatatatatatatatatatatgttttccttctggtagttaagtgaatgaagatttagttaaatagcatgtacaaagaatgtaatacagtcatgtttttaaaatttgtgactggtcatggccatagcataaacaatgagaccctgtctggggtaggggtgggggacaggagagaaaggaaggaaggaaggaagaaagaaaaccttgtaattttccattttaaaaaattattaaattaggttgtgaatttgggggtaataatgggcctcacacattgagcaagcactctgctggaaaaaccgaacctctttgaaaatttttgtatttttaattttttttaaacaaatttgagagcaggtctcactctgcaagttgccaggctggccttgagctctcagtcttctggccaggcggctgtagctgggttgacgagccagtgccgccctcaccctcatagcttttgtttggaagttactgtggataaggcctaaatgtacaacctaggatggcctcaagcccctgtgcgccccaggctaggacaatggcatgtgagacaggatctgattaggtcatgattttctcctcgtgcatacctctgccttcctggtgctggaattacaggtgtgcactaccattcctctatctccacccttctcatccccagggagaacaaaaccacagcccatcaattcaatgtttgtttgtttgtttgtttgtttgtttgtgttccccacaacctgagcactttaccatgcttgttgagagtatctgtgccataagggaagaggtgcaggggagtggcttacacttcagcagtgccatcatctgtgcagtgcttgtcacagctctttctgccattttgaacagtagtctcagattcctggggctgtcactgggctttttgagcacagggaccaccctctgttgttagaactctatttggaaacccctggactggctgaaaagatacactgtggatccgttttaacaattagatgctgccttctggggttagctgtcttgtcttatttactgaaccacactgcaaactgcatggatcaaggatgaggcatgctattctgtcttttccacaatactgtacttaggtaaatttagcagatgttctgaatggtttaccattgaatccattaatagtagaggtgtcttgaacatagattcttgagatctcttgataagctctagatgaacatcaaagaagtacatttcctattggagaaaacctctcctattggagaaaacatttcctattggagaaaacctctcctactggagaaaacctttcctagagatgtttacatgacccctaattatatacatatataaaataggtgttcagagcagtggttgctgatggtaaatcaggaggcaatagttgtaaggttcagtgagtagaggttcttgctgccaagcttagcaaccagagctgagtccacagtacccacagtggtggaaggggagaaccaattcctgcaaagttgttcactgcacaccagaggcagatgcaaaggataagaaggaacctgagtcccagggcagcctgacctatggaggaaaacattgtctccaagacacaaacaaaaccaagctggtgatcatatatgtggtacagtgtgtggcatatgccaaccacactcattcacacacacacacacacacacatacacacacacagacagagagacagagagatgctctgaatgtaaaaaaatggaatagaacaattatttcatatgtgtataattttatcatttattaaagacaaacacatttacacaagtaaagaggtttacttgtttatttttcacatacagtgattaaatcatagctgaatacttggcattgtggtactaaagcatctttgacattttcaaagatgtttggtatttcagtttattattaacaaaactgagaatgttgtttcaaataaatacattctacaaaaaaaatgggaaaggtatgtttgaggctatttcaaaaattgttggaaattcttatatataagaatgacaagaaagaaaacatggaggaatttttgaatctctgctcgggcaaatttcctactcaagatgcctccccggtggctccactggggctgaggagtcaggagaaggagagcagcacagaagttccgatggaagaggcgcttgctctttgctccggctctttcccaacagacagggaggaagagggtgaagaggaggaatttggagacttccagcttgtttcaaaggagaatggatttgctagtgacgaggatgaacacagtgactccaatgatgaagagctggccctggacctggaggatgatgaagaagagctcctgaaaagtctgagaagatgaaacgccaaatgagactgaagaaatacttggaagacgaggcagaggtgtcaggcagtgagtgacgtgggaagtgaggacgagtacgatggggaggagattgatgaatacgaagaggacgtcattgatgaggtgcttccgtctgatgaggagctggagagtcagatcaagaagatacacatgaaaaccatgttggatgatgataagcggcgactacggctatatcaagagaggtaccttgctgatggggatctacacagtgatgggcctggacgaacaagaaaaaatatatatacaggaacccttttattccctatagtggtagtgaacacttttaatctcagtgctctggaggcagagggaggtgatctttgagttcagagccagcctggtctgcatattgagttcaaggtcagcaggggctacacactgagaccttgtctccaaaacagagacagagacagagaagaaatcttgtcctatgcaaagtgtttatgactctcacattctgttactggacccactacaatttaaggaactggattttaattaatgtagttgaaatgaattcaaatgatttaacaattatgcccttatattttaaaatatgaaagccctaagcatttagcttgtatatgtcccataccttcagattacttacagtgaagtttggttttgagacttataaaaaggaaaacacagtttttaagcactcagtattttaagtgtgtatcttacccttctatcccatgctttctgttttcctgcctcccatctttgaggtcttcatgctgctggtgttttattttcattgagcttagaagctgagatgcccgttagccatgtggatggttttaaggatccccagccataagacagagtccatcactggcctgcagctcagttaggttaactgtctggccagcaggccccaggagcctcctcctctgttgcctccacaccagcatcatacacaggcagatatacctgatgtatataccacatttgtgggcactggacaatgaagttatttgattgactgagtcactcccccaattgatttaaagacaggatctcagtaagcatcctatctccgtctctaacttgcaaatgctgggattattgtggaacagcgtgggcctggaggttgcacacatccctccctgcctttcctcatgcactcagtgccaaagcccaagtgatgagaatcaaaccatggtgggagagcttggttttcccaaaacgaaaatattaaccaggggagtaagcagccacagtaaatggaacagatttcttgcaggttaattcttgtttgttgcagagaaaaatgtttagttgcctgaacaggttttactgataagggtgttatagcatgtttatgttttctgggtagatggtatttgtcagagttcaggttttgggtactggagagaagaaagtttctgtagacagttaattcacataataaagcataagctaatattttgatgataacagcctttttgaaaaattaattaattttttcatgactaaatttatgactatcatggctttaaattcttagttttaaattctcatgttttcagaacatgttcaaagagggctaatcctgagtccacaggtagtaacaggcctagctatgagatctgttggtttttcaggtgcaataaatgccgactgaatgtaacctgacaccaggtgagctgagtggccaatagcgggaggtggagaagtatgcgaaagaactggaatttcaggtgtggggagtaattgcagcctcccccagaggcctgggactgtgtcagcaaaaagtcgagagtagagaaagtcagcctgattggttcgctcatcctggggcttttaaagttaacgcagttgaagctcaggtgagtttgattgggaaaagacctgcttgagcttcaccagagctacatctgggccttgatatgcagtgccaccgtttggactttatttataagaaagtcaaagcagtttgataaagttgtgattgccactcccctgtgctgtctttcaatttaagaatgattagtgttctcctttattaattacataatagctactgtgaagacagtttatttacgttgacaaatgtccagtattactaagtagctattctgactagctagctacttaaaagatgtggaagggaatgtgatggcccacacctggagagccagcacttggaggcagatgcaaaggataaagggagcctgagttctcgggcagcctgggctatgttagaaaacattgtctccaagacacaaaccaaaccaagctggtcgtcatgtatgtggtatggtatgaattgcagaaactttgttttattcattaatttttttcaaagaaacaactccaaacacagaatttgaaaaaatcagaaggctcattttttaaaaaggggatttagatgtcaagtttatgtactatttatttttattttttatttttggggtctcatgtggtctaagctaggctagaaaagattctcttgcctctactttctaaatgtgagattacagatgaagagcaaccatgttttgcttttaagcattttattttattttaaagaaaattttatttgtttgcttgtgtgtgtgccacttcctgcctggaaatgtataatggtcatcatagaatagcagtgagcatttgtaactcgtgggccatctccaatctctccagccccaagcttgttgctgtttgtttggcttttttgagatagggtcttactgtgtagccttggctagccagaagctcactatgtagacctcagtagaactttgaactttttaagatctgattgcctcttcttaagtgctgagttaaaaacctctctgccaggctggtgagatggttcagtgggtaaaagcattgactactcttctgaaggtcctgagttcaagtcccagcaaccacctgtaatgagatccgactccctcttctggtgcgtctgaggacagtgtacttataataaataaataaatcttaaaaaaaaaagacctctctgccaccatatttattttaaaaattaaattatgaaaggcctgaatgcagtgagcgatgacttgtttactttgaatattaacttgtgtcccgcctccccattttgtgaatatggtacatggcttagatctttctagtgaggttgtgctcagtgcttgagaacacttgatgctcttgcagggaatccaggttcagttcccaacacttccaccaggacccgggcatgcctgggcacacatacatacattcaggcaaaacacgcataagcacaggaaaaaaaaatctaaaaaaaaaaaaaaattaaataaaagtattgccctttccttccttcccattggtagctagtagactaatattgttcttatttggagaaaattaattctaattgcataatggtaatggcactggtatgaggttcctcccatgtttacacttatttttctttttaaagatttatatattttatgttttctgcatgttcgtttgggtatatgtgaatcacatgtgtgcttggggcctacagaggccagaagagggcattggattcccacaaactgtggttacaggcaagggtgagctgcgctgtgggttctggcagccaaacccagagcctctgcaagagcagcagtgctcttaacccctgagtcttctcttctgttcacagattcatagatctgtcaatgtaaatgatggcagtgatactatacttgaactgtgaacaccagtaaacatcagaagatattttaacgagttattaaattgtggtagctgtataaaaggcgtacatgtttttgttcttattttttattttgctcttttaaggctgagtgaagctgaaaagaatatgatatggtagacttgggggtgcacagtaatgctcagctaaggcttaaagctacaaaggagacagcctcaaaccttcccttcactccaactgtatatatggttagaagcgatagattttatgcatcaagaggatgcataaaatagcttccggagacatttcaactaaaaagtgtaccggagtgtgggaccgtgcttgggaacacatgcttggttttgatggtgttggggtctaaactcagggccttgtgcatgcaatgttctctgtcactgagccgtttcctctccccctggtgctctgctgataaaaacatgagtgacgtctcactagtaaagatagagggaggggcaggaggagcctgggcctctcatgttctctttgctgcttattggctgtgtccttaggcaggtcacattgcttatggtcccaaattccttaccttttcaatgaagtgtgtagttctcagctattcctaggtgtctttttcaactctaaaccctgtaattctacaaaatttttgattgatgggcagaccattgtgccgtctactttgataaccacgaatttgacttcatttctgttgcctagcattcattctaaaacaatgaaaaacatcagaaaaaattgtggtccaccacacaaaaattagagtcattgcaagcggtgggtccactgcttctggtttctagttttaatgtggagcctcgcttttttcatgttgtgttctttaatttctgatgcatttcttctaatagtatttttccaaatagccttgtttttcttagaattcttgaagatgattttgggaaagtctcttcatcagcagctacttgatgtaagaacactttctgttcagtcattttctgtacagttattacagaagtcctcttactcgggtcccccgcccggccagcagtgtacagaaaccaagtgccatccgaataatcggttcccgtccagttctccctttcctccttgctgatgcctttcacctttttgagctagaatgattcattctaaaatcttgtttgtttaattgactctgtgtttattgtttccacagggagctattgtttccacattggttccactagaaccttatattaaatgtatggtttacttacattaaatgtgtttgtactatagtaatttctaaagaaatattaatattaatcccaagtgctgcaattaaaggagtgagtgtgcccccaccatctggctaaaaaaatcttgatgtattaagtattttatttaggataaggttctgaaagggagggaatatttgagggaaaggaaatgggattcgatatttttatggagtgttatatttgtcttcgtattgctgaaaactgacaaatgcagtataaaattaataaataccagttttaatgtaaaatcttaatggatatctcatatttttgtatctgaaatggttctcaaatcctatattttatgctttatattcaaagagggattaatttttgcaagtttcaattaatttttttatatttgaaatactttataataagttatgcaagacaatttgaattgagttgttatagccattagaatgaaacaatgttttgtgtttaaaattgataaagtcactgtgtttgggacagggtcctaactgaactctgttaagtgaagtttttgaaaaatatttattttctatgaatgggtgttttgcctgcatgaggatatcatgtttcctggtactggagttacagatggttgtaagccaccatgtgggtgctgagaattgatcctagttcctttacaaaagcagcaatgctcttaatcactgagctatctctctagcctcagaagtaaagtttcaaagatttatacaactggacttatcgaaaggataccaaaatgcaaaacactggagtcagcttagattttgtggctaatgggctctggtaaaaggctctcagtgactgtagagatgaggcttaagaaataattggaacctaaggagcacctgttgcatgttttgcccattatattcagagctataattaagctaatgcttattgagttcagtttctgtaccaggctttcagcacacacatttggctttctctctaagcagaggtgcagactgaagctggcatctttctaggcaggtgctctgcggctgacctgcagtcccagtcccaggcacacatatctcacggatgctttgcccagctctagactttgtcgtcatttattgtgctcatgaacagaaggagagcactagagtatatgtagagtatacgtgtatggaagcctaactcagggccgcaccgcagaggcggagcccaagtggtctgaggttagagttcagcagaaatgttttgttttaggacttaacctcaatgtgaagattggtggtgagaacttaggaatcttaattctaagcatttctgtgctatagttccccaaaggaaaagggcctgagagatagtctgggaattgtttggatgcccagaactgggttacttctctaaaatgtgtccataaggtgccagcatgtgactggtagaggaagagctttctccttctttctccttgttacttcatagtgttgtggaaacacgtgtttgagaactgttgtagcagctatcttcctgagtatatggctcattaatgggtacatttaaataggtttggtattattgtttgtttgactgttttaggccagggctggttatatagcccaggctggccccaaattcctgcctgcaatttcaggcttgtgccatcatgtctattattaaacaagcttaaaatctgtgaggcttttaggttgacttagggtagatcagatgctttgttttctgacttgacagccatgtctttttgtgtatagggaagatcatgatctgtttggacattttagacagacggactcagagcttcttgagatgaacttgactgacgtgtactgactggattcgggggtggggaaccctagaaagtggagttcccccttaaatttgacataaacatttacttaagtctgtatttgaaactgtgtaatagcacaaaggtctaggtagatttaaaagcaagtctatgtgttttatagtgattaagttttgatttaagagatgagatggtaatgttagctgtgctgtgctaatacatcatgatgtctgggcacctctgctaacttaatgaacaattgaatcactgctgtaagtatcagtcttgtctgttactaaataaaattaatacagcagagccgtgctattccagtatccttgacatgcaaaaaagggacctctgctttaagaatcagaaagggtttttgttttttgttttcccgtcaagaaccacactagaaccacagaataccaaaacaggagagaggatggctaggaagaaggcacagagggtcagaggcctaatgaaaccaaagaaaatgcttctcttatggtttggtttggtgaactcccgatacatgagaactgaaactgtgtcagagctcagttatcttttcctacccatgcagctgggtgagggtgatttggggcagccattttgggttatttttacaggttctcagtcatggggtatgaggtgaggctgtcttcattgcttgtcattacttttgaaggtgccaaagggcagtggggaaagcacagtagcactctggagatgctgctaagaaaaaggagctttgtaactttagacagctcactcctcacacaggttttctgtctgtaagaaagccaggtcttagtgcacccttgaacctaaccttttacagaaaaacccctgtggcgaacattcctcaattccattgtatttccttgctctggtgtttgaagatgatagtaatttcctctttatcaaaattacttcactgctaaacaaagaatgtatgtagcaatagcttgaatattcagtggtagatgttaaaaatgttatttgtcattaacataaaccttcttatcactagcatgggcaccaggtttggtgggcacagaagaaattagaggctctggttctttccaggagaggtttgccctactgatttctgattcctacatactggctttcagacaacggtcactgaaacatttattcagttgaattaagtgggcagcactttaaaacacggtgtgattagtgctaagttggtaggataggcaggaagtgctgtgattttgaagggaaccaatccttatgggtttagacatgaagttggaagactttatgaaggaacttggaaggcagagggaagaggatcaggagttcaaagttactcttggctacatagtcagtctgaggcgatctggcctacctgagtccctttcaaggagaaaaaaaaagtgacttaaacattgacaagtgggaagataagattgagaggtgggaggggacattccaggaacaggaataataggaaaaaagaagggagacaaaaacaaagatgtggtggtcaggggaacggcggcattaggcagggctacatagaggaatggggctatgtcacaatgtaagggtaaaagtaagggatgtttatgccaggtcaagtatacatctgtgttgatacatctgagctcaattaacacaaacatacatttatacatatttgtcctctctaggcttgaaacaatgaccagactgtttaaagtactttgttgttgttgttgttgttttcaagacagggtttttctgtgtagccctggctgtcctggaactcactctgtagaccaggttggcctcgaactcagaaatttgcctgcctctgcctcccaagtgctagaattaaaggcgtgcgccaccatgcctggcttaaagtactttcttagtgttatacttaagtctctgttaaaagggttaggctgggtcagaattgagcagcactggcctgaaactgagttttgtgagtaaaaatctgacttgaattcctaacccttatttaattttgatttccagttatgggagttacagtgatctatgttgctctctaaaacctgggatatacggggaactggcctgactaaagtagtatacctgacctggctagcccttgctaattagatgaagttttccaggaaactgactcaccgtggctctgcattcccaaacttgtgtctttacaattattagcattagtcaccatcctttacttcaagtcgtcatctctttgaaatatttatactaatattataaaagatgtttcaaacaactcgatttttaaaaacatgactattttaaaatcgtaacttttcatatcacatttatgtccataaacatttaatgtttcatacaattgtagtaaacacctatattaattttgttagtggtagcattactttttaaaaaacactagtgtacaaacgtgtttggcagtccttttcagagcatgctgaggttgttttggctcctaggttgcatttctgttttctcctattgtgaagttcggccctttgcatggtctagcttgccgtgacgtggtcaagtgcagtttccttcctgtcgcttgtgttagcgataaggctacatttcagtactttcaaaaggaaggccccgaagacaggcttggtctagcggttttttctcaccccgggctctttcagcgacagaaaagtaggctctaatttcagctcactcttaaaagctcatcaaacagcatttgcaacctttaactgtcttcatttaggtatatatgatgggggtggtgcttgcatgttgctgttaaggacgaatgagtcttgttatgagatttagagagagtggtggttcctgtgcgtgtaggtgatcagctgggtcagtgagaagaatgaaattgtttgtatatgctctgctgggatttaaaatttcctaattattactggaacatccccccccccatacttgaactcaagtacacctcggggaagaaagaaaaaataatgagggagatatgttatcttaggaatgaggtcttcaaagaaagtgtcttgaaaaccaaaccactgtgtgtaccagcaatgctgattttccttaagtataacagtgacattggatatgtgctgtgtcagttgttacattttagccaggggattgcctttttaccactaacctaagcctttgtttttcagggacaagaagacctagtgaatgatttcagaaaacgtgcctgttttcttagaatgtcaatgcagcaagcaggtctgaaggactcctttcaccgaagagcgtcttgtctgcagtaacttcacagacctgcctgagaggctcttcccaaactccactgcaccctacctgctgctccagactggaagctgcttaggccttttctcatgtggatctaaggggaatgctttactatggctgctgttgtccaacagaacgacctagtgtttgaatttgcaagtaacggcatggaggacgagcagcaggtgagccagaaaggccagctttagtccacttcttaggagttgtcatccgcgtcggggtgtttgctttaggacatagtacaacattctaaaataaaaactgagaaattaagtatttggtagtaatgtcatttcatattttaagtaccaattaattcactacttgtaaatgttactgtttgttttgatgtggtaacaaggaagtagtatttgggactcaccttggttttctgtaaaattagaccaaatagtaactatccttagtaatatttctttaatgattttaaacagttctaaagaacataactgatgtccataattaatcttttaattatgagctgtttttttctaggatattaaacagttttggccacctcacaaccacacttttcagttcaaagactatgagctcccaaggaaatgttctgactcttgcagagcttggtttgtcatctgtaggggacttgaacctaggacttactagtcacctttcattgaatatgtatgtgatgtgttgcttactgccttcacataagtaaggtcccaagagatgctgaggtaaagggtttaaccctaactgtgagcctctgatcctcccacagtgtgaaagggctacacttcataattaagacaggcagtgcagggatgtgagccgtggtgtgggaattggtatgtcgagagaggtcctttgctaagaggcttttaggaagcagtggtttaaagtgtgctgaagagtgcgatttacagactgaaataagcttgctccccaaatcttaagtagatcagttctgatgtctgctttattccagaaacagttactacaaataataaaattgattcccagttatggcaggacattgtggcttcatagctgtttgtattgtgtactgaaatgatacaacatagagtttataagtattcctacaaaaggggagaatttgggactaactatccttaaaatcaaggtgaaatccaagggaaaaaccgaacacctgaaagcatattaatattgattggaattgaatctagagacaacagaggagatagtgtgaggagagggagtgtttttgagttattttgagacaggatgtttgtgcacacactaaagcttgaaaaggagtatgctgcctacctgctttctagataaaaggtcccgtgacaggtcccaggctaactgtggtgagctgtgctgtggcacagagacagtggcagcagaggacagagcactgatctgtcaccagcatgctctagtgtgctggttctcacactctgaccacgagaagtgcgttatacattccagttccgagttctcacgtggtataagactgaaaggtgttctgcataactgcctgtacacttactactatgttggatgtacttaatttagggttttttttttccttttatgtctttgggaagggtgctagtagtttgactcacctctgcttgctctgatatttatttagttgttgttgtgtttactttttttttttttttttcctgagacagggtctctctgtggagttctggcttgcctagaactccctatggagaccaggctgacctcaaattcagagatctgcctgcttctgcctcccaagtgctgggattgaaggcattcatttcccacatgcctggcccactttctaggtttttgagatgtgatctcatatagatgaagacagctttgagctcctggtttcctggctcccacttcctgaatgctgggccttcagatgtgggtcccacacttaccaactgctcttttcctttctcttttgtcctgttcttgtttctttcctttgcccttttttatttttcttccttgatacacttaaatactttatatgttaacctatgaaataaatgctgatagctttattttttgatgaggaaacagagacataaagtagttaatagtttgctcccagctgtctagccagtaattataacgcatgcagtttgactttcagtaatatatacttgcgggctgctctagctgggttcaggggcatccattgctcgtattatcaaattatttaaactgtggctctgcctccttatatgattttgttttcagttttattcattacttctgagatgagaccttatcatgtagccatgctcgccttgggtgtaagagtctcctgcattcatcctctgagggcagggattaggattgttcgcttgtgacgccataactggcctagtttaatttgtagttttacataaaagtagtgacctgccagcttaaaatcacatgctacaaaagtgcataaagtatgtcagatgtggcagcttctatctaattctaccactcagatggctgaggcaggaggatcaggaggagtttagtaccagccactgttacaaaatgggtttgataccagcttgcgactcttatctctaaaaaaaaaaataaaagtgtgtaaaatggtgtgtgtaggttctgcagtagttgtttttctatatttgagtggaacattatttaccctactagtctgtaactatgaccattcccagtgtcttgctgagttgtggcagtgagaaatcctgtttgggaatgccataccctctggagtggcagagatggttaggaactgagatactgaaatcggaatgcatggcttgataactagctctgttgcttagcttactactgcgatccttgcaaattacttaatcctctgtgcactggtttcctcatctgcatggcaaaaataaaaaccagaggagctaagctgtaggactggtgtgagggctgagtaagttgctgcttacagagctctgagaaccactcccagggcagagcttatgttgaccaaccaccatcttgtcagggcacctgtttccatacagcatggctctcttcccagctgtgaaggtcatctgaaaaatcactaaactgggatcgttgcatttgctctttttttttattagatattttcttcatttacatttcaaatgctattctgaaagtcccctataccctcccctgtatttgcttttaatcccagcactcaagaggaggagacagagccgggcgtggtggcgcacgcctttaatcccagcacttcgggaggcagaggcaggcgaatttctgagttcgaggccagcctggtctacagagtgagttccaggacagccagggctataaagagaaaccctgtctcgaaaaaaaaaaaaaaaaaaaaaaaaagaggaggagacaggtggatccctgtgagtttgaggccagcctggtctacatagataaatagtaaaatgacattttgacatttttactattttcatttacatttctataactactagtaatgagtagcatattggttttttttgtttgtttgtttttttgttttttgttttggttttttgagacagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagtttctgcttaagaaagcttttctttttttttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccaactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccaagaaagcttttcttaacactaatattattaaaattttcatctagtatgcttcacctctttggctcttcagctcatctgaagctcattttttacgtgggaggcgctacagtgatctgataactcctccccttccacactggtagtttttactctctacttttattgatttaaaaaaatttttctatcctaaaacttaattgttgtttaaattaccctagatcagacataacatttaaacttattgtttattgtataattgaactgtttttatatggtgccaatgttgcattgatttcattgtcactttatagatttggtgtaggataagttaatttccacttcaaagggtagtttactatttctacccactttcagcccaggaaaccactactttgctttctgtccttgtatatttgcacagtataggcattttgtatatggaatcataacctacacgttttatggttgatcccttcccccctttgtccctctcttatactaagaactaaacctagggctatagcctttaataaatgtgttcattcatgttgtgccatatatcacaggacaaattaccacaacacttacctctcaaaaggaaaaaacaaaacataacaaaaaccttaagaggatccttagtgagccttacttttgagagatgcatagccaaattaacaatttatcctgaccaaaaaaaaacaaacaaaccctttttcaaattcactccctcagactgggcagtggtggtctatgcctttaatcccagcacttgggaggcagaggcaggcagatttctgagttcaaggctagcctggtctacaagggctggccttgagctcagccagggctataaagagaaaccctatttcgaaaaaaaataaaaattcacatcctctgttttcattacttgttgcagtatggtatgtgtgttgtcttagacagtgttttgttgctgtgagcagacaccataactgtggcaactcttagaaaagaaagcatttaattggggcttgcttacagttttagaggtttagtccattatcatgtttggaagtgtgatgatgtgcaggcagacatggtgctagagaattagctgagaattctgcatctgagttagcaggctgcaggaagagaaagtcattgggcctaacttgggcttttgaaaaccataaagcccacttccagtgacacacttcctctaacaaggccacatccctagtcctttcaaatagtcacttcctggtggcaagaaagccagtaagattagactatgtttaaacaacttcataggaatttacaatgggaattccaatgtcatcttgggtaagcctagagaaaagatagtttgcttagacctttaggttgttttgttgctgtgtctttagctaagtgtctttagaagtgccttcactactagagccagcggatagaaaatgaactctggtgagggctggtgagatatggcttagcagttaagagcactgactgctcttacaaaggtcctgagttcaaattccagcaaccacatggtggcccacagccatctgtaatgagatctgatgccctcttctggtctacagtgtacttacatataaatctttgggcaggagcgagtggggccagagtgagcagaggtcttgagttcaaatcccagaaaccacatgatggctcacaaccatctctacagctacagcatactcatatacacaaaataaataaataaatcttaaaaaaaaaaagaaaaagaaaatgaactcagtttgctgtgatcctaaatgctgggttcatgatgaatatagccatctatacatcttaaaacccaagctttaactgagatgaacctgattacagtgatagttcaactgaggagcctagactgcattgcattctgtggtggccaaacttgctgactgagcaaggtgtagtcatattgtctgggtttagatcttaggtctgttgcttctgggcagcttggctagagagtgtcgggtcgggaaatacggcataatattgtggtgctccagtggtgtaagccatctctcttagggttttattgcggtgaagagacatcatgaccatggcaactcttataaaggatgacatttaattgtgagtggcttacagtttcataagtttagttcattgtcatcatggcaggaaacatgagcacgcaggcagacatggtgctggagaaggagttgagagttctttatcttgatctgcagtagcagaaggagactgtgtgccacacatcagcatatatgacctgtctccacagtgacacatttcctttaacaggccacatgtccgaatagtgccactccttatggccaagcattcaaacatagggccattcttattcaaaccaccacaccatccaaagtccttagcctggcagctgctttttaccatggcttttgttaaaagcatcattttaaacagctttcaaagatggagactagagtggggttcagagatggctcagcctcttgattttctgtagtataacattataacatgttacttgataactaaaagacttagaaatttttgcttataatagactttatagccaagaatggaaagggacccagaatcactactcttcaacattatgtttaatatatgcttggattccaatttgatttatgcatattctttgagatgacctattaggggataatttttgttgttgttgtttttgtttgtttgtttgtttttgtttttcgagactgggtttctctgtgtagccctggctgtcctggaactcactctgtagaccaggctggcctcaaactcagaaatccgcctgcctctgcctcccaagtgctgggattaaaggcatgtgccaccactgcccgactgataatttgttttaatagctgctcacctgtttccttagtaagcttgacaattctgcacttggtttgtttgatgagatgtctgatagatgctgacaggatggtgcaggggctatgtggacttgtacaggatctgggctgctgctttgagttatgctttgtgtttttagaattataggtatctagactaaatattttgcttaaaatgaaacttcctaagcagcaacaaaagaaacagagtaaattaaatactctccacatacataaaatgaataggcccaaataatttaatggtgagttattttaaactttcatgaattatttgaacagtttccattcagagtttcttaagtcactttttacagtgaacataacagtgatattcaagtctggccaactgttcacagccacgtgtgcagaatcagagggctccaagtagacaccttgtttacagtactaagagcaggcattgctgtttctgaccattaccaccttggaggtgacagcgatttttctcttgagtgtcaacagaaccatagtatcttgatatccttcccatataatgaaggaaagcttttcaagtgaagagtctcaggagaggttgaaggagtaatagtgtccagagacacacagcacttgaacaggaatgactaaagctcgttacacctttggatgtatctattacttgatgtgcttgagtttattttcactgaaaaacaaaacacaacagcaatgtgcacacatggaaagagaaaggggagggcaaagggagtcaaaacgaaagaccatccaatcagtaaaaaatcatataagccaatttttctttatatcatctatctattcattatgtaccagtttatgcattatctgtcttatctgtctgtctatctaatctatttatcttatctaacttacctacctacctgtttatcacgtatgcatcttggtgtagatatggaagtcaaaggacattttgtaggaattggttctctctttttactctgagtcctgaggatcaagctcaggttgtcagacttggtggcagagagcttttcccacggagccatctccctggccctaaaccaatttttgagattacttatttcatcggtgtatgcctgcaatcccagaatttgagagttacagacatgaggatcactgttgaattcaggaccaggcggggaaaagggggtagtgtgtgcactcatggtatgtacccccctcacagatttattaggctcagtggtagagtgtttaccaaacatacaagaggcccagcccctaatttccaaaaagcaacaaaagaaaaacagaaactaaaggatcctgttcctatttaggtaaaacactaaacagcatcatcggtttattttcttgagtacactctacatgccttacaattttaaaagttatttagctccatgttatttaattcctacagtaattttcaaagaaggtatcacatgtatttttcttaacagacacagaaaataaaacttagagagcctgcctaatttgaacacacaaattgattttcttccaagtgtgtttaaatactcagagtctttacagccatccattggactgagcatagggtccccaatgaaggagctagagaaagggcccagggagctgaaggggtttgcagccccataggaggaacaacaatatgaactaaccagtacccccagagctcccagggactaaacaccaaccaaagagtacatatggtgggactcatggctccagctgcatatggagcagagaatggcctagtcggtcatcagtgggaggagaggcccttggtcctgtgaaggctctatgccccagtataggggaatgccaggaccaggaagtgggagtgtgggtgggttggtgagcaggggaaggggagaagggataggggattttcggaggggagaccaggaaagggtatatcatttgaaatataataaagaaaatatcaccgggtggtggtggtacacacctttaatcccagcatttgggaggcagaggcaggaggatttctgagttcgaggccagcctggtctacaaagtgagttccaggacagccagggctacacagagaaaccctgtctcaaaacaacaacaacaacaacaacaaaaaaccaaaaaaaaagaagaaaagaaaatatctaataaaaagaaaaaaacacagagtctgagtatttactggtatatcgtcttttcacatgcatatttgtaatacagttggtgcatggcaaaatactgtcagagcatgttatgctagtacacgttctaggcttttgttttttttcaaaatccgaagttaaggaagtcatttcaggaataaatctgaggtcttcagatctttggaggcttgggctaggcccagcctgactgaaacacaggacacaggaatttgtgtgaaagtgtgctttgcttagcctctctgttactagagaagtcttagagtcaaggagattttgacgatgatggagaatgaggcaccagccttgtcagggtgaggagtgtgtgcgtgtgtgtgtgtgtgtgtgtgtgtgtgtgtgtgtgcgtgtgcgtgtgcgtgtgtgtgtgtgtgtgtgtctgtctgtctgtctgtctgtcttggtacaaacataactacttgaaagcatgcttgccttacaattgcttttgaaaagtttctgcattggggaatttattttttacaatgataaatttttttcttccttttcttcttcttttttattaaatttatttattcactttacaatatcagcccttcctctcctcctagtaccccctcacatatgtcctcccccagtccctttagaaggggaagccctgctctgagtgtcaaccccactccaccactccgcacattgagttgctgcaggactaggcacgtcctctcccgctgaggccagaccaggctgtctgtttaggggtgcaggatccacaggcaggcatataggcagcaggctcagggacagcccctattccagttgttgggggacccacatgaagaccaagctgctcatctgctacatatgtgcagggggcctaggtccagcccatgctttctcttggttggtgattcagtctttgggagctcccaatggttcaggttaggttaaatctgttgatcctgtggagtccctgtcctctttgggtctctcagtttttcttccaaccctcttgagtgactccccaagctccatctaatagttggatgtgagtctctgcatctgtttccattggctacagggtggcgtctctcaggatagttttgctaggattctgtttgcaagcataatggagtgtcatcaatagtgtgggggattggttattatccatgggatgggtctcaatttggggcaaccattggttggccattccctcagactctgctctgtcattgtccctgcatatcttgtaggcaggacacatcttgggtcaaaggctttgtgggtgggttgctgttattatctttccactggtagtctgtctagctacaggaagtggccacttcaggatccatatccctcactgctaggaatctcagctagagtccgccccctttagactatctggggcctctcccctttccaggtctctggcacaccctagagattgctcctgtcccccagctgatctcatgtctctctcccctgctctccctacatatgatcctcccccgccccgcttccctccccatccctcttccatccagttcccctcatccatagacctcccatatctattttgtctccccttctgagaacgatccaaccatcttcccttgtgctctccctatatcttggcttccttaggtctgttgatgattgcatggttatcctgtagtttacaaatgagtacataccatgcatgtccctttgggtttgagttacctcactcaggatgatattttctaattctgtccatttgcctgtgaaattcatgatgtctttgtttttaaaaggctgaataaacagtatttcattgtgtagatgtatcacatttcttgtatctattcttcagttgacatacatctaggttgtttctaatttctggctgttatgaataaagctgctttgaacatagttgagcaagtgtccttgtggggtggtaggacatcttttgggtatatgcccaggagtggtatagctgggtctttaagtagaactatttccaattttctgagaaaccaccaaattgatttccagagtggttgtacaagtttgcactcccaccagcagtggaagagtgttccccttgctccacaacctcaccagcatgggctgtcctctcagtttttaatcttagccattctgaagggtgtaagatggaatctcagttgttttgatttgcatttccctgatgacttaggatattgaacatttaagttcttcttggccatttgagattcctctgttgagaattctctgtttagctcttgtcttggtcagggtttctattcctgcacaaacatcatgaccaagaagcaagttggggagggaagggtttattcagcttacacttccatattgctgttcatcaccaaggaagtcaggactggaactcaagcaggtcaggaagcaggagctgatgcagagccatggactgctttccctggcttgctcagcctgctctcttatagaacccaagactaccaggtaccacccacaaggagccccttgatcactaattgagaaaataccttacagctggatctcatggaggcatttcctcaactgaagctcctttctctgtgataactccagcttgtgtcaagttgacacacaaaaccagccagtacagctctgtaccccgttttttattgggtcatttggattattggtgtctaaattcttgagttctttatatattttggatattcaccctctggtggatgtagggtaagggaagatctttttctaatttgtatgcaggctgtcattttgtcctgatgatggtgtccttttacttagagaatcgtttcagtttcatgaggtcccacttactaattcttgaccttagtgcctgagctattggtgttctgttcaggaagttgtctccttaccaacaagttcaaggctattccccactttctgtcctattagattaagtgtgtctggttttatgttgaggtatttgatctatttggacttgagttttgtgctgggtgataaatatggatctattgctttcttttacatgcagccgttcagcatcatttgttgaagataatctctttttttccaatgtatggttttggcttctttgtcaaaactcaagtgtctgtaggtgtgtgggtttatttctgggtctttgtttcaatttcattgacccacctgtctgtttctgtattaatatcatgcagtttttataggttttcttttgtttgttcaagatcattttagccattctgggttttttgtttgtttgttcgtttgtttgttttttgagaaagggtttctctgtatagccctggctattctggaactcattttgtagaccaggctggtctcaaactcagaaatccgcctgcctctgcctctcaagtgctgggattaaatgtgtgtgccaccactgtccggcttcattttagccattctggattttttgttttttcttatgaagctgagaatttttctttcaagacctgtaaagtgtgtgtgtgtgtgtgtgtgtgtgtgtgtgtgtgagagagagagagagagagagagatgtgtgtgtgtgatgtgtgtgtacatatctctgtctgtgttgatacaaatatatattaactacttgaaagcatgcttgtcttataattgtttttgaaaaaaagtttctgcattgatggaattctgaaagactttttaccctgctgcttgtttgaggaaagtgttttgcttctgggctgtgagctgttttctagcgagctgtgcagggtgtttcacaatcaccatggaacagattgagagctgctgttagggaaacttggcaaacgagttgggtgagtgctcttgtattttttaatatccgaaagcttgttgaaaacgtaaacttgcttgacagcactgaggtagcactctgtagtttttgagtctccatctaggactgcagggcctagaattaggcaagcttactagcagaaacacatactgtatggcctccattcggttccttcacttctcctttaagttgatgatattggctcatgacttacgtgacgaaccatgactaaagtaaactacagggacagtgttgaaatgtgaggaactgcccttggtttgatttgtattattgctgctaaaatgttggctgaaattttgcttttaacatatgctctaggatttacctgtatataatatttctttcctcttgagctactaagaatcccagtaaagttagagaaacccatggaagtcagtttttctctctatagtgagacagacttttagaagcagatgctttggagcctgattggacagacttttgattccaggaaatcttttttctctagtcctcagggtctgtggcttgctttgtttctgttccacaaacaaaataaaaattatgtacaaatggcaagtaatggaagacttgtaatatatgtttagatatctgtcacgtagagacgtgcacaagtaataaagagttgacaaatgcagtgttgaatagtcctttatatcagtgctcctagactctgtgtgcaaattggactcacttgggcaagtttatttataggtcctggccatatccccagatactctgaattatctggtacttatttggtgttttaaaatgtttcccagtgtacagacaaggttaagtaatgttaggatttagtgaagttcttctcaaataacaggtagaattgggatgtggatcagtggtacagtatctgcttagcatgtgggatgccctaagttttattttctgatttccaaggatggggctgggtttaaggaggtagaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttataagcaagcccccagttacatgctttcttttataagagctgccttggccatagtgtctcttcacagcaatagaaaaatgcccaagagagattgttactttatttctttaaagaaacatcaggactacaggtatagctgaggtataacacttgcctacatgctcaaagacctggggttgataccaacacaacaacaacaacaacaacaacaacaacaacaaaataatgaataataaaagtagaagttttataaaagaaactacagattttccttaggtgttgtcatcattttataaataagtttttatttatcttgagttgatattgtctcatgttggtttcaaactgctgtggtcaagtacattctttgtcttagtcttcctggtatcatgttatcatgctggtaacaggagcatgttactgtgctcagtgttctgacctcttgaaactcttttctaacgtctttctggaaaaggagttagatttaaacagtggagaaaaaaacgtgagttgaaatatgaagagtaaagtctattcttaatttaaaagcagcatcaaatttatgtctgtatttttattttcatcaggttttggttgggatagaggcagtagatgtaaagctagtttaaattgggtcctgttaggggtagaatctgtctaacttaacccctcttcatctattgaagtcctaacccatgttaccatagtgtaacagacctcatccggaagcaggatgccgctgctgatgtagttagaatgaatggacctactacaaccacccactacaggggtggttgtttatagaagggggacgctcagaagggaaaggtgggaacatgggaaggatgtcgcgtgagcgtgaaggcagccaatacaagtcaaggagagttgagtagctctgcagaaggaaccagccatataccaacaagttcatgttgaacccagcctttagaactgtgagaagacattactgttgttgaaggtatttagttgttggtacttattatggcggttcaaacagaacttttggtttttttacttactttaaaaatctaaatcttagataattcaacatgtgaaatttatatgtttgcccaaaccatcttttcttcatggccctggtgtgtagatcctggccttaactttcagcaattctcctgtctttgcctctatagagagcacgaagggctctgtgaggagttttacagtgtgttgttctgaaggtttggattcttgatgactcatactttagtcagctgctagtcaatccagagaaaaggcaatttatcttgagttcagatcaacagttactggagtttgcattttctctccatttatggtaatagggcccagcgtcttgtattcacctgggaggtgttatatactttcaggtttcttactttactacttctattgttaatttacttgtgtgtgtgtgtgtgtgtgtgtgtgtgtgtgtgtgtgtgtgtgtgtttgcctgaatgtacatctgtgtagcacatgtgtgcctgccatgggaggccagaaaaggacattggcttgttaggaatggagttgtgagctcccatgtgaatgctgggactcaaactcaggtcttctgaaaagcagccagttttcttaagcagtgagccatctccccagctccttgtattcttacgaacatatgacttgcttattttatgtgacttgatagcaccttgaagaagtgggaagtgaaccactttgaaataagctcagaattctttttaaaaaattgaaattatgatataatttcaacatttctcccttccctttcctctttccaaaccctctcttatacccatcttgactcaccttcaaattcattgcctctatttttcacttgttattgtatgcatctatgtgtatgtatgtatgtatgtatgtatgtatgtgtgtgtgtgtatatatatattcctaagtatgactagctcagtctgtatgatgttacttggatatatgtttttaggactgaccatttggcactagacatcaattagtgagctctttcagttctttatatttgtccctccccctccccccccctccctgagagggactgttcagctcctgggtattcccccaaccctgacagatcaagtctctacaaaattaagcacatcctctccaactgaggccagacaaggcagccctgttgaggaatgtattccacattcaggctacagctttagggacagccctgccccgctccagttgttgggggaaacccacatggagactgaactgcacatgtgctacatgtgtgctgggggccacagtccagcctgtgaatgatcttttgttggtggctcagtctctgagagctcccaggggtccaggttagttgactttggtggtcttcctgtggagttcctatccccttcagggccttcaatcgttcccccaacaattccataagagtccctgacctctatccagtgtttgtctgtgggtatatgttcatgattttaatgagacacttaaaatatcttagcaatagaagactataggtataaatcaggagtgatccccagagaaagtaataatgccaagaaagtttatagcagactgatgtaacagtaacaaagataatgttaaagctacactgtaaagtaatcattgcttttatttcctcagaggaagggatgagaagagagctgtatccatgctataagaaaaatggcttgtgctgagcccagagcatttctatctaactagccctagctctaggcctggaagcttcttgcttccgtacaacctaatcttctgaaagcctggaccctgaagacttcagtttccagtctctgtctgctaacctcggcctagaatgttttagcttctgagagttactgctgaataaattcactccttttagctctttctgaactctggctggctggttcaactcagctattctggctcaaactcctctccaagctaactgatgaaaattggcttcgcttggcttttgactgaattgctctgctgggaaagactgcctctgaactccatgaactgagcttctttaaatttaactgctctgctctgaactgaccccaactgcactctacagaactgctccaaactggactgaaccgaaccgaattccctctccctcagtgctctttaagttgcttctctttgctgtctgttcccgtgatagtagggtatcctatttctgactcattctgtcaaatctttctctgactgtcactttgcccgcctttcaattagatgtcattgtttgggtatattattctactgaagaagggtctgacacttgaacccaggccttgcttatttaggtagtccagctggccagcttgcccaaggggttcactgtctttaactttgcagcattgggattagaggtaccccgcaacctgacatttatgggggcccgaactccagtcttcatgcctgcatagctagagctttatctacatttaaaaagtattttagtgtgcagttggttggatcagtgttattcctccttgttttgtctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagttcgaggccagcctggtgtacagagcgagttccaggacagccgggactacacagagaaaccctgtcttgaaaaaccaaaaaaaaaaaaaaaaaaaaaaaaaagtgcctctgacctcttcagtaaggacgtgttctattagctggtggcacatgccagcacgtgggaaataggggcaggtggttcccacatacagcttcctcagtctaatgtataatgtaactccgatgcatgttctcagggctgaccgattgttactggataaccaatggagggatcttcatggggaagtctctctctcccactctcacagtccttagttgactgtcgttcttgtggagggttgaggtcttatgctcttctgaccatcggggtgggggtgggacccagtaaagagaacaccaggatacaaatgatctgatggggaaaggggttctaacaagggtgctgggaaggagatacatccagaaggagcgaggaggtaaaataaccgtaaggatttctgaaaaagtcataaggtgtcttagtttgggttttattgctgtgaagagacaccatgaccaaggcaactcatacagaggcagccatttcattggagcggccttaaagtttcagatgcttagtccattatcatcatagtgggaaggatggcagtatgcagtcagacatggtgctggagaactgagggttttatatcttcatcagaaggcaggcaggaggagattttcttcgatgcatggagcttgcgcactggtagacctcaaagcccacccccacagtgacacatgtcctccaacaaggacaaactcttaatagagtcgctttagtgggctaagcatattcaaactaccccaggaaggtcaaataacagtgaagatgtctgtaaacgtcgttaggaatcatactattatctacttttaaaaacttataatacatgtaattcttcatatacatatacacatatcatttaaatgaatttttaaaaatctaggctgacgatgccccttccaagagctacagattatctaacaagacccccggtaccaggtatgagaagccctgtttgagttgttggtcagggctgtccgagaaattcccaaaacattatagattattgctattgaccttggctgctttctagagatagaaattattcctgaagacatgcgctttagattacaggcctctgacctgaacctgacctgagtgctcctccctgatgactagctttcatggtactagaaggtaacaaaggagggagggagccaacaggcctgtccagctgtgacacctataaactccaacaacaaccagcatggcatgataaccctaagaatgcagtagtagcacacataggatgcagtagcggcacacatagggtacagtagtggctcacataccttgctggtaaccaatggctctcttattgaacttaagaccttctcaacaagagggaaattatgcctggtactgaaatttttctttataaattaaaaaagtattgtacgaaacaaactatctgatgtatacatggatgatctctgccagggaacaaagaaactggtgattgtagtttcctctagggaggagagtgctgtggtagaaaatagtgatatttgacagggtgtttgtgaattatgtggaaaaatagttagctacacttagtgatagaatagcagctacagttttgaggactagaacaaagaagataataataacaatatctagttatttaaaatataggagagctggagaatgagtcatttgacaaagccatgaggactgagttcaggacagcagcagccatgtgaagagccatgtataatggtgcatgcgcacagtgccagcgccggggacacagataggaggatgccccgagctcactgttaggtactctcgctgaatctatgagctcctggctaagcgagaaacctcatattacaaaacaggtacacacaatagaggaaaacacccaacacggacctctagcttgtggatacaacacattcagacacccaaatggaggagctatatagattcagataaagttgtcaagatgtttcttgtaatatttatgttcttgccagtctgtgttcaaattgcaagaactaggtaggtttgtattgggaggaatattccagttttatttggatgagtcacacccacatgtgagttgcatttgacatgcctctttcttggatttagtgagtgaccttgggtgtgttcttaacccagttctttatctgccccatctttaatagatgggatggtgagctctgttcttaccttgtacagaataaggtgaaatcctgtgaaaaccctctgaacactgggctcatcctctttagaaatggatttggagctcctaagagagaagagagggtgaagcgtttcagcttgctggatgttcacaccaggctgtgctcaagaaaaagaaagggacagccatgatgaggctcagaagataagagctcacccagggtcagactctgtgacttacttgagaggagagaaccaactcctgcctctgtcctctcacttacacacacatggcctcttctaaaaggaaacccaaatgttaatattttgctttgaaaagtaaatgttttctctaccgcttgtgtatgtgtttatgtgtttcacaatgtaaattcttaagcccctagtttcagtttcaaaattagttttacaatttgaaaagccagttagttctggctaacttttctgaaacaggaagaaacattttgaagtaagaccaaatgtgcttgaagatcattgcctataagtttcattgcatggcattcttgaaggtaaggatactatatatattaactttgagtaattacatttttatgactcaagtaatacctggccttactctgcagttatgtaaacatttactttaaaagagcgacactttagtatagagcaaaggcataggtaattccagcgtaacacactcgacagaagaaaatgtcactttctatataacaggagccttttcccactttagtaatatgtactcatgaggaacaaaacaatgaaataagtaggatatttactaaatgaagccacggatcctaaaatgaatccagaactaaattctgttgttggagttcaagttcaaattagcccatataaaagacacacaatccagatattttatttataagccaaatacttagactagaactattctaacttattccctggctctaatgctccttgttacttgcagtttctcctggccaaacagttctggtccgtggcggctttctcctctcttgtctgtcctcttcttcccctccctactcatggggcaaccacaccttaagaaaccagttttagcaatgggatacaaacagcatcagacccacccatgacaaattcctcccctgatttttttctcttctcttaccctcccctgtgacgaccattagtgagatgattaaggggctttgaatcagattttcagattagttactagtagaatagttcctccttctaatactttgtccatattcatttgtgatattttaaaatatttgtgatactgtatagagataccgtatttagtgaacaagccagtattttgggctagaaaggtagtctgagggtggaaagatggctcagcagctaagaactctggctgttcctccagaggaccagagtcacttcccagcagcacgtggccgctcacagctggctgtaactcccatatttcagtttaagggggtccaatgctctgggctcctgagaggcactgcacacatgtggtacacagacacacatgaccacaaaacacccgtaaacattaaaaaaagagataagtctacaaccacttgaaagcaaatcagaaccatgtcagaagataatagagatgcttaccttagaactagaggagtatgaattaccggtcataggaaaatccttggatgtagttttacacgttttctaagttagagattttttcaaaataacaaatgtaaaggaagccaggcatggtggcttatacctgtttccctgcacttgggaacctgaggcagaggagtgctgtgagttcaaggatactctggactacatagtgagttgcaggctggcatgagctacgtaacatcatgaaacaaagcaagacagaaaggaacaaccgagttgattttcagtatgtcgttaaaaacctcctggggaagttttctcagtggcaaagtgaagtagctggatgaggttaaaattttcaattctgatatgccataaactgtgtttttgatgttattttgagacaggttcttagcacatagctttggctgggctagattcagtgtgtacatcaggctattccctgacacatggagctggaacagcctctgccccacccccccccaagtgctgggattaaaggcatgtgccaccacacctacctaaaagtttgtaatcttctaaacaggaatcagtaggaaaatttcacgacacagtcatcctaaaggaggacagcagtagaaaatgaaagttaattgtttacatgtgctaaaatcaggcttccatgccaagtgtaactaaaccgagattcttccagtgagcaggaagctttagtaagagcttatttaattattcatccattgcatttcacttcctggctcatgctttggcataattttaatatatatatgtatttaatatatatatataatacatatatatattaattaattctgtgccattttaagatgtacttttagaattaaccaatgagaactgttattaagctgaagaatctgacgtggtgggcacgtggtgggcacgtggtgggcacgtggtgggcacgtggtgggcacgtggtgggcacgcctgcaatcgcagtacttaagagatgagagcaggagcatcaggagctcctggtcctctggtaaacagcaggcagggtagcctgagatacacagagcccgcctcttaaaaaggaggcaagactactgtttgggtgttagaagttcacagtcctcacagcataaagggtggttaaaatgtaagtggtggagaaggtatggtggggtatgcttgcatcccagaatttaggggagtgagtttgagatcatcctggcttacgtagagagatcagtctgtctcaaacacacacacacacacacacacacacacacacatgggcctggggggcggcgagacgggactaaatagggttgggtatagatcagtggttgagttcttgcctaacttgtgttaggtcctgggtatagtttccctttaataaaacacgagcaaataaatactacgagtgtcaagtgttttatgaaaaagtaaaatggttctttgattgtatccaaccaaagcataacttttctctttctcgtcccttccatctcttgcagcttggtgatcctgctatatttcctgctgttattgtggaacatgttcctggtgctgatattctcaatagttatgctggtctagcttgtgtggaagagcctaatgacatgattactgagagctcattggatgttgctgaagaagaaatcatagacgatgacgatgacgacatcacccttacaggtgtgtgtgcgcaccgcaggccaaatgctcagggtctaggccagggggttctaggtgcttggccttttcccaaggatttgaaaatatggggtcacacagatttgcaaaggtaaggtaagttgttcatagcagaacagttatagagattatagagggatagcctatcaagactgactgtgagctacacacagcatgagattattcaagggccccaggataaaacttagggtctttttaaagtggggtttaaaaaaaggaggggctgagtactgaagggtatagctcgtgtgcttctttactttaattgatagattaggtatataattatcttttctattaatcattctccaaagcatgacacacctggttttaattataggcacgataataaatagaatgagttctctaacaggttactggcagctttgccttgctgtgcatgtacctgaacccagttcagggtggatatgccttctatttcttatacttagatatactggaaacacacttgactacagtcttctctcaatttttaggatgtggggaatttatgttatgggtaagagatgtgcagcctggtgtaggtcagggtggagggcttctggggttccgtaatgtattgtaatacatactatgcacaccccaccattctgccttagcgtggggcatgatacctgacgcacagacgtattcagtgaaaacttcttgtatcagtagcttatgctagcagatattaaaactgaagttagaatattgaaaacaaacttacactaatgaatgaataagtgaattattagaactgaatatgtctacacgcgggtgcttgtctttttaagaagttaacacatgatctagtgccattttaaattagaacaggaaggaaaaatgactgtgtggctatttggtgagggagagaaaagaaagaaccctacctaaaaattataccaaacgagtatatggcttagaggttaaaagcactggttgctattccagaggacctggttttagttcccagcgctgaaatcgtagcttaccaactgtctgtaattccagctccaggggatttggtgccctcttttgacaacctgcaccagacatgcatatatggtattcagacaggcaggcaggcaggcaggcaaagcacttacacacataaaaataaatattttttaaagtactaagacaacaaagtagatatcaaatcaataaaatgtttaatataggaaaaaacttttaagccgggcagtggtggcgcatgcctttaatcccagcacttgggaggcagaggcaggtggatttctgagttcgaggccagcctggtctacagagtgagttccaggacagccagggctacacagagaaaccctgtctcaaaaaaccaaaaaaaaaaaaaaaaaaaaaaaaaaaaaggaaaaaacttttaaaagttatggcttgatttatgtaagtagcaaaaggttttctatgtgtgagaaggagcagaaagagcattgacattttcagcaaacattgcaaacatttttcattccttccccaaattataatcaaaataaaaagggaagtgactgtgtgaagaaagagcttaaaagtaagcaactgtaagtggacacagaatttgattagttatgttaatgagtaaaaatataaatgtctaacatgtatgagcaagagttattgcttagtaaacacatatgcatggtgtgatgcagggcggcaaggttataagcccggcacttggggagtaggacaggagaatcaagacaagcctcatgataccacgtctcagaagaaagaaaagagcaatagtgtggcaagaaacgacagatcaacaggctcctccctagtgaaccagaaaggcctggtgtcagaaagcaagcctattttaaaagccaggttatttgtgtcttctcttcctttcttttctcaccactccagcccttaccgcctctctgcttatctaagatgagaagggaagaagggctaattcctgtcattccagagttgggaaggtagtatcaagcctttgagaagctgggggaaggaaggccgagaaggacaagggctagaacggtaccgccttgtggccagagctagtataacacagtgcctcccactgtagctggcagaaaaacatttccttgtaggttaagatgctggcctgcttggtttctttctcccatgcttactgaagactgtcttcttccttgtcttcagagagtcttcttgattactgtccaagtccagatttcctagtgggttgacaggataatgatttagtctactgtgatgacctcattttaactggactctctactttctacacgccctctgtcgtgtctgtcttctgctgcttgctttgcttatggtaatggttgttcctgctgctggggatggaatccaggacctgtgtatgtgcagcaagtgctctcctgctgtgtcccatcaccaccgaaaggaatttgagggataaaaatgacaatatggaatcatttgatgttaatttttaatacacgatgttatcgttgtgttaggctccttttagaaaacatgctaaaatacttagagataaaatatggagtagcaggcccagactgtagtcccagacttgctaggcagaggtagaaggatcagctgttgtaggccagcctcagctacataacgagtttgaggccagcgtgggctataataaggtcctgaattaaaattgaaagagaaacagggctggtgaaaaaggctcagagagagaaagcgcttgctgccaaatgcctggtgagtttgatctcggggacacacatagaaccaactcctccagcctgccctctgatctccatacacatgctgtagtatgagtgtacatcctgcaaataaataaaagattgcaaaaataacagaacaaccaagcaaatgaataaaagtggagacttggatcccttcgcagtggtcctttgtagagagtaagcactgtgggagggtgtggacgaaagatcaacaacttgttgattgtgtttgaagctgtgaatgaacacagaggcctttattatgtcttaggactttgatttttccaaaatctctaataatatgaagcttagttactttatggtggtgaatgcccgtgatctcacaatttaagagggagaggcaggaggatcactataagtctgaagccagcctggtcttacattatatattttgggccaactatgactgtataacatagactcagccagagaagggctggtgagatggctcttattgtaaaagtcaaatgacctgtgttcagtccccagaacccatgggaatggggaaggaaaaaatacttccacaaatgtgtcttctgaccttcctgcacactttgtgacatggtccagacacacatcacacacacacacacacacacacacacacacacactaataaacaaagcaaaaggcagttggctggtagctgacacctggggttcccagcacttgggagggtgaggcaggagcatctcagcaagtctgaggctagcccacactatagtgcacatcttagtttgcttctttattgatgtgataagtaccatgccccaaaacagcttggggaagaaagggtttatttggtttacacttgcacatccctcagggaagtcagggcaggaactcagacagaacctagaggcaggaacagaggccatgagcaatacctagcttgctctgcatggtttgctcagcctatacaaccccctggtcttttacatttattctttattttatgtgtacaagtattttctctatgtaattttttttgtttttgtttttgtttttttgagacagggtttctctgtaccgccctggctgtcctggaactcactctgtacaccaggctggcctcgaactcgaaatccacctgcctctgcatcccaagtgctgggattaaaggcgtgtgctaccactgccctctctgtgtcatgtaagagtgtatcatatgccttcaggtgcttgaggagaccactagatggcctcggcctcctggagcttaagttaaaggtggctgtgacccaccctgcagtgctgggaaacaaatcccaggatttctcaagaacagcaaatgcccttaactgctaagctatctctctagactcccacctgcacctgctttcttatgcaagccaggaccgcctacccaagggcggtgccacccacagtgggctgagcactcctgaatcaatgcaggccagtctgatgggaacagtttttcaactgagattcctactttccagatgactcaggcttgtcaggttgacaaaaagcaaaaaagcaaaacaaataaaacaaacaacaccctctgccccacagctagcataatgtgaaaccttcttcatattcacctcatatttattattatggcttatgttctgtatcttatagtttatatgcatgcaagctacaagctcaatattaaatggcatgtcctggttcaggacactgtggctgaagttcggagaagcacatactgtttcagagtagctaatactattctttctttattgcagttgaggcttcttgtcataatggagatgaaacaattgagaccattgaggctgccgaggcactcctcaatatagattctcccagccctcctgtactggatgaaaagcaaatcagtgagtgctaacgaccgctcctgtctgtgttcactgcgaacttacccttgccctcccctttagagatgcttttcttttgtgggtcccaagcacattgtaaaggacagattctagttgtggtgcccttgctaaacgtcctgtttaactgacactatttagaataaaaagtaatatgtctcttttccccaacataatattgtttttgttatttttagaatttcatacaatgcatccccatcaaacttgcaaactcttgcctcttcacctgtttattttttaaaagtttatgtacattagtgttttcctgaaagtaaacatgtgcattgtatgtgtgtagtatcgatagaggccgggaggagtgtttaatatcccagaactggagctagagttgtaagtcatgatgtgggcactagtaacttggaagagcaccaagtgttcttaactgctgagcctctcactgggttttaactggactagtataatatagtcatctctacagataattgtattgaataggcaaaaatgtcctaaccatttgttgtataaaattcattgccagcttattaacctctctttaaatcgatttcttctttgggcctttgacaagggagaactgaaacttacaggcatagttactaagaacgttctgcatgtttgatgtgcacagtggtatgtgaggctatgtatggtatgacataagaatagctattacttctttcttcagttttatggtttaatcccgaagtcactcatgtgcgtaagggagtataaaagccagaagcaaaggccatggaagtgatagcatggtgttctggagggagtggtactcttgctgtatagagagaatgttttaaacaaatgacaagtagacttcattagatagagaagacaggccgggcagtggtggcgcacacctttgatcccagcacttgggatgcagaggcaggcggatttcagagtttagggccagcctggtctatagagtgagtttcaggacagccagggctacacagagaaaccctgctcaaaaaatgagagagagagagagagagagagagagagagagagagagagagagagagagaagacagaaatgaatattcaacttacaaggagtagatccaagcactaactcgtaaagtaaactagtttcttgacagaaagatgtctttgcaggtctgactcaagtgttagcttcatggtgagtgggaatgagatggtaaggtaggtgtagcttatggaaacgtggagaggcatgctgtggagtttgagtcatttgttttattttttcctcagtacattatagggagatgtttttgactatgatttctcattctcgtttttagagaataaagcatttgtacagaggtctaatgctgtgagataggaattgcgtttcagaaaggagacctggggtggtagactggggtgacatagatggtgatgggaaacaaagcctgggttgctttaggatccttgatttagggcagaggaaatgaaaagcggagagtttatacaaaaagacgtgattctgtttataatacacaagtgattataatttatttcatttccattagataataatatatttagctcctctgaagatgacatcgttgccccaatcacccatgtgtccgtcacattagatgggattcctgaagtgatggaaactcagcaagtgcaagagacaaatgcagactccccaggagcctcctccccagagcagcgcaagagaaagaaaggtgcgtggctgacttgcttaggccgtacagtcagtgttggtgtggactccagacaaactttctattacaggtgcttctataccaggtaagatacggaagagcaatgaggacacaagaccagttgaggcatttcttcatattagtcactaaaaaaaccctaggtacttataatagttgagctatctgacaggagattttccaactctttgtcttttattgtgtttgtgttcaggtgtgtgtgtgtgtgtgtgtgtgtgtgtgtgtgtgtgtgcgctatggagtatgagtagaggttagagaacacttggcacagagtttgttctctccttttaccatgtgtgaccacgggctccctctcaggttgtctagcttggtggcaaatgagctaacttgccagcccagatccaattattaaagcctcaagtttctatttaaattctttatccagcatcttcatcctcctctcaaccaaataaaacaaaaacccctgggggtaagggttcgggccaggtttgttttgagggcatagtttaaggtcctcctttgctttcattagtctttgtttgttttattattttatttatattctacaagattttgtcttttaatcctttaattttgtgtgtgtatgcacatgcatgtgattagggaagagaaccccagtcctctgtgagaacagcaagtgttcttattaacatctgagccatctctccagcctgtttatttgtttttgagaaatgttctcaagtatccaggactggctttaaattccctgtgtagccaaatgacccaggcgagcatcgagcatcgctgctcctcacgtcctagggtgtagtttgaaaacctccagtctaccagagattccattacagggatccagtaggagaaaagtgcagaaagttggaattctgcaggcaattgaagaaacgagtgttaaactatgttaaaaggggactctaactttcacaaattgttagtgccttggttagttttaattgtcagcttggcccagcctaaagccacctgagggggaaaaactggattcaggaatgttctagatcagatttttcttcagggatatcagtgggtcttgagtgctaattgttgtgggaggcaaagcagccaacaatgggcaacaccatccctatgcaaggtggtcttccgaggcgtaagaaagctaagtaaatatgaagttgagccagaaaacagtgttctttcacaattcctgtgtaagttcctgccttgactttttcttataaacacgatactgtctcacaaaaaagaaacccacctcactgccaaccgctccgtcacaaaaaggcttacctgatcattttggccatgaattcacagggagtcatctacctttgcctccacctacaagtacagggattataggtgtgtgccatgaaacacagctttgaggctaattttttaagcccaagttttgtctatgtcaagaatatttaaaaatttaagataaagcactggtgtggtgacctcaaagaaaattcagtatttgaaatttaccctcattttcttttttcaggtgagccaaaggataatttctcgtttctttaccaccctaactcccatccctgatgtgctaggggtcaaactccaggcttggggatgttaggcaaggacgctgttgaacaggagtctgtgtctctagtcctgaagtataatttcatatataagtaataatcacttgtgagctagcctacttagtgtgtaatttttactgaagttatttttcttttagatagcattttgagagaccagtttgtatgacccaaatatgaaagtttggaacttgaaactcaataaaaaacaagatagtgaaactgcccattttctttcagttttgagggcaaatatttatacagagctattctgatttcaggaaggaaaacaaaaccaccacggccagattccccgacgactacaccaaatatctctgtgaaaaagaaaaataaagatgggaagggtaagtactgaggtttccttactgtacaggtctagtaccctcccctcctcctatattccctgtagcccaccccttgttacttttaaaaatgtgtgtgtgcatgcatgcttgcatgcatgtttgtgtggtgacgcacacatgcaccacattgactaccttcggtatgttaaacctatagtccagattggtcttgaactgtcgtgtagctgagggtaaccttgaactgctgatctttttccacctcctaagtgctaggattagagatggcacaccactaaacccagctcatcccttttcttgttatagccaaatagaacctgcagctaccagtgcttataagatactgtcagcaatttctgtaaagtggctggtaacaaagtagcctaccaaatccatttcagttagttttatttttctaccaaaataattcattaatgcattcagcaaagttttgcagcaatttagctagtctagaatttcactttgtaggtccttgctatggtgtgttagaattctactgtttttacaacttgtgctatcatggttggtctgatggttctgatataaagaaaacaaatgttgaactgggagggggtcaataactgaactgtaaaaacataaaaataataaaataaaataaggatgtttaaaatccctcaaaaaagagagagaacaaccgttgaaagggacacacacacacacacatacacacatttacattttggtgtttatgctatgtgatggtttttaaaaaccagacagggctggtgagatggctcagtgggtaagagcaccgaccgctcttccaaatgtcctgagttcaaatcccagcaaccacatggtggctcacagccatctgtaacgagatctgatgtcttcttctggtgcatctgaagtcagctacagtgtacttatgtataataataaataaatctttgggccggagcaagcagggactgagtgagccgagttgccctgagcgagcagaggtcctaaaaattcccaacagccacatgaaggctcacaaccatctgtacagctacagtgtactcacatacataaaataaataaatacatcttaaaaaaaacccaccaattcatgtaaaataaaataaaaataaaataattaaaaaaaaaaacagacagaaatgaggccagtgtttccaattaggtcatcatgaatctaattgacaagtttgctgttcatacatcatttatgggattagcaagttctctgctagatctaagaattatgaccatattcaccaatactgaggaattgcatcagttaattgaatgatgtaatatttctgtgagaatcagaatgggccttttaagactctttggtcccgtggtttgcctgtttgtgttcttttaaagccaactgtgttcctttacaatcgattggtgtgtttcaggaaacacaatttacctttgggagtttttgctggccctgcttcaggacaaagctacctgtcctaagtacatcaagtggacgcagcgagaaaagggcatttttaagctggttgattctaaagccgtgtctagattgtgggggaagcacaaaaacaaacctgacatgaactacgagaccatggggagagcactcaggtatgtggctgggtcgttctgcaatgcattcatttcccaggtattgtaacacaggtaacttttaaaaatataaaaaatgtgatcatatttatgctgtttgattttgtaccgtgggggaatgaacccagggttttgtgtatagtagacgagcattctaccattgagctacatccccagcctgtgaatcatatttatggaagaccacagaaaatacagaaaccagcttgcatatgaagttaaatcttccaactggggaaaatacttactcatacaagcagcagaatgtactctgaaagtcaggagtccagattctactctgaaagtcaggagtccagaatctactctgaaagtcaggagtccagaatctactctgaaagtcaggagtccagattctgaatctttgagcaacaatgagagggttaagtagtttggctttgaggcatttccaagtttggatgttcaactggtaaggtctatataaatgtttaaaaataattcaaacgtatttccaaagccttaggacactattggttccaaagcatttcagaaattagatactcagggctggagagatggctcagaggttaagagcactgactgctcttccagggttcctgagttcaattcccagcaaccacatggtggctcacaaccatctgtaatgggatcagatgccctcttctggtgtgtctgaagacagctacagtgtgctcatataaaataaataaataaataagatactaaatctgggtttttcttataaagagatcagaaaattagaaaatgttaaaatgtggatctcagaataatgaatacttcatattgatattagagaaaagaaatttaagcccattttgttttcctatgactgtatcattaattattgcagatatgggttgtgtgagaaagacttcaaatagaagtgatttgtcagtgatttgtcagttagaactcctcctcnnnnnnnnnnnnnnnnnnnntttcttctcctcctcttcctcctcttccttctccttatgcagagttggaacttactaaggtttttaaaaaagattttatgcatatgaatatcttgttggcacatatgcctgtgcattatgtgagcatccgatgcctacataggtcagaggtaggcactggatttcttgaaattggagttctagacattgtgtgggtgttgagtcacctctttagccctaaggaaaggttttcctgtggatttaaggaccagcatttgagggagagactcaggggaagggcattatacataacagtcgtagatatatgttttcaagaattgtttagtttttttgattttattaaaaccactgacatttgaatcactaaattttgcacaattgagttaaattaacttttatgagttcatgctagtaagggagggatgtcttgaggtttgtaatagattttatcatctcagcaaattagcagcagggaacagagggagagaagcaaagttcctaccatccttcacattccctagtcagaattcagctgagatctgttttcagtaaggacttgtatgtggtatatgtagtgttttgtgggcatgtcataggtgcatgtggtggaggtgagaggtgagaggtgagaggttagaggttagaggtgagaggttagaggtttggtgtcttccttgattgctctccatgttgtattttggtgtcaggtctctcactgaacctgtagctcattgattcaactaagctgcttggtcagtgaatgagaggtctgcctgcctctctcctcagcatggaccacagatgtgggccactggggaccgcccagctcttgcaggggtgctggggactgagctcagggtcttaggcaaagaggctaagtcaccctttcagtccctcataaggatttaatctgtgtataaaagttttaaaatatacataaataaataaaagcccacaaacagcaaatttccttatttaaaaacttcatccctaaatttttgattaggaaaaaataattctgttaaatgtcattttaatttatatttgatgtaataagatattgatgaaattgtctgttttgactaggtactattaccaaagaggtattcttgcaaaagtggaaggtcagcgcttggtgtatcagtttaaagaaatgccaaaagatcttatctacatagatgatgaggatccaagttccagcatagagtcttcggatcagtccttatcgtcaacaaccgcatcaagtcggaatcaagcaaaccgatcaagagtatcttcaagtccaggaattaaaggaggggccgctacaattctaaagcccgggaattctaaagctgcaaaccccaaagatccggtggaagttggacaaccttcagaagttctgaggacagtgcaaccctcacaggctccctatcctacccagctcttccgaactgttcatgtagtacagccagtacaagctgtcccagaggaagcaaccatagccagcaccatgcaggaggaagcagcaaattcttcagttccaagtattaggtgaggaacagtaaccagagctcatggccgtgggagggcatcgctgctagtggggcaggaggccagagctcatggccgtgggagggcatcgctgctagtggggcaggaggccagagctcatggccgtgggagggcatcgctgttagtggggcaggatgcagaaggcagaggttttggtcaacattgtttcaggaacaaaattatatcagttttctaattctgtcagtggctccttttctgtttatttttcaattccgtgtatttgtatgtggtctgtgtcggggttttctgtacctgacctcagatgcctgtgaaggtctgatacactaggtcccttggaactgcagctataggcagctgtgagtcgctcgaggtgagtgttgggaattgaattcctgtcctctacaagagtagtgcatgctcctaaccgctgagtcatctttcacaactgagacactcaggatgcactgaatacggagaatacatggtattcttcacctgggaaaatcctgttttacaatacttctgaagcttaagtgggaaggtcaggagtcaggtctcttcttcaggtgttaatgtgccagacgttggaaagtctcttagtctggtttaatcaaatcagactttaaaaggtgctaaatatctaattgaccaagaaaaaaatcctatctttaggttggtcttctgaaaaatttagtactattctcatttgattttagaataaagtaagagatattggtctaaaattaagtggatatttatagttcttagggtttgtcttagtttgggttactattgttatgaaaaaacactatgactagagtaagttggagaggaaagagttttatttggcttacacatccacatcataagccatcactaaatgaagtcagggcaggaaacagggcaggaaacaggacaggaacctggaggcaggagctgatacagatgccatgaaggagtgtgcctcatgacttgctcctcatgacttactcagcctgctgtcttacaggacccaggaccatcagcccaggagtgaaaccacccacaatgggctgaccccaccccgacagcctctcatcactaattaagaatatgctctacagatgtgtctacagcttgatcatacagaggcattttctcaactggggtttcctcttctcagataactctagcttgtgtcaggttgacataaaaccagtcagcacaggtttcctttctttattctgccatgggtttccagaacatgaattatatgtagaattttacagggtctgggagaaccactgcctcttcagtttgggttactattgctacggtgaaataccatgacccacagccagatggggaggaaagggtttatgtaaatcattaagatttcagtttttgggctggagagatggctcagcggttaagagcactgactggctcttctgaaggtcccaagttcagttcaaatcccagcaaccacatggtggctcacaaccatccataatgaaatctgatgccctcttctggggtgtctgaagacagctacagtgtacttacatataataaataaataaatctttaaaatataaaattcaatttcagcctaaaaaaatgtattgtgtatgtatgtagtgtatgggggaggggggaatttcagttttttcctttgagtcaatttataatgacttagtcttaatttagtctttaaaggttttcattaactttgatttcgtgctagttcaaggaataacaaagaaaacccctggtaaagtgttttctgagaatggttgttgggaaatgtggaagtccgttttccttactacttattcatgcactaatagtttgtctaaaggtctttaaattaccctctaaaatgcccaacaacgctgtagtttttcctcaaaggcaaggtagtgcagtaggaagaaaatgcctgccaaagctttctgccctccagccttgccagttatttagtgtgccagtctgtcaacaattaggaatatttctcatctgtacagcaagaagagtacttagcaacccaggtggctgtggcaattaagggtcacttcctgacacccgagtcagcttttaacacaaactcaatgtcatgtaatgagcctcagaaattctgatgcatcataaatccacagtatgatgctgcttagttacaagcacagaggaattttaaaaagtagttaccttgaagaaaaaaaaaactgatacaacagaattagatacaagtgacaatttaattataaagaaaaagtgtttggaaatttctgtgactgcagggacttcattgtgttttattctttagtatttcttttgatgtggtatattatatcccagtctggcctcagatttgattgtagagggtggccttaaactttggcctttctgcctcttcctcctgcacatttagataataggagtctgccaccttgctcagtttttgtttgatttttttattagatattttctttatttacatttcaaatgctatccagaaagttccctgtaccctccctccaccctgttcccctacccacccactctcacttcttggccctggtgttcccctgtattgaggcatataaagtttgcaagactaagggtcctctcttcccaatgatggccgactaggccatcttctgctacatatgcagctagagacacgagctctgggggtactggttagttcatattgttgttccacctatcgggttccagaccctttcagctccttgggtactttctctagctcccccattgggggccctgtgttccatcttattgctggcatatgcaatagtgtctgggtttggtggctgattatgggatggacctctgcgtggggcagcctctggatggtccatacttttgtcttagttccaaactttgtctctataactccttccatgggtattttgttccctattctaaggagaaataaagtatccacacgttggtcttcctttttcttgattttcttgtgttttgcaaattgtatcttgggtattctaagtttctgggctaatatccacttatcagtgagtgcatatcaagtgagttcttttgtgattgggttacccactcaggatatcctccagatacatccatttgcccaagaatttcataaactcattgtttgattgtaagatatagacttgatatgtagctgagacaaggtggacaatcctcttgccttagccgcacgtgtgttgtgatttcaagcctgcactattataagttccaatttttgttttttagtgaaaattgctccaggatttgctcacttgagacagtatattttgtaagtagtatatctgtttcccgaagggggtggggaagagagagagagagagagaatcctatcatgaaaaggttgttttcaaaccaactgaacaaaagtgttgaagacctagatatagctctagttagcaatatgcagtttccagatgcactgtgtcacaatgtaaagaaggctaatgccatggggacagtacatggtaaagaattaagtgttcctaagacagggacaaaacaaagaccaagtgcaccttgaaaagctgtgggaggcaggcacaggacggcccatccaggtgggacgctgatgcttcagttcagatcgccacccaaggcggcactggaacagcataggcttctcctttttctttcttttttcttaattttggagacaggtgtagctctagttggcctaaagccgcaaagcacaaacattcacatgtgtgcatgtctcaaaaagctaaaaatcaaaatagtattcgtcttcagctggtgttctcagaacttacagagtagtgtgttttgtaatggctaggcacataggatgtgaatcttaaggaggctgtcaacctttgcatcaaagcatttacatgtagccaaggtagagagactgtgtatacttacagacttctgtgacagatgacaaatgctattttatctctagactcatgtaagcacttagtatataggaaggtcttataagtttaaaaagtggtatctgctatgtatagtggtgttgctgatactcttgtctggattagatgtgtctagattcttggtgtcttatctaaagaattgaatacacacacacacacacacacacacacacacactggtaaagtagcaagaaattttgtcatttgcagtgggctactggagctggggtgtcccagaacagtaggtaatgttttgtgttccagataaaggggttggtttctaaggattgtataagccatggcttattatgcatagtacctttatttttaaaaatatgctttttaaagtcatataattgtcccttgtgcatagacataagatggtaaatagggatttttttccctttaaagttgactgggagaatgatacatggggaatatatgcagcttgatgcagggagggtccccaggctgctaggctatccctgcgcttgcttgtttcagtgatacacagctataaatctcataggtgtgaacttttcaaattatattgagtcatcacatcatttataaactgttttacttaataaggttaatgaggttagctcattattccagttagttcctgtcttaggtcttagtcaaggtttctttttttttttttttttttttcgagacagggtttctctgtatagtcttggctgtcctggaactcactttgtagaccaggctggcctcgaactcagaaatccacctgtctctgcctcccaagtgctgggattaaaggcgtgtgccaccatcgcccggccctcgtcagggtttctattcctgcacaaacatcatgactaagaagcacttggggaggaaagggtttattcagcttacacttccatactgctgttcatcaccaaggaagtcaggactgaaactcaagcaggtcaggaagcaggagctgatccagaggccatggagggatgttctttactggcttgcttcccctggcttgctcagcctgctcttttatagaacccaagactaccagcccagagatggtcccacccacaaggggcctttcacccttgatcactaattgcgaaaatgtcttacagctggatctcatggaggcatctccccaactgaagctcctttctctgtgataactacagcctgtgtcaagttgacacccaaaaccagccagtaaagttccataaactggattttacattaattttatgttaaattatagttttatggtgggtggggtggtgcatggctataattctatctgctggtggatggggtcagggctagtctgggcaacacagaaagaacctgccgcagaccctctgggtccctgtgtctgcgtggaacaggtctctgacaggggtgggcaaagcatggatgaatgacaaacagacacacacaggagaggtcgtgtggaatctgagtgtaattttcgaatcgagcctcagactttttatgcagaggacaataaggaagttgggtgacatattcgaaaggtacaattgaggtaacaggaatcttacttaaaacagaggaatgcaaacacaaaaggtctaacgggatccacctgggatagaatacattgataacagctgggatcaacaagggctccacctaagattcactaatcttagaagccaaggtcaagggttttgcgcccttgccatagttcctattttagtctattgtatagtccaccttccccttaggtggggacctgtattggaaaattactgtgaaaattgctttggcatttatttatttatttaggggggttggtttttttgagacagggtttctctgtgtagctctggctgtcctggaactcactctatagaccaggctggccacgaactcagaaatccgcctgcctcagcctcccaagtgctgggattaaaggtgtgcgtcaccacgccgggctttgctttggcatttaaaattgctgaaatatatatgtattttattttgccaaagtgtgggccttaattttgttctctgttcacttagaacttgtagaagttatagtcatgacttctttgatgtcgatctgacaccaattatgagatactgaaatcctagtaactgctttaaaaaatagataatcctcttaagataggattttttttaagttaatcaagcattttttctcttatgttataaaagttgaaaacaattttgtggcgctatttactgggagggagcaccgtgagtcaacaaatctgcttttcagtccacattgtgcttcagcgtggcccatccgtacatgccttgctaagggcactgattcctttctctcctgtagtcatgtggtggtgtgtacagatcgtccatctgaaacatgagctttctatgtagctttggctggccccgaactgcctctgcctcctgagtatgtccattataggtgtgtgctggtaccacaccaagcctgtataatgtatagaacgatgtttggcatgttaattatgctgtgataaaaataagagaagtagcaacggaatgcacttttaagagtgacttgtaaagtattaaagctttaaaggatgttccatttgctaactgtatcacttctgtttgttgatctcaataggactatacaggcttcaacccaggttccagtagtggtgtctcctggcaaccaacagttacatacagtaacagtgccactcacaacggttatagccagcatagacccatcatcaggtgctgggtctcagaaattcattttacaaaccattccatcgtcacagcccatgacagtactgaaagaaaatgtcatgctacagtcacagaagccaggctctccttcaattgtcctcagccccacccaagtacagcaggtcctcacaagcaatgttcagtccatttgcaatggagcgggcagtgtggcatccgcaccatcgttcagcgcgacgacacctgtggtgactttctctcggagttcacagctggtcgcacacccaccgggcactgtgatcacttctgttatcaaagctcaggaaacaaaaactcttaagcaagaggtggagaaaaaggccgaagatgatttgaatgaagatgctgagaaaagtgcccagcagccccagccttatgtgatggtgttatccagttcaaacgggttttcctctcaggtagccgtcaaacagaatgaactgctagagcccaactctttttaatacaccaaaggaattatgggtgggtatttttttaattgaactcatttttcggttgtctgaccataacatgatttttttctaagatgaaatccacagaagttcttaactgttaaaaagttacttttgactttgctagataaggaggcgaacccaagtgtgtgtctcctctgaatgtctcagaactcagttgtgaaggagcaggaggtttagacgatgaagaaattcttgactgtttttcagttgctatatcatattttaaaagtttcttttctagcttgacactgtactagcttcctgaattgtttgaaaatactacttaaatataagacaacaggaaatttatataggaaacattttcattccacttgtataatttaagtcttagctctttcagatgcaagaaacttatactattaaaattgttgcgatgtcacttagcttgactttaaagttggctggactgttatactatgaatatactacgaatttgtaaactatcattataaattgaagtgtatatgctcagtatattggcatatatgtgtaattccagcactgggaggaggacaaagggcaatcaggagttcaaggccagccttagctatatagtgagtttgaagccagcctgggctacatgtaaccttcccaaaaaaatccaaaacaacaacaaaaatatttaagtgtgcctatgataatgtctgaacctgagtttaagaaatgtgatgtagccgggcgtggtggcacacgcctttaatcccagcacttgggaggcagacgcaggtgaatttctgagtttgaggccagcctggtctacagagtgagttccaggacagccagggctatacagaaaccctgtctcaaaacaaacaaacaaataaaaaaagaaatgtgatattataaaggcaacacttgtgacacttccactagctaggtgtgtaaccctgggtaggccactccatctcctaggtgtgtaaccctggacaggacatttcacctgctagtctgtgctattctggtaaaatgaagggatgcattggactagacaaaatgatctaaaagtttccttattataaattttaggattttattatctgtactttaaaattatttcaaatattaccagattatctccttatgtaaaggtaaaatactgcttaaaaatattttcctcacaaaattactatcaggtctgccataaattcttcctaagttctctgctcattaatcttcagaccacagttactaaaactgtggcttagtagtaagctgagggctaaatgagagactgctattctaagagcatcagggctctgagggccaaagaagcaatgggagtcctgagctagtatagctgtgtcacttattataaaagcataactgttttttatttggatcattttttactgtgggtgaaggggaggggaagttgcatacaaagaatatatatccaagtttccgaagtagagtttttagattactttttcaatgtaaataatgtatatttaatgtcacaagaaattgttttctgcaaattctctagtatagaaagttttgtagaagaaaaattattgtgtttaggggtataatattatatgttttcatattatgaaatgaatttgtatttaaacaaaaatttaaattttggaatcctctaaacatttttgtatctttaattgttattattaaatcatgtaaaagttctcaatatttctgttttcaagcaaatatttcttgtttgtaattcttttgctttttgacacaagacacactgtgctgtcctagaactagtgattatcgtgcctcagatactgagtaaaaggcacatgcatcaaccaannnnnnnnnnnnnnnnnnnnaaatgagtttctgtgtaaatgagactctgtcttagaaagccaaagagaaaataaaccttgtggtatagtagctgtggctctaagtcagcttttaaatgtctgaatatacatgcaggaacacagtagagaagagagcatagcactggctgtgggtcctgtatcctgtctgaggtgggtcctctaggccctgggctgctgctttcagcacttcctgggtcctagggatccggattcaggccgtggggcttacatagtaagtggttactctcactgagccatatccccagctctaaaacaggctttcttagtaattgctaaacttggaaaaagaaaaattcaagaaaacaaaaatctcagtaccatggcatgtccctactctcttattggtaaacttagtcatttttcacatattcgtacccatttgtgagtatgtgtgcatgtgcatttgtgttgatacaaagtctctctcactgtgcacctctgggtggctttgaattcagagaatccacttgcttttgcctcccacgtcttgagatttaaggcatgtgtcaggactgatacataacctttaagcatcattgaatgtgtatgtgtgtattgagtttctattgctgtgaagagacagcatgatcatggtaactcttaaaaaagaaaacatttattttttaaacactgtcagaggattagtctgttatcctcatggtagaaagcatggcaacagacagacagatatggtagctgagagttctatatccagattggaaggccgcaggaagggaccctggccccggctttggctcttaaaatctcaaaacccatccccacagacacatttcctccaactaggcctcacctcccaatcctaatctttttgtttttcaaatagtgccactccctagtgaccaagcattcaaatctgagactatggggccattctcattcaaaccacctgtttgtccccgagagagagagagagagagagagagagaga

SEQ ID NO: 1958 - DNA, 1556 bp, Mus musculus
gcggccgcgggggcggcttcggcggcgcgagttgcagcagagtggctgagtggtagcggcgctgacgctagtcagggacaagaagacctagtgaatgatttcagaaaacgtgcctgttttcttagaatgtcaatgcagcaagcaggtctgaaggactcctttcaccgaagagcgtcttgtctgcagtaacttcacagacctgcctgagaggctcttcccaaactccactgcaccctacctgctgctccagactggaagctgcttaggccttttctcatgtggatctaaggggaatgctttactatggctgctgttgtccaacagaacgacctagtgtttgaatttgcaagtaacggcatggaggacgagcagcagcttggtgatcctgctatatttcctgctgttattgtggaacatgttcctggtgctgatattctcaatagttatgctggtctagcttgtgtggaagagcctaatgacatgattactgagagctcattggatgttgctgaagaagaaatcatagacgatgacgatgacgacatcacccttacagttgaggcttcttgtcataatggagatgaaacaattgagaccattgaggctgccgaggcactcctcaatatagattctcccagccctcctgtactggatgaaaagcaaatcaataataatatatttagctcctctgaagatgacatcgttgccccaatcacccatgtgtccgtcacattagatgggattcctgaagtgatggaaactcagcaagtgcaagagacaaatgcagactccccaggagcctcctccccagagcagcgcaagagaaagaaaggaaggaaaacaaaaccaccacggccagattccccgacgactacaccaaatatctctgtgaaaaagaaaaataaagatgggaagggaaacacaatttacctttgggagtttttgctggccctgcttcaggacaaagctacctgtcctaagtacatcaagtggacgcagcgagaaaagggcatttttaagctggttgattctaaagccgtgtctagattgtgggggaagcacaaaaacaaacctgacatgaactacgagaccatggggagagcactcaggtactattaccaaagaggtattcttgcaaaagtggaaggtcagcgcttggtgtatcagtttaaagaaatgccaaaagatcttatctacatagatgatgaggatccaagttccagcatagagtcttcggatcagtccttatcgtcaacaaccgcatcaagtcggaatcaagcaaaccgatcaagagtatcttcaagtccaggaattaaaggaggggccgctacaattctaaagcccgggaattctaaagctgcaaaccccaaagatccggtggaagttggacaaccttcagaagttctgaggacagtgcaaccctcacaggctccctatcctacccagctcttccgaactgttcatgtagtacagccagtacaagctgtcccagaggaagcaaccatagccagcaccatgcaggaggaagcagcaaattcttcagttccaagtattag

SEQ ID NO: 1959 - protein, 423 aa, Mus musculus
  VARIANT (1)...(423): Xaa = Any Amino Acid
GECFTMAAVVQQNDLVFEFASNGMEDEQQLGDPAIFPAVIVEHVPGADILNSYAGLACVEEPNDMITESSLDVAEEEIIDDDDDDITLTVEASCHNGDETIETIEAAEALLNIDSPSPPVLDEKQINNNIFSSSEDDIVAPITHVSVTLDGIPEVMETQQVQETNADSPGASSPEQRKRKKGRKTKPPRPDSPTTTPNISVKKKNKDGKGNTIYLWEFLLALLQDKATCPKYIKWTQREKGIFKLVDSKAVSRLWGKHKNKPDMNYETMGRALRYYYQRGILAKVEGQRLVYQFKEMPKDLIYIDDEDPSSSIESSDQSLSSTTASSRNQANRSRVSSSPGIKGGAATILKPGNSKAANPKDPVEVGQPSEVLRTVQPSQAPYPTQLFRTVHVVQPVQAVPEEATIASTMQEEAANSSVPSIX

SEQ ID NO: 1960 - DNA, 149612 bp, Homo sapiens
aaagaataaaacaaaaacactattaatatgcttcaattaccttttttaagtctccttgaaatccttcaggtttctcccactgagatgcttaaagcaaaatatattgcatttataaaatctttttgctttaaaaaaatactttccaaaaaatttggacaaaatttacagtcattatgtacaaaacactacaggtctacaatttaaaacatatttgaaaaataaaacagaacatacatcccagtactgtgcagacaatatatgtgaatgctacgtaaccaagaagaaaggacagaacgagggattagaagttactggaacttccacaggaattttagagccaggcagggcttctcataaaggtttcacagaattcaggtctgataagtttcaaaggccttttgatatcttggggcaagggagagtgagagataaactgaataagaactcagaagaggaacaactagtatgcagaaattaaaaacatgtatcatggagaggaagagtatataaagtaggatgctgaaaaagagaggcaagcaataagcattggaagggagaaatgaaataacagtttataagtaaatttgagaaagacttctaattgctagtacataatcatttatgatatcttcattgctaaactacaatatgcatgtcacttaaagctcagtgcaaactctaacggattaatatttctacatagtccaaaggtaattatgatcctaatgataatagtcattacagtaagattgttagcccaaggatttcttcatgattaactctctgatcttatttcctaccttcctagcattcttaaccttcttttgctggcttttcttctatccattcctttaatatatgtaacactcaccttctttacttcttgctctattctctctgcttgcgatctcatatactcctaaaggctaacatattatctacatccccagactcaattttgctcagctccacactgtaaccatcaattagctaccaaaagctgtcatatgaatattctgtaggtacctcatattcaacgtatctaattcattattgtccccattaaacttattttcagttccttatctcgtatctaagtaaatggcaccatcattctctcagccctccataagatggctccaatctaccttccagtctaactctactaagacgtcttcaaagaactgcatgttttacctcgaccactatttcccaatactttcaaaccttttttggggttcatattgttctgtgtggattctgtacctcttaattatctactgaagtcttctttaatcaaaacacagagtgtctacactgtgctaggcactatgttaggcgccaggaatacaatggtgagtaaggcatcattcctgatgtccctatcttaatttagagatcagctcaaaagtaattcctatggtaatctctcaaagctacataatcacaatgaattcaacattattatgagttcccatataatcttaattacacttctattatagcactttaaaattcctccttttatcaagcttatttatttgtcgctaaattttatgactctggagagtaagatgctacataaatgtagaataaatgtattaatttattccaaaatgtatacggagtaaaaaccccaaatacatttagtttttaggaaaaacaaaaaaagatgtttttgatattgttactgtaaaacgacactgtgtattttttttttcttttttttttttttgagatggactttcgctcttgttgcccaggcaggagtgaaatggcgcgatctgggctcactgcaaactccatctcctgggttcaattgattctcctgcctcagcctcccaggtagctgggattacaggcatgagccacctcgcttggctactttttttttttttttttttttttgaggcagagtctcgctctgtcgcccaggctggagtacagtggcccaatctacgctcaccgcaagctccgcttcctgggttcagtggcccaatctcggctcactgcaagctccgcctcctgggttcacgccattctcctgcctcagcctcccaagtagctgggactacaggtgcccaccatcatgcctggctaattttttgttttttcagtagagacggggtttcaccatgttagctaggatggttttgatctcctgaccttgtgatctgcccatctcagcctcccaaagtgctgggattacaggtgtgagccaccgcgcctagcctaattttgtatttttagtacagatggggtttcaccatgttggtcaggctggtcttgaactcctgacctcaagtgatctaccctcctcggcccctcaaaagtgctaggattacaggcatgagccactgcatctggccatggcactgtgtatttttctgttgggtatcagtttccagtaaaatacacaatgtcatttttcagtaacaatatcaaatcaatcaaggcagctacagaaaaaagaaatcagttactggctcccagaagaaaatctctactgtagaatattttatttcaagtacccctacaatttgtgaagtggatttgaaattccttatttctatgcaaaattctttatttccatgtagtttatacttacagaagtttctattgagaaaatataaagctatagtttatttgtaagaaagtcattatcaaaggctttgactaagtatgacacttagtcactatgagaagggtacctttttaaagggcacacagttttcttacctttggggcaaaaatgaaaaaccggtctttcactatttaaagtgctccaacattagataaaaatcctaacataaaataaattgttctattctactagtgacactgttctttaccagttttatgcctaaatgacttacctcctgagataagatcataatagtaatggtaaccctcagaggttatgccttctacccatctgccctttgaaggatctttttttcttttcttcttttctttcttttctttctgttgatttgatgtcgaggtaggtgggatagtgctggttactggtgttatgcttggctccaaaatttctaaagagatgagagaagggtaaagcagctatagtaactactattttttatggttgctggcataaaacattaatgttattccaatcaaaaacctgataaggttcttttgagaacttaacacattattataaagttcattcggaaaaataaacatgtaagggaaggaaaactgtaataaaaagaaaaaggagaatttagttctaccaggtgttaaaacttattctaaaactatgggttaaaaaaacagccagcagtgtggaactgacatagaaataggcaagcatataattgaaacaaaatagtccagatacagagccaacttcaggttggctggtatttcatatcagaggataaaagacagatcattaaaaaaagaggttttcaaattacctactgggtacaacgttcactatttgggcaatgggtatactaaaagtccagattccatcactatgcaatatatgcatatgagaaatctgcacttgtaccccctacatctatatatatattaaaaaaaggaaataaagaaagcatgcttaaaaagaaagtttttagattaactgattaattatttgggaaaaaagtaaagctgttccccactacctgctcccttcccccctttttattaaatactaggtcaaagatagttacaaaaagaacacaaagtaaaataatgttaaatttgactacataaaaattaagatattctgtatgacaaaaataaaaagaaaaaacatatataagacaaatgaaaaaatatttacaataaatatggcaaagggttaatattcctaacaaagatcctttacaaatcaaacattctaatagaaaaatggacaacaattacaaagacaattcagataattaacatttacttttttttctcttatgttgtccaggctggagtgcagtggtgcaatcatagcccacattagtagccttgaacttctcagctcaagcaatcctcccactttagcatcccaagtagctgggactacaggtgcgcaccaccaagcccagttaattttttatttttatattgtagtagaggtggggtctcaccatcttgctaggttggtcttgaactcctgggctcaaacaatcctcccactccggcctcctaaactgctgggattacaggcatgagccacggcacctggccaattaacatttacttttgctaatattcaaagaaatgttttgttgttgttttgcagaagatcaataagtagtgaaaagaatgaccaaatccagtattagtttgatagatcaggtatttacattgctttgaaaaaatgggtagttttggtgggggacagtggctcacgcttgtaatcccagcactttgggaagcccaggcaggtggattgcttgaggccaggagttccagatcagcctgggcaacatggcaagaccccgtctctaccaaaaaatcgctgggactggtgacgagctgaggtgggaggatcactggagcccgggaggtcgaggctacagtgagccatgattttgccactgcactccaaccaggtgacagagcgagacctgtcttcaaaaaaagagaaaaatagtttttatggctttactttccaaaggattggctagttactcctaaaacgggttaataaacttatttttgttctaatgaaaatgtacatcagtccatttctggagacaatgtggtattagctatcaatataaaatatattcacacttttatactgtaacttccagaaactgaacctacagagaaaaataagtgtaaaaagatacatgcataaagatgcttaatgccgcactctttacgacagtgaaaaatgctaagcaacctaaatgttaaccaggaaaagattaaataaattatagtacagagacaaaataacagtggctaccatttattcaccatttgttatgtgtggtcacgtaataagcaatttataccataatgttacttagttttaataaaaatcaaaagtcataactagcaagaggaaattctgcttgactccaaagtctgctcctaccatataaaaatgatacatctccctaattaaaagaaaagatacatttgatatatcactgagggaaaaaataaaacaaccggcaaatagaccgcagcacaaaatatgtaatttaaaaaaagatctaaagaagaggtctgcaaaaaatcttaacagttagtgagtttttaaaaactcttttctttgtactgcattgttgtatgtttgaatatgtatcctatttggaaaaacaaggctatggtaatatttaataggaaaaatccatttaaatataaaatggtaaaatttatttgctcaaagggcagcataatggaatgtctcaatgcatataattgataatagttggactctcatctattcctaattctccaggaatgcctaaatcctttttcctttcaagatgaacatatggctttatcctcaaggaaccaaacaactttcccaccttttaattaccaatgtccaggataacaaagtctggctacaactgttcttatttaatgaacacaatgccaattaacttaactggtactctgcttaaaaccttaattgaaagctgtttttattagaggaataccatcacatgttgatgactgcaaccactaggtaagatcaacaactgagatctgctatatgcctggtttaaggaaaacggatttgatatggaagaattattcacaaaaccttcccagtttaaagcctaaattcaatgacaagatagatgcagtctagttaaataaggtctttcatctggaacttccttctagtagtaaatatctgccttctactagtaaaatctgctaattgtccacaaaaggctaattcactacatattcacccatataaatatacaagactcataattttgaccatatggacacagtgaattgcaattataatgcaaggcctatttttaaatgaatagtgtctcttagccaaataactagaatacctaaaaaactcaaagtgtctctgaaatgaaccatttacctaggatagaactaggattaggtgaccacaaaagtagtatggctgctatgaatgaaggtgttaaaagataaaacattaaaagtacaacaaaagggcataagcaaacttccatagtctaaacagggctatgatgcataataaaagcactgagagtacactgagtttataacctctttatggaagcaatcaaagcttacttagcttgacctctgatgttacttttaaaacatgctggctgctttttttttttttttttttttacctgactctaagccaagtcttttcaaatcctcttggtatgctttcagggcagctgcctccattgcagcaaactcctttgatgccttttcttcttcctttgccttatccaggcttttctgtttaatctatgtaagacatacataacagtgaaagtgagataaaggactgacatttgcatagaaaaattagcaaataaacaatctaaattacctcactgatcctttttgccacattttccttatgattctttcctctttcatgaaattcaacactcttgaaaatgaaaagagaaaataacaaaagaaaactacataaacatcataaaattcatagtaaacataattttctcataaacatgagaaaattaaaattaaaatgaatggcagaaaagatgaaaacattaatttaatgcaaattggcccttttaatcaaatgatgctagggaactacattgtttattattatgtcctctgactaggtttcctttggttcttaaaataaaccatgatgaccttattaatggagaaaaatacaaggtacccttgatgactaatctagtgactatgattgtaatgaggactcaaacgtgacatgaagccaaaagactggggaaaaaaatcttaaacaactttcaacatcaaaagcctttagaattttattgctctatttgtcacaaggagggacatagagaacaatgattttattgctttattccttaaatttaggagaaaagtatgtattttaagattcctcgtaaattataagcaaacacttttatacaatgtggtaatggttcaaaatgtacaacttctatggaggataatttggcaatatctatcaagactacaaatacatttaccctttgacacagcaatttcatttctggtaatttattctatagatatacctgcacatgtacaaaatcatgatatacacaagcttactgactgcagcactgtttgcaataacaatacggtatccatctctaagggactgactggttaaactatggtacattctcatagtctactgtaacagagagaaagaagctctttatgtatggatacaaagggagctccagttacatactgttaaattttttaaaactagtgcagaataatatatacagtacattaccttttatgtatgctggaataagaacttgtgtctacatgcatgtagaaacaatggaaggataggcaagaaaatgaaaaaaaaaaatgataacctatggggagtgatggccactagatgactggggacaggggctggtgagtgagcgcaattatctatttaaacaatcagaaatgctccctaaattacaagtttctagttaaatgcagtaagaaattcctcacaagctctgcaaaataagttctgtcaatcaaatcttacatgatgcattaactgagctattttaaaatactaccatgaattcatctttaaagtgtgactttgtaaagcagataatcctcctgtttttcatacattgcgtttcctaaagttgattacactacacaaagaatacaatattaaaggaccattcaaaattaaattaattttgtttctaattaaaggttaaatcaatgtgtattaccaactcaagaagataaagacagactacactggaagggattacttactctagataactcacaaaattcattttacagcctaggtacctccaagaaagagagactttaagtgacctgtgtggttttaaaaattcatggtatttatttataaggatagcctaggtaaaatagtgaagaactttagcaactatccaaaaagaccaaaacatcaaaaaaaaaatccaaatcctaaacaccttgcaggtaacaggaaataaatgtctacagaagaaatccacagcattgttaaaatatgagactactattctttgtgcatccaactttgccaagtaaaaacggtatcaacataaaatatatttaacagataccctagtgtttatgtggtatgtacatagtattttgacatgcaagaggggagaaaaatcagcggtgtgctttttgctttacatcttcaaaactggatctcaactatgagacagactaacaacatacctaacagagttgttactttgtttcatgagaaaggaaataatggtgttctttcaaatttaagcatctaaagatacacagctctgcattaaatacacttgattatttctagaccacaaaatatacaagaaaaactaaacatgttgcttttattttttaagggctttccacaattctttgggtatgacagtattatgaacaccaccattataatataggtgcttcataacatgaatgatatgaccaactcattgcccatttcccaaaaggccacagagaaataatttaatatataatcaaagtcaggttgatgaaaaggaagaaggctcacagctttcataggggactgagaagacagaaatcttctgatgttttgaaaatgcaagagcaatgtacataaaagtgctttgtaaactgagtttacatcaaaaaggagcacttcattcaacacaattattattagaatctctaacagcggaattatcatacaggcctattgtctgctatccagcacttgcagtaatcacagaatttctttggctgtgacttccagtagtccgccctgaaaaagagagacaacaaggctaagctcatgtaaaacttaaaaaaggttaaattctgcatgctttacagtttttaaagtttgaaatatatgcccctgctactgaatcttgtcttgttatgtatagtcgttttattatttatctggttggagcacagtcaattgaaattctgttgccagcggagtagaaaaagtctgtatctgattcattacaaaactcccttcaataaaatggctttcaaaaattcctcacttgttatcgtcatcgttatgaaaaactaaggaacatcttagaagaacatttatcctttctggctttgggggaggttgctgtaatggaaacctgaagaaactcataaagtttgccttaaatcaagttattcccaccaagagaacaacgtacaagactactctggggaaaactgtagttcctcccagactctcagttaaaacaaactgttcttgagcctcaaggcaagagagaactggaaaagccatgggacttcgtagacggccgacaaaaaaaaaaaaaaaaaaaaaaaaaaaaccattacgctatccagggctggccgcttccagtgggcgggggaggccgcagcccagccctagtttcacaataccctagggttcaggggcttcggaaacccaaggggtgcatgcgacccccgacagcgtcgtagagagagcactgcgtcgcttcacccgcggccgtccaaccagccccctgaaccggccgccggcctccccctagagcccgtgccccataccccagggcgttcagcggggtaacatttctaccccgccctgagaaccggccctgcaggtctggggccggtcccgagcgagttaagaacgcgtctgtcacgcccccggccgaagggcgggaggagaggaggggaagacccgggcgagaaagggcggcccagagaaacaacacctcgttgttcagggcctgagacccaactcacatgactgcgccagccgctctgcaagtcgtccagggttccactcagactcgcgctttcccagcgggacgagtcgagctcttccagccgcccgatgcccacccgaacctccctccgatccagacaccttactcagtccccgggaccagcgttccgctgttcccaactacgggtgcccagacgatccaatccgcgttcgaaatcgcctcctctcccctccccctacaggggcggtactcccggctccaaagaggtggggtcggtataaaggggttgaggtcaccgggaaggggtaaaagcgcgacgggacctgagctgaaggacgggatctcaagcctcaagtccctgcgccatcccgccgtctctgtgtcctcccctggggcccaaaacctccatcctccttctaggctcgctggctcaaggccaaggagctcagcgcgccgcctccgcccggaacgcaaacagctgttcccagagacgtctccgctctcaactttgccaactactccgcacgcactttgaccagcggagcaaccgggacctgtgggtcggggtcctctggcggagttaaaaaaaaaagaggtgaaactgcgggaccggcgctgcgagtcgctaggcttcgcctcaaactttgctgttgcagcggagcggccccgcccctcctctcccctacgacgcccacgcgctcggatggggcttgttccctagctcgggagcgtgtgggcagcagcagcggcggcggcggcggcggcggcggcagcagcagcttcagtagcgcagaggcggcggtggcgagaggtgcggcgaaggaggcagaggcacttatgcttgtcaggtgggtcacggcagtttctcatagcacttcccatatggtctagcggttaggattcctggttttcacccaggtggcccgggttcgactcccggtatgggaacgcttccttatttttctttttttttgcaactatcggtttggagggctgactttttaaatcttgtgttctggctcctttcttgtccccgtctgggtgagtttgtagaaaataagcattactgtagttagtggcgccaggagctgggctgcggcttttggagcctcgagtgccacgccgtgcctgctggagaagcgaatgcgcttccgatccttctccctcccgcctccggctcacggggctggtgggccctgagggagtttcactttcccctgggctgctcccccgcccctccggcccgtagttttccagacgcccgggaggtgatgattaactccggccttgcgttatctcctcccagcgcccccgtccggcccacaccctcttcagccgctcttgcgactcttcctatgcaggacgggctgacccccctgccctgggcgccccagagcccgcgcccggaccagtagctctagtggttctctggccgcagggtatttacgaggccccacggaacacagtgtgccttccgcgccctcccggggggacgcgctttcccggccgcgcagccgcccggcgcccctttccgccgcgtgtgcgctcgcgtctccacccgcggcgcctgagcaagcgcgaggccggcctgcgaggtcttcccaacttgacttaaggggcgctggtcgcagtcacggaaagtaccctcgaaaaaaggcctttgggaacgagaatcttttttctttccctttaaaaatacacaccacgagctatggaggagaaaaataccactctgatgagatggctttaaataagtatatcgactttccaaagggtctaacattttgagcgcggttgatttaaagaaaaaaattgattaaaacaacggcaaaacatcctggggtggaggtggggcttgggaaagagaaaattggctggagactggggaggggacgttaaaacaaagtttcactgtatttttaaatatagaagccctgtgtttattacaaagaagggacagctgtgtcagcagcatgtgagctgtaaatgaaacaaaagcgttatcttaaatgcaagctgaaattagaaaatagggtcggctataatgtttattgggcctctgggaacaaacgaagaaggaaaaagtgactcttgtagatgggtttctggtcagtgccattactgaaagcagatgttttggttgttagtatgtgtgttcccagactattttgtagctttaactgcacagtaaatttgttaatgtgatctgcgtgattaaggattaattaggcttaccttgttaaaaagaaagaaaaagcctaagtattttaaatcgtcttcattaattcaaatatttgtgtgtttgctacacaccaagcaccaccacatgcttttgaagttactgatgtttgtattctttatgttagctagtggatagaatactgaatggaataatattttggtctttgtgattagctgtgtgatgagacttttcaccttctctgttctctggctttagagccatacatttttgataacacgtatcactcacaaattttaaatagagttacaagaattgttgagcgattcctgaatagataatgaaagtggaattttcatttaaataagtaatagtgtgtcattattaagaagcagttactaaagaattacagtagttgaaaatttggaaagaaggaaagataactcggataactctgccttaattgtccccagagagggcttaacttttgactttttcttcttttttttgttgagacggagtctcgctctgttaacccaggctggagggcattggcgcgatctcagctcactgcaacctccgcctcccggattcaagctattctcgtgcctcagcctcccaagtagctgggactacagacacccgccaccacgcgtggccaatttttgtattttgagtaaagacaatgtttcaccatgttggccaggctggtctcgaacccctgacctcaggtgatccacccacctcggcctcccaaagtgctaggattacaggcatgagccaccacgccaggccttgaccttgtattttgtaatgagtttacaacattgtaccaaatggtgctaaaatggatgttattttcaactgtgcactcagtaattgcaaatagttgtactatatacctgggggtgaacacaaaggaagtagttgcatcatctctgtataaaacacagatttatctttcgtgtagttgtgcattacgtagaatatggtaaggcaacatctgagttgtagaagtgctactggagtaacagaggtgaggaatcggttctgctcaagggagaggactggagaagagacctagaggggagagtggaccttgaagaactgattggatttctcctgttggggaatgtgaatcataaagctgaggtagggggaacaagtatgaggctggcaagtagtcggtttggcaggagcacagagtgcctgcagggagggccatgggagatcaagctgggaatgtagaaaggaattttaacttgataaattttgactaggtaacaggttcttttatcaaggagtgacattttatgtcacaaaaatttttaaaccatttctgtctcttggaaaacccaaaggtagcagtggcatgtgaaaaattcttgttttaaaagattcaaacaataaagaaacatgtagaatattttgtgtccgtacattttatgtttaggagttgaatattaatttgtaattaatagaatggagaaaagcaatcagttaattagaattcactttataggaatgaaatctaggcttaaagtgtgagaataatctgtcttgctttgttgaaagtgaccttggtattcgaagacagagctgctcactactgtcagtaagacgtatatcttaaattgattaaggctaggtaatcagtttgtgaggattcattcttaacgcttgtgccattggcaggcatattttaggtgctgtctcttgggccataaattagtgacactgagtgctgtggatttacccaaataacctctttaatatttgctactgttaggtgtaattagaagatacatgaaagaggcagggtgtggtggcttatgcttgtaatcctagcactttgggaggctgaggcaggtggatcaacatggcgaaatcccatctctaccaaaaatacaaaaaattagccaggcgtggtggcacccgctgcacctgtatcagctattcaggaggccaaggtgggaggatcacttgagccctggaggcagagattgcagtaagccaggatctcaggatcgtgccactgcactccagccttggagacagagagagactccatctcggggtggggggaaaaaaaagagaaaaagtgagagagcctggacaacataacaagagcctgtctctacaaaaataaaattaaaaaaaaattagccaggtgtgatgccacatgcctgtagtcctagctacttgcaagcctaaggtgggaggatccattgagcccaggagttcaaggctgcagtgagctgtgatgttgccgctacactccaggtgacagagcaagaccctaagaccttatctcttaaaaaaaaaaaaaaaaagacgtgaaagttcagtaaatgtttgcagagatgaacgctggtatttaaagaagtagaagggattttaaagcaattactgcatttcagctaaaatccgaagaccttatcatggtctcataggtccaacattatctggactttacccatctaacctcaggtcctaccttatctaccacttcactgtatcttggctacgtaggcttcctttttgccatgccaaacttatccttgtctcggagttttgtttcttgcctttttcctttgcctggaatattccccctgtagctctgcacatctcaggtcaacattaccttctcagatcttttctgaccactttagcttgagacttcctcttccttggttactttctggttactttatgacatttttttcattttcttagtatctgaaattaacctgtttatttgtttctgtttatttcttgtcttagtctgtcaatataagttccctgaaggcaaggatatcatatgagatcgttcttgttctgtatgtagtaaagattcaaacaatagtaaagaagttggaacccttatacagtgctgctggaaatgtataatggtgcagttgctttggaaaacagtttggcagttcctcaaaatgttaaacagttaccatatgatccagtatttccactcctaggtgtgtacccagtagaaatgaaaacatgcccacaccaaaccttgtatacaaatgtttatagcagcattattcataagcaaaaagtagaaacaacctgaatgtccctcaactgatgagtgaataggtaaaatgtagtgtatccacacagtggaatatttgggaataaaaagggatgaggtactcaatcacaagaacattacactaaggagtcaggcatgaaagaccacatttttattccatttatatgaaatatccaaaataggcaaatctatagagaaagagggaaaattagtggttgccttggattagaggggatagggaggtttggggtgaggtgactgccaatgtggatagtaaatttagggtgattgaaagtcctgaaatagattacagtgatagttctataactctataaatgcactaaataatgttgaagtgtacactttaaatagataaacttcatgatatgtaagttttatctcgactaaactcttaaaagggattgaagcaataaaaagcatatagaatattttctctcttgattttacatttatcatttggatattacctgttttaaaataatagcagcctgggcaacatggtgaaacttcatctctaccaaagaaaaaaaaaaacaaaaattagctggtgtggtggtgcgttcctgtagtcccagctcctcaggaggctgaggtggtaggattgcttgaacctggggggttgaggctgcagtgagctatgatcgcaccactgaactccagcctgggcaacagggtgagaccctctctctagaaaataaaaattaaaataataatggaataatttaatggggaaacttcagctcctagttagttccacaaatgtggtaagtgcttattaaataactgatggaggaggttaggtaagtatacagataattatgatacaatacatagtttgataaatgctcagaggggactaagccaggggtcataagtgtttgatagtgttcaaaatccatatctgagtttgtgtgaggggaatgaggaaaggcctcctgtaggaggcagcattcgagataagctttgaaggctggttaggcttttgctggtagagacagggatggggacaaggcattgagaggaagcaagcaggagcagaggcatgtcaacagttactagcacattttaatggagctgagggtgcaggtaggataggaatgggaaataaggctgcgaaaatagattagggtctgtagtggacaatgtgtttttactatcctcctgatgcctagtgtgcctccaatggctcatacttaggaagaacgatacctcttacctgcagagagctggaagtgtctggggacatatcctcctcccgctcacagaccactgtcaggagtgtaactttggagcaggggctttgacttgtttccctctgtatcatcagacttgaagcagggcttggcacctggtaaacattcagaaaacatttgaatgaatgaatgaaaatcaagaagtggcaagcaaggtctatttaaagcaaagcaaagtttattttacgaagccccttgacaaggagattttggaagcctcttggatttggagctaaggagtttagttaggaaaagagatttctggtaatacgaggaatgttttaatgaaatgaatttggtagtaacgtgcaggttgaactggtggatggaaggattatgtctgtgctccccatctccactgtccctttcctgttcccactccattaggccttgacaaaggtcaaggacttcccgcagtccaataataatctcctaacatctctccttgcttctactctctccctaaatagggtggtggcagcagaatagaaaggatcagatacaacagataacactgaaggaaaaaatctacgacttcagaaagtaaatatttctaaaagaaatagagaagttatgaagcacagattttattgcagcggactggcagtttttactcttagggttggccagctagtaaatttattgcatacctgcgtgtgtctgtggctttcgaactctgaaattgtgcattgactccatgaacaagttaatactgtgagactgccaccctgtggacaaaatatcaggactaaaaccatcaagaattaaagtttcattcatttgcgatttactgttttagaactggctttggttcttccacgttggtgcatgcagtgatgctcattaaatagaaagcttgaaattaattttttctctgaattttttctgaggcttttaaataaagggaatctaaaatggaaccagtagttttaaaaagctgcaatgattcaagagtggtttttagatggtacttctttgctctagaaatttcatatggaagggttggttttttaaaatattgtggcatgtaggcctgttgtgaaatggtcatttatcccttttgttgtactgatttttttcatcccattttataagacatatggtattatccttgagagttatattttttgagaaatatatcaaacatccccccacacccttttttggctaagtgaaagtggccttcttgcctcgtttttttgtggatttggttgtagttgttaaaagttctctacgttttggatggattgccttaattgtatttatacaaatgagtttggtttatattacgctacttatttagaaggacactctgctcacaaattatactagtttggtagtttcataaactagcttgaatcaaaataaaatggtgattgtgaaatacttatttgctcactgcaactcaggaaatgtttcagttttggactcacgaccaaataaaactttcctaagagatgagctgtttacagccaataatgttataaatatcttacacacttgaattcccagaggtgtcagaaggggtggggtagccatttagggcttgaaatttgtgtcaccagtaaagcagaagtgggttgaagcagccatctgaggtcagcaattgtgccttatttaagaaggtgatatccacactgaggagaatggatgaatcattgattgacccccttgccactgatacttcaccatagagacctggtactttaccataaggaccttacgttttggtaatgtactaatggtcaaatataatgttaatgatcttaattttttttttttttgagacggagtctcagtctgtcacccaggctggagtgcagtagcatgatctcggctcactacaagctctgcctcccgggttcaagcaattctcatgcctcagcctcatgagtagctgggattccaggcgtgcaccaccatacccggctaatttttgtatttttagtagagatggaatttcactgtattggccaggctggtctggaactcttgacctcaagtgatcctcctgcctcagcctcccaaagtgctgagattacaggcgtgagccacagtgcctggtgattttaattatttaaatatttctctgagtcagttctgaaaaatgtagtgtgacaaacgcaataaactttaagtgttcggttttatttaactttttcaaagtaaatatatggagttgtgggtaacttttcaaaattattttttgctaacacatatgtctcacattctacaaacagtgctgtgtaattgtaagtgaagtagactatgatgaaagtgcacgtttatgtaggtttacaaggtaaattgccatataatgtagatcatttagattaggttagtattatttagatacagtttaagaaaagtagcttactttcttaaatttatttttaagtatttactcatttatttatttattgagacagggagtctctctgtctcccaggctggagtgctgtgtcatgatcatggctcactgcaacctctaaatgctgggttcaggtgatcttcccgccttggctttctaaagtgctgggattacaggcgtgagcgactgtgcctggccaaggaaggtaactttcaaaatacttggtgatctatttactcttcacctaggtattgaatgaagagtcaataaacttaaagatatatttgttttctagtcttctttaatggttttgctatgatatcctttttaaaattgtaaatgacaatgaacttacataaatttttagtttaacatttcaccagcacttaagagactttatcacacaatatctttctacatttttatgctataatggttactatttcaggattaatggaagtgttcactcctgagttcatttcacaaatttaaatactaaaacattttgttctttgaaaagtaattctggccaggcgcagtgtctcacgcctataatcccagcacttggggaggctgaggtgggcagatcacttgaggtcaggagttcaagaccagcctggccaatgtgatgaaacctcgtctctactaaaaatacaaaaattagctgggcatggtggtgcacacctgtaatctcagctacttgaagggtgtgtcaggagaatcacttgaacctgggaagtggaggttgcagtgagtcgatatcatgccattgcactctagcctgggcgacagactgagtgagactctgtctcaaaaaaaaaaaaaaaaaaaagagaaaaagaaagaaagaaaagtgattctaatatagacgacttgaactttgaaaaagcaataactattctataaattttgtgtgtatgcaaactttaaaacatcttttatttttgaatgcacactaatcactattgaatacacacctttgacttaaaacatttttgtgctttattttaaatttgtgggaaggtgcctagcctagtgactttttgatccagagagtcattctagattgtcgtaaatctttatttgcagtttaatcttattacttaaagttttttgaatttagagtccagagaccaagatacatttctgatttagaatgtgttgatatattgctctatatgaaacttttttatccgttttcaggtgtgtgtgtgtgtgtttttcattttcagttttaatcaaacatttaattcaacttttcaaggttgtaatgggattcattttacctcagctgttcaaacgtctgtgtttatcatcgataccctctaatgccaaggtgcacagagctgaaatagaaaggaagggtacagccacaggcaaagagaatgggataaggtgtcccagcgcatgaattgggggcagtagtgaaggaggagtatcctgaagggaggcaaaacataagcttaaggaatttggagctccaagcaggcaggtggcatcagagaatttcagatatgagtgggaatgcctttcatttgtttttttttccctttgtttttatgccatttcacatgaactacaatattactgtcccttaaagtgctacttttaaaaacttttttcttttgcattgccattaccttctagaaggttgtttgtttatgaaacatatttttagatggctttttgccacaaatgtgtgggaaatgaaggcacataaagtttatatgaaagcagtcacaacctgatactcattaggatgggtcctattaaaacaaaacaaagcagaatataacaggtattggcaaggatgtgaagaaactgaaactcttgtacaagaattcctgtgttggtggggatgtaaaatgttctggccacaatggaaaacaggatggcactttctaaaaaatctgaaagaggccgggtgtggtggctcatgcctgtagtcccagcactttgggaggcttaggcaagtggatcacgaggtaaggagttcgagaccagcctggcaaatatggtgaaatcctgtctctactaaaaatacaaaaattagctgggcgtggtggcaggtgcctgtagtcccagctacttgggaggctgaagcagaagaatcccttgaacctgggaggttgcagcgatccgagattgtgccactgcactccagactgggcgacagagcgagactccatctcaaaaaaaattttttttgaaagagaattatcataatccagcaattctgcttcttgatatatactcaaaataattgaaagcaaggtctcagagatatttgtatgttcttagcagcgttacaataataaatatttattatgttaccaaaaggtggaagcaacccaaagatcagtcagtggatgaatggttaaagtgtggtgtgtacatacagtgaaatgtgattcagccttaaaaaggaaggaaattctgacaacatgctacataaccttgaggacattatgctaagtgaaataagccagtcacaaagaagatatactgcatgattcaccttatatgaggtacctagaatagtctcatagagacttaagtagaatggtggttgccaggaactgggggtaagggagaaaggggggttattgcttaatggatatagagtttcagctttgaaagatgaaaagagttttgttgcaccacaatgtgaatgtactaaagactattgaactgtatacttaaaaaggattaagataatacgttttgttctactttaccccaattaaataattttaaaaagcaaatttcagtttgtatgtggatactctatgcacattatttatgaatgtaaacagcatctgtaatgatgcagtttcttatttcaccaatatgtgagtgttagatgctgggataaaacaatgataaaagctgacaagatcctcatgaagcttgcagtttagtgggagagacggacatggattgaacaagtaaaaagtgtgcttaagtgtacacgcatggcagggagacccctaacatagtgtagggaagggctggattgagaaggcttccctaaggacatgacgtttctgtagagatccaaaggatgactaagccttatgtaagagaaagggagaaaagggaagagagagtagattgagggagtagcattttgcaaatggtctgcaaggaggaaagagtgtattttgggaaatgaaaggcctggtgggctgtcatgtagaaagtgagatgcaatgggagatgaggctgcaaggtatcaaatcatataagacattctaggccatgttagatattttgaattttatcttcagcagagtgggcagatattgatgggttttaaatgagggattatggaggtggaatggcataggagcaagaaaaatgatgtacttttttgtacacttggtctttaactgtaaactacctgtttagtatggtgcttgaatgttggaggggattgtatattggccaccattgtgagctgttcatatggtaaagtgtacttaaagggtgaacttaagagaattgtcaagggtaattgaggataagtgattttcaccttgatactgtgatttggtagtttgaagccctagaaattgatacttgacttgggagagtctggagtaagaagaagactttgagcttttaggacctctagtggtaagtggtgaggaggtggggcagagaaaactgagaaagagtagtccagaattggggcaaaatcaggagagtgttatcaaagaagccaaagaagtgtttaaagtgataggtctaacacaacaagttctgaaagtgttcattggatttagccctgggaggtcattaactttagttagatttagtggcataataggggcagaattaagttagattaggctggttgaagaatgagcgggagatgaagaaatgagtaggtgaggacagtatatacacatcttttgaggaagtttggctgtgaaaagcagggagtgagaatgaatagtagttgtagttggggttgcggtgtgtgacagggtgccaattcaggttctttttttttttttaaaggaaaaacttgaattaaaaaaataccttcggctaggcgtagtagctcacaactgtaatcccagcactttagcaggctgaggtgggcggattgcttgagcctagaattttagactagctggggtaacatactggtatcctgtcactataaaatattaaaaaattagctgggcttggtggtgtgcccataatcccagctactcgggaggctgaggtgagatcactcgagccctggaggtcaaggctgcagtaagctgtgtttgtaccactgcactccagcctgagtgacagatggagaccttgtctcaaagaaaagactgtaggcagttccaagatggccaaataagaacagctccagtctacagctctcagcgtgagtgacgcagaagacgggtgatttctgcatttccaactgaggtaccgggttcatctcactggggcttgtcggacagtgtgtgcaagacagtgggtgcaggccaccgagcgtgagccgaagcagggcgaggcatcgcctcacctggaagcgcaaggggtcagggaattccctttcctagccaagagaagctgtgacagaaggcacctagaaaatcgggtcactcccaccctaatactgtgcttttccaacggtcttagcaaatggcacaccaggagattatatcctgtacctggcttggagggcctcatgcccacagaccctcgctcattgctaacacagcagtctgagatcgaactgcaaggtggcagtgaggctggggaaggggcacccgccattgctgaggcttgagtaggtaaacaaagtggcctgaagctcgaactgggtggagcccattgcagctcaaggaggcctgcctgcctctgtagactccacctctgggggcagggcatagccaaacaaaaggcagcagaaacctctgcagacttaaatgtccctgtctgacagctttgaagagagtagtggttttcccagcacagagtttgagatctgagaacagtcagactgcctcctcaagtgggtccctgacccccaagtagcctaactgggaggcacccctagtaggggcagactgacacctcacacggccaggtacccctctgagatgaagcttccagaggaatgatcaggcagcaacatttgctgttcagcaatattctctgttctgcagcctctgctgctgatacccgggcacacagggtctggaatggacctccagcaaactccaacagacctgcagcctgagggtcctgacccttagaaggaaaactaacaaacagaaaggacatccacaccaaaagcccatctgtacgtcaccatcatcaaagaccaaaggtagataaaaccacaaagatggggaaaaaacagagcagaaaaaccaagaattctaaaaatcagagcacttctccccctccaaaggaatgcagctcctcgccagcaacggaacaaagctggacggagaatgactttgacgagttgagagaagaaggcttcagacgatcaaacttctctgagctaaagcaggaagtttgaacccatggcaaagaagctaaaaaccttgaaaaaagattagacaaatggctacctagaataaccagtgtagagaagtccttaaacgacctgatggagctgaaaaccatggcaggagaactacgtgacgaatgcacaagcttcagtagccgatttgatcaactggaagaaagggtatcagtgattgaagatcaaataaatgaagcgagaagagaagtttagagaaaaaagtaaaaagaaacgaacaaagcctccaagaaatgtgggactatgtgaaaagaccaaatctgcgtctcattggtgtacctgaaagtgacggggagaatggaaccaagttggaaaacactcttcaggatataatccaggagaactcccccaatctggcaaggcaggccaacattcaaatttgggaaatacagagaacaccacaaagatactccttgagaagagcaactctaagacacataatcgtcagattcaccaaagttgaaatgaaggaaaaactgttaagggcagccagagaaaaaggtcgggttacccacagagggaagcccatcagactaacagcagatctctcagcagaaactctacaagccagaagagagtgggggccgatattcaacattattaaagaaaagagttttcaacccagaatttcatatccagccaaactaagcttcataagtgaaggagaaataaaatcctttacagacaagcaaatgctgagagattttgtcaccaccaggcctgcgctgcaagagctcctgaaggaagcactaaacatggaaaggaacaactggtaccagccactgcaaaaacatgccaaattgtagagaccattgatgctaggaagaaactgcatcaactaacaagcaaaataaccaactaacatagtaatgacaggatcaaattcacacataacaatattaaccttaaatgtaaatgggctaaatgctccaattaaaagacacagattggcaaattgggtaaagagtcaagacccatcagtgtgctgtattcaggagacccatctcatgtgcagagacacacataggctcaaaataaagggatggaggaagatctactaagcaaatggaaaacaaaaaaaggtaggggttgtaatcctagtctctgatagaacagactttaaaccagcaaagatcaaaagagacaaagaaggccattacataatggtaaagggatcaattcaacaagaagagctaactatcctaaatatatatgcacccaatacaggagcccccagattcatgaagcaagtccttagagacctatagagagacttagactcccacacaataataatgggagactttagcaccccactgtcaacattagacagatcaatgagtcagaaagttaataaggaaggatatccaggaattgaactcagctctgcaccaagtggacctaatagacatctacagaactctccaccccaaatcaacagaatatacattcttctcagcaccatatcgcacttattccaaaattgaccacatagttggaagtaaagctctcctcagcaaatgtaaaagaacagaaattataacaaactgtctctcagaccacagtgcaatcaatagaactcaggattaagaaactcactcaaaactacatggaaactgaacaacctgctcctgaatgactgctgggtacataacgaaatgaaggcagaaataaacatgttctttgaaaccaatgagaacaaagacacaacataccagaatctctgggacacatttaaagcagcgtgtagagggaaatttgtggtactaaatgcccacaagagaaagcgggaaagatctaaaattgacaccctaacatcacaattaaaagaactagagaagcaagagcaaacaaattcaaaagctagcagaaggcaagaaataagtaagagcagaactgaaggagatggagacataaaaaacccttcaaaaaatcagtgaatccatgagctgttttttttttttaaagatcaacaaaattgatagaccactagcaagactaatgaagaaaagagagaagaatcaaatagatgcaataaaaaatgataaaggggatatcacaactgataccacagaaatgaaaactaccatcagagaatactataaatacctctatgcaaataaactagaaaatctagaagaaatggataaattccttgacacataccccctcccaagactaaaccaggaagaagttgaatccctgaatagaccaataacaggctctgaaattgaggaaataattaatagcctaccaaccaaaaaaagtccaggaccagatggagtcacagccgaattctaccagaggtacaaggaggagctggtaccattccttctgaaactattccagtcaataggaaaagagggaatcttccctaactcattttatgaggccagcatcatcctgataccaaagccgggcagagacacaacaaaaaaagagaattttagatcaatatccctgatgaacatcgatgcaaaaatcctcagtaaaatactggcaaactgaatccagcagcacatcaaaaagcttatccaccatgatcaagtgggcttcatccgggggaatgcaaggctggttcaacataagcaaatcaataaacgtaatccatcatataaacagagccaaagacaaaaaccacatgattatctcaatagatgcagagaaggcctttgacaaaattcaacagcgcttcatgctaaaaactcttaataaattctgtattgatgggacgtatctcaaaatagtaagagctatttatgacaaacccacagccaatatcataatgggcaaaaactggaagcattccctttgaaaactggcacaagacagggatgccctctctcaccactcctattccacatagtgttggaagttctggccagggcaattaggcaggagaaagaaataaagggtattcaattaggaaaagaggaaatcaaattggccctctttgcagatgacatgattgtatgtctagaaaaccccattgtctcagcccaaaatctccttaagctgataagcaactttagcaaagtctcaggatacaaaatcaatgtgcaaaaatcacaagcattcttatacaccaataacagacaaacagagaaccaaataatgagtgaactcccattcacaattgcttcaaagagaataaaatacctaggaatccaacttaagggatgtgaaggacctcttcaaggagaactacaaaccactgctcaatgaaataaaagaggacacaaacaaatggaagaacattccatgctcatggataggcagaatcaatattgcaaaaatggccatactgcccaagataatttatagattcagtgccatcaccatcaagctaccaatgacttcacagaattggaaaaaactactttaaagttcatatggtaccaaaaaagagcccacattgccaagtcaatcctaagccaaaagaacaaagctggaggcatcacgctacctgacttcaaactatactacaaggctacagtaagcaaaacagcatggtattgctaccaaaacagatatagaccaatggaacagaacagagccctcagaaataacaccacacatctacaaccatctgatctttgaaaaacctgacaaaaacaagcaatggggaaaggattccctatttaataaatggtgctgggaaaactggctagacatatgtagaaagctgaaactggatcccttccttataccttacaaaaaattaattaaagatggattaaagacttaaatgttagacctaaaaccataaaaaccctagaagaaaacctaggctttaccattcaggacataggcatgggcaaggacttcatgtctaaaacaccaaaagcaatggcaacaaaagccaaaattgacaaatgggatctaattaaactaaagagcttcttcacagcaaaagaaactaccatcagagtgaacaggcaacctatagaatgggagaatatttttgcaatctactcatctgacaaagggctaatatccagaatctacaaagaactcaaacaaatttacaagaaaaaaacaaacaaccccatcaaaaagtgggcgaaggatatgagcagacacttctcaaaagaagacatttttgcagccaacagatacatgaaaaaatgctcatcatcactggccatcagagaaatgcaaatcaaaaccacaatgagataccatcttacaccagttagaatggcaatcattaaaaagtcaggaaagaacaggctggagaggatgtggagaaataggaacacttttacactgttggtggtactgtaaactagttcaaccattgtggaagatgtggcgatccctcaatgatctagaactagaaatgccatttgacccagccatcccattacagggtatattttcaaaggattataaatcatgctgctctaaagacacatgcacatgtatgtttattgtggcattattcacaatagcaaagacttggaaccaagccaaatgtccatcaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccgcatgttctcactcataggtaggaattgaacaatgagaacactcggacacaggaagggaaacatcacacactggggcctattgtggggtcgggggagtggggagggatagcattaggacatatgccaaatataaatgacgagttaatggatgcagcataccaacatggcacatgtatacatatgtgacaaacctgcacgttgtgcacatgtatgcttgaacttaaagtataataataataaaaaaaaaaagaaaaagaaaaagctgtaaccccagcactttgggaggcccaggcaggcgaattacttgaggtcaggagttaaaactgtgcaaagtgaaactttgcctttactaaaaatacaaaaattagccgggtgtggtggcatgcagctgtaatcctaggtactcaggaggctcaggtaggaggatcccttgaacctgggaggcagaggttgcagtgagcttagatcgtgccactgcactccagcctgtgtgacagaacaagactgtctgaaaaaatataaatacataagtaaataaataatatctcctatagagtttaggaaatatttgaaaaatatacactttgcttaaacaggatctactgaatacaaatatgaccttcccactgacttagtctaaatatggtattccgggattgtgtacacacaggtattgagatgtgaaggtctgtatgttactatactaacttctgatcatctggaaagtaaaaaatagagaatcttgagtccacctaagacttacagttgaatctttaggtgtaggactcaggagtgtgtgcatctttagatgattctggtgcatctgatctatggactggctttttgaagtcttctggatgccctttttttttccccctggaaaaagggtctcactctgttgctcaggctggagtgcagtggcgcaataatggctcactgcaccctctgcctccttagctcaagtgatcctttcttcttaacctctgaagtaggtgggactacaggtgcgcgtcaccacacccggctaatctttctgtgttgtttgtagagacaaggtttctccatgttgcccaggctggtctcctcagctccagtgattttcctgcctcagcctcccaaagtgctggggttacagtcatgaaccactgcacctggctctggatgatttttaatagttctgtcttgaggattaaatgagatgtgtatgtcaaggacttagcaaagaaagactttgaaaatgtcgtctgcttatacagttcggatggtgtaataggtttttttttttttttttttgatgaaaccagcttgatcctttttttcttactgtaaaagtgcttcatgctctgtataggttcttctctagctgctttttgtacttcttccctctcctctctgcattctagccatgatgcttcctcctaccccactgcctttgtttgtgcctataattttctctcctgatggtatgcttcctcagcctctttacatgactggctgcttaacattcaggtttcatatccacggtcaccttttcagaaaggccatccccaatcactctatctaaaataggttttcctggtcattctttgtcacttgttgatttccttcaaatggggacagggaccatgtttgaattgtttaccttagtctgcggaacagtgcttggctcatagtaactacttaaataccgagtaacaaatatgagtcatagaaatcttactagccagagtaagtactgttaactctttgtgcagggatccccagccccctcaggcctgcagacttgtacccatccgtggcctgttaggaaccaggcggcacagcaagagatgagcagcagatgagcgagcattactgtctgagctccacctcctgtcagatcagcagcagcattagattctcataggaatatgaaccgtattgtgaactgtacatgtgagggatctaggttgcctgcttcctaagagaatctaatgcctgatgatctgaggaggaacagtttcatcccaaaaccatcctccccaacccctgccccccatccgtgaaaaaattgtcttccacaaaactgtccctggtaccgaaatggttgggcactgctgttttagttgaccatcattgcatatactgaaatgtagatcatgcatatataagtattatgtgatcacatactgttttgtaacttttatatttcacttaaatatgtcctggagatttttccatacctgtaccattttatttagacaatagcagtatggtacattccatataatgggatatagtttctgtgacgtttcccgatttacataatagtttgtttctagtttcttactactttgaacaatatcgtgctgaatatatatctacatctttgcacgtgtatttattttgttagaataaatcccaaggactgaaactgctagataaaaagatagaggcattaaagtcttttggttgtgaagttgccttctggaatgatactctttggactctcataaataaaatatgaaaacatttttttccatgtaccctctctaatcatttgaatctttgctaatttaatttagtaggtgaaaaatggcattgtttttctgctctgaggttatgagaatgaacatcttttcctgtatgactacatttcttttgtgaagtgcctattcatgccttatgcctgtttttctattagggtatttgtttcaattaacaatagctttttccctccatattttattatgaaagttttaaaacacacagcaaagttgaaattttataatgagtactcatacacccactacctaagtttttattaaattgcagatattagtacattttcacttaaatattttagcatgcatgtcattgagcagtgtttcagtattttagtttttttcttttgagataaaaaactgtcttagaactaaatacatatatctctttaccttaaacactttattttaacttaaaacctagaattggatgttaattgatcaatcttttgatgaagggtccaagaccattttctttgagagtgagcccactgtcacagttctgtattgtatcgtcttaactgcacatccacaatatattgcctaagatttctagttttcgttttttaagtgaagcaagagatttattttggaaagcatttgctgagttttgacaaatgtatttgcttgtgtaagctaaacttaagaataggtttttttttttttttttttttaaaaaaaggactttttgtcatatttttccctagtttgttcctagccttagctttggttatggtaattttaaaaattatttatttacttacttatttattttttaagatggggtattgccgtgttacccaggctggtctcaatctcttgggctcaagcgatccacctacctcggccttccaaagtgctgggattacagatgtgagccactgtacctggcctaggttatagtgcatttacatttttatgtactaaaatgtcatccttttcctttacttttttttcctgcccttttgtcatacatagaaagtcttttttttttttttttttttgacaaagtctctgtcacccagactggagtgcagtggtgcaatctgggttcactgcaacctccacctcctaggttcaggcgattctgcctcagcctcccaagtagctgggattacaggtgtctaccaccacgtctggcttatttttgcatttttagtagagacagggtttcaccatgttggccaggctggttttgaactcctgaccacaagtgatccactgcctccgcctcccaaaatgctgagattacaggtgtgagccactgcgcctggccagaaagtcattctttatcaattagtgtataaatgtttatccatattttattccatacttttacatttaaatgtctaattggaataatgtgatatagggacttaaaaatttttggcagtgcttttaaattgttagctaatgccatttgatgaacaaacttttttgctttgaattttttcagacaagatagaatctaatgtttttatagataccttttctttgagacggggtctcgctgtcacccagactggagagcagtggtgccatctcagctcattgcaacctcgatctcctgggctcaagcagtcctcctgcctcagcctccccagtagctgggaccataggcttgagccaccatgcatggttaatttttgtattttttgtagagatggggtttcaacatatttccaggttggtctctaactcctgggctcatgttgtctgtccaccttggtggcctgataccatttttattatcatcactgcccaaagtgctgggattacagacatgagccacctcacctggcctgattccatttttattatctaagtttatatgtaatatcagatctttttattttacatcctgtcctatttattcctgtacttagctgcttgaggtaatttgtggcatattcctcctcactattcctttttttttttttttttaaggtttcttcactttgctaacatagtctttctttgggtgaactttagcagatccttgagggatggggagaaaaaatatagtggggagacagtagcaagagtgaaagtagagaggttggtaaactctggagatttacctcaataacttgtaattgaattcttagtctgtgtagcacattatacatgcatatttttgtatccttaaatttgggaaatgtctgttgaggatgttcaaactaatttcttttttcttttttttctttttttttttgagacggagtctcgcttagtcgcccaggctggagtgcagtggtgtgatctcggctcactgcaacctccacctcccaggttccagcaattctcctgcctcagcctccctagtagctgggactacaggcatgcgccaccatgcccggctaatttttgtattttttagtagagatgaggtttcaccatattggccaggctggtctcaaactcctgacctcatgatccatccgcctcggtctcccaaagtgctgggattacaggcatgagccaccgtgcccagcctcaaactaatttctaaagttcaaaatatttttgaggtttgaggtttgggatgttatagaaagggcataggattctggagtgaaaatggatttaaatgttggctttaagtttactaaccatgtggccacaggcaagttgtaatttttgaccaaatgtatgtatcacagatattatttctcattattctgttacttgactgggtgattcttgagatctaggctgacccatcttggcctaaaggcttaatcgccttcaggagagagacttggagatagaaacttgagaacattaaaaacgcttagcacattgtatatgacacttagcacattgtatgtgcccaagaaacatttcctaaaatgaatctaagtctaaaatacttttaaggttttttttaatatatatatatattttattatactttaagttctagggtacatgtgtacaacgtgcaggtttgttacatatgtatacatgtgccatgttggtgtgctgcacccattaactcgtcatttacattaggtatatctcctaatgctatccctccccactccccccaccccacaacaggccccagtgtgtgatgttccccttcctgtgtccaagtgttctcattgttcaattcccacctatgagtgagaacatgcggtgtttggtttcttgtccttgcaatagtttgctgagaatgatggtttccagtttcatccatatctgtacaaaggacatgaactcatcattttttatggctgcatagtattccatggtgtatatgtgccacattttcttaatccagtctatcattgttggacatttgggttggttccaagtctttgctatcgtgaatagtgccgcaataagcatacgtatgcatgcgtcttcatagcagcatgatttataatcctttgggtatatacccagtaatgggatggctgggtcaaatggtatttctagttctggatccctgaggaattgccacactgtcttccacaatggttgaactagtttacagtcccaccaacagtgtaacagtgttcctatttctccacttttaagttttaaagtgtcatttgtgtcaatgatttgacttcaagtatggagggagagaagcagagtagtttagctatagccaaaacgtttcatttgtcatgatagtaaaacatgagttcaaagaaagtattaattgttcatctatatggcattaagaaatatgaataaataaagccagagtctaaaatcttatttgaacattcctttttgctgaaacttagctgcctgcttctaattagaaaaaaatttttttttggccggctgtggtggctcatgcctgtaatcccagccctttgggaggccgagacaggtggatcacgggatcaggagttcaaaaccatcctggctaacacggtgaaatcctgtctctactaaaaatacaacaacaacaaaaaaaaattagccgggcgtggtggcgggcacctgtggtcccagctacttgggaggctgaggcaggagaatggcgtgaacccggaaagtggagcttgcagtgagccgagattgcgccactgcactgtacttcagcctgggtgacagagcaagactccatctcaaaaaaaaaaaagaaaaaaagaaaaggttttttgttgtcgtcaatttttgttgttgttgttgttgttgttgttttttttttaacaagaagttgtgttaagtaaaggcctgaaagggacagaagacaaaaagtcgaatggaagggccactttaccctaatcttttgggagttttcctttttttttttttttctttttgttcttttcctcatctctgtatctctttctctctaaagtattatttttcacctattaatgtatatgggggtgttgaggtatagaccctgggtcaaatccagaagctattctctctttacagatgcagagctttactgctgtagacttgattcctaaacagggctaccatacccatcctaacccagctgttcagagaatttagattaagtcaggaaagtgagaaagtggccttggctttttgtgtactttagacctatacagtggtctaaatgacctgagaatggttcaattgggtggaaaagggaaaaaaaaaaggtttatcattgagccaataattagttcaatttctgaatgtttcatttagcagatatttattaaataactactgtgggacaggcatgctatcatgctgaaataaatgaccaatgaggcgtgtaaacaaatgatacggaatgtaatgttctttaccaggtattctagcagagtaggaagagtattccagtaggaagagttctgaaggaaatctattcatccttgagtgctcaaaatgcaaagagtgctttgcgcatagcagtaaccataagtgtgtgtacgaatgaataaacatgattcaaacaatgtgattagatcatttacaaaatactgtgagagcacaaaggaggaagtgaccaattcttccttttaatgacacagtgaggagagaaaggctcttgggagattcagtaggtggagaaggcctgaaaaggtagagtgaaaaagcatgacaatgctctgaactaacaagttcagatgtagagtatatgctgggggcgtagaatgccgaggtaaggcatgataaggtagacagaagtcaagatggataaatgttttgtattggaatttattctgtgggtgctgataggccagtgaaggtttttttttttttttttttaataggaatattaaggggtagaatttgagacattcctttaaaaataaattattcttgaattgggaaatcaaatgatagaattgtaaaaattataagcatatatgttggcaatgattatggctaataagtcgtataatatatggtggaatctgttttatccctttcagataacatataatcttagtacagataaaaccattttaatcaaaatatgcatgatgtcatcagtttgtttttgaaagagatttatttttactttatggaattattacagactgtattctttcttaaagattctggcatttttttaaaacttattttgaaatgatcttaagtttagaaaagagtttcttaaatagcgcaaagaagtcgtgtatattttttatccagtgtccactgatgttaacgtcttatgcagtcatagtatagtgatgaaaactaagaaactaacattggtacagtgctattaactgtagactttattaggattttcccagcttttccactaatgtcctttttctgttccaggatctagtccaagatataccacactgcacttaatggttatctctctcatccccccaaatctcttttttgaccttgaccctttggaagagtaccagtcaggtattttgtagaatgtccctcaatttgattatatctcttgttttcttgtgattacggcctgaagtaatgagttttggggctcttggaggttttttaaaatttcattttatttttcaaattatcataaagttgacttttttgtggacagctctgtgaattttgacatgtctaagtttgtgtaaccatcaccataatcaggatatagaacaattcatcacttccccaaatcctcatgctctctcaatagtcacaccctccccaaaatctgtatccctggcaaccactgatctgttctccatcaatgtagttttgtctcttcaagaaatgttatataaatggaatcatatagtattcagtggtccctaacctttttggcaccagtgaccagtttcatggaacacaatttttccacagaagttggtgggatggtttcaggatgaaactgttccacctcaaatcattgggcgttagattctcataaggagcacgtaacctagatagtttgcatgcacagttcacaatagggtttcctctcctatgagaatctaattctctggctgctctgacaggaggcagaactcaggtggtgatgctcgcctgccttggggttgaggacccctgcagtatgtaaccctttgacactggcttctttcactcagcataatgcttttgattgtcatctaagttgtatttatcaatagttagctccattttattgctaagtatggatgtactgcagcttgttcatctgcctcttttcgttatgtatttgagaacatactatgtgtcctggcactataacaagtaatttaagtgaattattatgtgaaataaggattataactgtccctttcacagatgtgaaaacagaggcttagagagtttaagtagctttaagttaaaaactagtcaatagtagagttaggactcagcctgggtcacccactccaaaccccatgttcttaatcatgaggctacacagctagttgctaatgttggtttcctcatttctctgttttgaccagaagtgtaactaagagaagttaaagttcacatttctttaacgtgtcctaaaattccctttcttttctcttttatcaaagagcaaaaataataatagcaggggtaattttttaaaaaatcattttgggggctaagagttctgtgattcaggcctaaagcaaaaggttaagccaagtcagtcatcagtccgtaggacattatgacttaacatttaacattgagtggttctgtttatgagcattgtaaccatagtactaagttttttctttggtttgtttttttttttttttagaaacaaggtcttgctctgtcacccagggtgagtgcagtggtacaactgtagctcactgtgacctcaaactcctgggctcaggagaatcttctgctttggtctcctaagtagctgggactacaggcttgcaccaccataccaggctaattgttttattttttgtagagacagggtctcactgtgttgcccaggctggtcttgaactccttgcctcaagtgatactttcacctcagtgctgggattataggcatgagacactgtgcccggccctgttttttcttaatctccttataaatagaatatttgttttacagataattaataaatatcgctgggcgcaggggctcacgcctgtaatcccagcactttgggaggctgaggcaggaggatcacctgaggtcaggagttcaagaccagcctggccaacatggtaaaaccctgtcgctactaaaaatacaaaaattagctgggcatggtggtgcatgcctgtaatcccagctactcaggaggctgaggcaggagaatcacttgaacccgggaggcagaggttgcagtgagccgagatcgcaccattgcactccagcctgggcaacgagagcaaaactccatctcaaaaaaaaaaaaaagtaaataaataaatattaaataaaaatggagaggcattctaaatcagcctggtttaaaataagagggttgccttctatgatattgctttaaattttactaatgacaaaggtagttgtcttttaagaactgaaattttggtgtatttaagatgaccctttttgaacttgtgtgctaacagcccatttgctgaaatattctactgctataagataaaaagaatgtttctagaatgttagtgtagtatttctacattttattagtgaagtatgatatgtataattacattttcatggattttataaaacttctatgttattctgggtatctggtaactttatgtgttaccttagcaaattatataacaatttgatgaggagacttttttttttttttttttttttgacacggagtcttgctctgttgcccaggctggagtgcagtggcacgatcttggctcacagcaacctctgcctcccgggttcaagcaattctctgtctcagcctccctagtagatgggattacaggcgcccaccaacacccctggctaatttttttgtatttttagtaaagacggggtttcaccatcttggccaggctggttttgaactcccaacctcgtgatccacccacctcagcctcccaaagtgctgggattacagtcatgagccactgcgcctggccaaggagacttgttttaagtgtagcctcagtttgattttttgttctcagttctgtagatactattctgagaacctggagaggctataaaatcaaatgtcagaattggaatggatcttcaaaattatcagctctctagattgtcccaatattttacaaaaaaggaaactgaaattccatagtagtgtgaaataacttgtccacacttacagttagttgtagaagctgcacgatacagttcctgctctcaggtacattactggttaatcagtgtagaaacagacttgtacaaaattgacagtaatacaaaatagaatgttctagatagtaaaggtactgcttttcttttctttttttctttctttctttcttttttttttttttaatagggtctcactctttcacccaggctgtagagcaatgatgccattatggcttactgcagcctcaacctcttggcttcaatcctcccaccttagccacttgagtagctgggaccccaggcacgcaccaccatgcctggctcatttcttttatttttttgtagaaatggggtttcatcatgttgcccaggctactgttgaactcctaggctcaagtgattcacctgcttcagttccctgaagtgctaggattataggcgtgagccaccatgcctggccagatacaacttttcttaaacagtctcgtcacctccccactgcaccccccaccccccaaaaaaaacaacccaaatcaaaaaagctttctcttgaccctttcacaacaaaattactttctttttatgtgtgtgagacagaatctcactcctacccaggctggagtaaagtggcatgatcacggttcactgcagcctcaatctcctgggctcaagcagtcttcccacctcagcctccccagtagctgggaccacaggcacacaccaccaagtctggctaatttttatttatttttattttttgtagagacaggttctcactgtgttgcccaggctggtcttaaacttctgggctcaagtgatcctcctaccttagtctcccaaaatgttgagtttacagatgtgagccaccacacctgacccaaaattacttctgttttcggtttttcatctcttattctctcttaaactttacctaatcagggttttttgtttgtttttacctttgctgtaccatgaaaactttcctttcaaaaccaacagtgacctccatgttgccaaattcaactgtcatttttttctcagaccttatctaacttgatctgccatcagcatttggcacagttgctcattccttattcttggaaacacacatgcctttttttcttcctacatttctgagtattccttttagccttctttgttgttatgcctcatcttttctacttctaaatgatggagtgtcccaagagtctgtcattgttgcttttctaacctatagctttaatattatatacatgttaatgtaatataaatataaatatatatatatggtaattattcccaagtttatgatctctagcccatacctttaacctgggctttaggactgtatattcaactccaggactgcatatctaatttggtgtctctagtctgataactaatgagcatctgaagcttaatgtgttcagaactgaactctgatattcctctacctcaaaccattgccatttgtcatctttcctgtctcagttttggtaactgcagtctttccagttgctggagaaggagggcgccccagctccaagaaagagagaattcacctttctatccaggtccttagccaattgatggtgcccacccacattggatgagggcagatcttccttatggagtccactgattgaaatgcttatctccctgggcactttggctcacgcctgtaatccttgcactttgggaggctgaggcgggtggatcacttgagcccaggagttcaggaccagcctgggcaacatggcaaaacctcgtctctccagaaaacataaaaattagccaggcatggtggtgcatgcctgtagtcccagctactcgggaggctgaggtgagaggatcacctgagcctgggaggttgaggctgtgatcaggccactgcagtcaggcctgggcaagagatcaggactgtttcaaaaaaaataaaaaagaaatgccagtctctctggaaacaccctcatcctcacagacatacccaaaaataatactataccagttatctgggtacctcttaattcagttaagttgacacctgaaattaaccatcacagttccaccccttgtcaacttggcacccatgtggcacccatgtgcacctacttaaaccatatttaatctccgaatagagacaattacgaaattgtagctctgcctaaaatgatacaactaccctgcatacaattgaaaatgcactgatttatcctcagaagaggaggtaaagctcttgaatgttgttctcttatgtcccacaatttaattatatgatgtaaaattaacaatacttggccgggcatggtggctcacacctgtaatcccagcactttgggaggccgaggcaggcagattacgaggtcaggagtttgagaccagcctggccaatatggtgaaaccccgtctctaaaaatacaataataaaaatggaaaaattagccgggcatggtggtgtgcacttgtagtcccagctactcgggaggctgaggcttaagaatcgcttgaacctgggaggcagaggttgcagtgaaccaagattgcgccacttcactccagcctgggcaacagagtgagactctgtctcaaaaagataaaaaataaattagcaatacttaaatactgatataaagtaaatacatcttatattacatagtaaaggaataagaggaaagaacacaaagatatttgctttgttatatctatgtatatatacacacaaatgtattctgaacaaaatagggagaatatagtcatgacagttaaaatcctcatttccctaactggtcaggtggttatagctggcattgattactgccttcttgtactacatattctgtattctgtttgccttcagcaaacgccttagctggtcgtggttctttatttggtggggtgacccaaagcttcattcttaaagggtctgggctattagtagaccttcctggattgggttgttgtagtttcccgttgacttatttaaagggcatgataatacaaagagatgccccaagggatctcctgtattccagacatactcttctttatctgcactgtgagttagtagtccagcttcccattcctagtttagattaatcacccccagctatgttgactcagaggcatgaggagcccaaagtggctggatggtagttttgactccagttccatggaatcattattgtgtttcctggtggaagtattcctctctctctggaactaagacttctaggccaaaagagcataaagttacgggaacaggaagtaaaaattttgcttgtgggtaatggtgagtagtgccattcctatttgtattccttagttcaggaaacaaggaatattgactcctggctgtgggaaaaacagtaccatgtagtggatgctaactcagaatgtgtacagccttctggagaacctagtgctagacctgcaaggtattatcacctagctggcactgtaactgaatcttctaagggccatttcaccatcctgtcaagctagctgcttcaggatggcagggaacatggtaagaccaatgaattccatgagcttgagcccattaccccacttttgtgactgagataagttccatggtcagaagcaatgctgtgtagaatgccatgatggtagataaggcattctgtgagttcatggatggtagttttgggagaagcattgtgtacaggaaaggcaaatttgtatctagagtgtctattgcagtaagaacaaactgctgccccttctgtgatggaagcagccaccaggtagctggcggatcaccccagggaatggtgccatactgggggctcattgctggtctctgctgctagcagattgggcactcagcagtggccatacccaggtgagctgtagtgagtggaaatccatgttgctaagcccgtgaataacctccatccctgccaccatgtccaggatgagccccctgggcaatgacaggtggctggggaaaatggctgactggtatccataaaacaggtcatgctatccacttgattattaaagccctcctctgctgaggtcaccctttggtgagcattcacataagacaaatatcttcacatcctttgcccagttaggagagatctgttctgccccaaatttctttgtcaccaattttctggttatgttccttcgaagtccctgagcatcctgtgaaaccattatctattgcctatgcattgacgtataatcacacatctggccatttctccttcacagcaaagtgcgtaactgggtgtgctgccctaagttctgcctactgggaagatttcgtgactgggaagatttcatgactggatgttccagaaaaagggctgtagcactgcagctgtccgcttttgggtggtgctcgcatgtcgtgcagaaccatctgtaaacaaggctctgtcagctgattgtagaatattcctcatgaggccagaggtacaatctgggtgagaaaagacagtgtagcaccaggaaccatgggcatttgggccatttcatgtaacttgtgcctttaggacctacgcaggcccaatcacatatatgttacctccacttgatgattttaatggtgctatgcacgcccagctttgtggcttggagtgggtcaggtaacacccacttccaagtagattgcatgataacttggtggcccgtggtgaatgttcagtttctactaaggtccagtagcaggtcaagagctgtctctcaaaagggaagtattatctgcagttgatggcaaggtcttgctccaaaatcctacaggcctgtgctgtgatttagctatagagagaggcctgccaactgctgatacctcaagtaccattggatctgctgggtcatatggcccaagtggcagagcagcttgcagagcagatttgttacagatttgttacagagccttctattctgggcccccctcaaaactagcagcttttctggtcacttggtaattgggccggagtaacactcaaatgaggaatgtgttgcctccaaaatctaaataaaggagttaagtgttgtgcctttttcttggtagtaggaggagccagatgcaacaatttatcctttaccctagaagagataccatgacatgcctcacaccagtagacccctagacattacactgaagtagaaggcccttgaattttagtcagatttatttcccaacctctgacatgctatgtgttatcattaagcctagagtagttgctactcgttgctcattaggtccaataagcataatgtcattgatataatggactaatatgttaccttgaggggaaaggtgatcaagatccctgtgaacataggtctagggggttgatatatccctgagttaggacagtgaaggtatttttggccttgccatttgaaaggaaactgcttctggtgggcctcatggacaggtatgggggaaaaaggcatttgccagattgatagctgtatgtaacagataccaggagatctgttgagggtaaagaatgagctcacatctggtacagcagctgcaatcggagtcaccacttggttaagcttatgataatccaccgtgattctcctagattcatctgtcttctgcacaggccgaatagggtttatttatcagcagtatgtctcttttgtttgctgtctagcaaggggctagaacagtacctggcacatagtaagtgctgagtaaatatttgttaaatgaatgacaaagagtccctcaaatcagtcactaacttgacattgggaagtcactttgtacagacctcttatctctatttttaaaatgagactggattggattcgtgttttaagctgtcctacagtgaagacttaaatgtatggagtgtcaaggttccttgaagcctttataaaaattcagctgcttaagtaaaaagtttagaaaccactggactggataaagtgtctctaaggtctctttcagttctgcgataaccagttctcacagtaattgtaagtggggctgttgaggagatccttctgtagaggaggcattgaaattgagacttgatggatggatgttcataggcagaggtcgggcataggataggaaataaggtaagtgcttttcaggcccagggaacagtgataaggaagtgagacaaataggaatggagcaattcaggaaatttccgtacagctgtcaggggctagggagtgagggagagtcaggaagatagggctggaaaagttagggaaattaaagtcagattgtgaaagccttgaacgccataatagtctggcttttaattttgcctctaagaaatcagttattttatttctttttgttttttgggccataagtgataatcatttcactctcagagttgttctttaggaagacttctctaatagcagagtgatgggtgaatttaaagtaggcagttggtggtagagaaagattctgtcagttaggaggagactgtgatgttacttttcctgtgatatgatgagtacttttttacctgaagagtagcaaaggaggagcttaagtttcactttaaactcagtataaaaattagatttcctctctgcaacatttagagattattgaatagtaggttaacaaatgtctttgagtggctgctgtgtgaagagcagtaactacagtagatgctagggctacatagaaacacagcaatggtggccatgtgtggttgttcatgcctgtaatccaagcacattgggaggccgaggcaggcggatcgcttgagctcaggagtttgagaccagccttggcaacatggcaaaaccctgcctctacaaaaaaatacaaaaattagccagacatacaaaatacaaaattagccagaaatacaaaaaaatacaaaaaataaccacattgtggtgcatgcctgtagtcccagctactcaggaggctgaggtgggaggatcgcctgggaggcagaaattgctttacgctgaggtgccaaggtcctgccactgcactccagcctgggtgacagagcaaaactctgtctcaaaaaacaaaaacagccaccccccccaaaacaaacaaacaaacaaacaaaaacagcagtggttctcataagcctgacctccacctgcactactgaatccatttccaggagttggcatgtgtcttcataaagctccttcaggggtacattcctggttacaggctactgaagtaaaagatacattatttttaatattgaatttaaaatttaattatgagagataaaatatgtctatacaaacaacttgagattgcagtcagcatattacctgggagctttataaagaatataatcataccatcaattcttggttatttttaatatcagaggaaacagtaatacccagaataatacctgcaatagaaccttgaatttgtctatatcaagtcataggggccaagtcatgtctttaaagatatttcaatgtttacgaaaatcctgatatgctacatttttcccctcagtgagcagttttaggaaagtcactcattcatgtctctgaatttctgctgagttttgggccttgtcctaggtgatgggaatatagtgcagacaaaagccatggccccttttgcctttgataagcccctgaaaatacatagactgttgcctaagaggcctgctttttgtgggtggtaaaaagtaccacctagttacctgtccgtgcagaagtgggaaagaggatttggtttaacaaagctagtgatagagcatagaaaattaactgtgttttacgtttaagctcacatgtagaaattctacacaattcttggaacctgggattatatttttgagaggcattaacatcaacaaaataaattctgcatgattgaaagattcataacactcaatctcagtcttctgaattttatttttctatttaaatagtggggaacattgattttggtcatttgccattttaatggtgtgatcttttctttttccatctctgatagtcatagcatgttagctcccgacctatggggcggattcaaacaaagctttttttagcctaagtttcctagatatggaaattagagtattctgtatttttgtactagaagttttgagatttgagttcaaagggaagaggtaacagtaaaaaggaaaaatgagccctagcacaataaattctttttataaattctgttttggtggaggaaataaatagtatctgaaatttagttggcatttaaattcattcagttgactcaatctctctcagctaatagttcaaatatacatgttgacaattccatgagcagccatgaaagctttatataaggtatatactgacttgatccatatctaattttataaataaacatacccacagtatgtacatttcatatacctaaactagatttatttcttccttcctcccttcctcccttcctttctttctttctgttctggggtacatgtgcagaacttggatatttgttacaaaatgtggaggtctgacacagagtcttgcttggtcacccaggctggagtgcagtggtgcaacctcggctcactgcaacctccacctcccaggttcaagcgattctcctgcctcagcctcctgagtagctgagattacaggtgtctgccaccacacctggctaatatccgtatttttagtagagacggtttcaccatgttggccagcctggtctcgaactcctgaacttcagtgatccacctgccttggcctcccaaagtgctgggattacaagcgtgagccaacgtgcctggcctagatttctttttgttaaaatcagttttattgaggtatggtttatatgcagtacaatttgccctatttagttttatagctctatgaattttgacaatgtacataagtcatataccggtaccacagtcaagatacagaatatttctgtcaccctcaacagttccttgtcttcctttgtagtcaaccccctcccctcatttccagcccctagaactgataggatttctgtgccttctgttttgccttttccattatgtcacatataaatggaatcatacagagtcatggagtcagtcttattttgttcagcctaatgcttttaggttcatccatgttgtcacatatatcagaaattcagaccttttttgttgctgagtagcattccattatatggatatactataccattccattacatggatttatccattcacacattgatggacattatttgggttttcaatatttggtgaatgataaaactgctatatatatttgcatagaagttttaaaatagacacatatcttcatttctcttgggtaaatgcctaggaatgggattactggatcatgtgataagtgtatgtttatagaaactgctaaactatcttccgaagtggctaaacttttgcattcccaccagcaatatatgagagttgtagtcgctccatgttctcatcaacacttggtattattggtggtttttgttttgttttgttgtggtggtgtcacattaatttgcatttccctattgagtattgatgttgagatattttcatgtactttttttgccatctgtatgacttctttagtgaagtgtctattcagatttgaccatttaaaaaactggattgttttcctatttttgagttgtgaaagtgctttatgtagtctggatagcagtgtgtggacttattttaatcctcataatctgtgtggtagatactattaggctaaatgatagataaataagttatgatgcaggattgttaagtaattgcccaagattacatagctaataggtagcagagctgggattgaaacccaagtagattgactagaacctgtgtcaaactgtttgcctttttttttctctttgatcctctcatatgcagagattgacttattggggctgtaaatagaacaaggatccagttcctgtaggtgatagaataatgctaatagggatacccctgggcagagggataatatattgtaatggcagctctggagtcatctccttaggaacagctaagatatttgtttctgttgaagaggtgtaattattttccctttaattctcttcacattactggtggccagagtacttcctttaaattatgtttggaatatttgccattattaagtaatgaggtgcattatataaatggattttctcaatagcagaagcttatccttttagatacctgttctacataaaacatctcacacacttgatgttacacactttggctttcgaaggcctgtcttaaactaatgctgacttggagacacttagtgtatggtaatatacttagggaatattacaacttactgaccttatataatggcttcatatctgaatacttttaaagttatgtttatttttagttttgtaaggtgggtttttttaatgtcattatcagctatttcactttttctgacatccttttataatactgttgccctcttttacctgttacagtttttatttctaattagccaaaagaagataatcaaattgttaggtttacattcatgttatctaaaataaatttcagatatggaaaattacctggggggaactttccagggaacaagtgaatctcccgtgactgctcagcggaccttgtttcttggtgcatgggctctgaatagtcattttgtgtaagtgaactaaagtaagctaaatatgacatttgacaggagaaaacatggtctatatttctttttaataaatttttaattaacagtttgtaaaaccatggagattatttttcagtaaaaggataaaccaagcaatcttcagtgtaaggaataaatagacagcaggcagaaagttggttcacaatcattgctgttttgcagcattttgtaaagttcctaagtcagtgacagcttgtgctctcaactatgcctctggtaagccagaataaactcccaactaattaactaaagggagaaaaccttgctaaatcctatttactttttgtaagataccaggacgaaggctatctattgagttgcatttatcatttcaagcgctttggaagtacttagtgctttcaagccattttgattaatttaagctcttagaataaattaataagtattcacccagaggccagaataagtaggtgtagtaatatttcagtggcttgggcactttgtcagatgtattctgacttggaaggcagagcttcactggccacagttgtccccttaggttggccttgccacaattgcagtggagctgtagcagggtgcctggcacaagaggcttgaaatacatgtagaaaattttgcttgaaaggtaagtcaaactgtagctatcatttggaagtagtagagttatgaactatgatcgtaccaatacttttttaaaagggttttatcaagcttgcagtttatttaaaatcattttgctttgttggactttaaattcctaacattggggtgtgggtttttaaaaattctgtaaaccagtttaattcacacttatttttccactgaactttgaattttctagtggattttatctgtttagtgaacttacagatctgcatctggctttgtagtttgctagcctttccagactacatagcaatatatctctttcatatgagggttaatgagtagccagattacactcaccagtccattgttacattaagagccacagagtttgctatctcccttccatcccctttcatacttttttcctttcacagttttatttgatatagtaaagcaacttttaaaaattgagatttttatattttaaaacaatatatagtttttaattttgctcccttgtaggttcttactctattttattgttagttttaaattatggcaattaatatgagcttagtaatggtctaatcaaggtagatcttgctccttgcctcttcatccccactttcctataccgtttttacctgcagatttgcatgtttgacctagcagaataattgggtccacagcaacatgggcgtgcctcccttagaaacacttggtttcatgtatgactcataagctgaagcacagacaccacttccccaatctacaggagccattttaacagctaaaacttgtcggattgctttttattttcaagctcaaaagacgatagagaaagaatacttgaaggtaacttgttacaattttgtatgtttgcttctggctttttcttgagctgataaacagagggtggttcttacctgttgaagaacatggctgaatgtgttctttaaccctctgataaaatgtgtgtggtcagtcacatgcctgattgaacttaattgctagggggaaacaaagcactgaaattctggaaagttttagatcttcttgctaaagcattttgtatgtctttgtgattttttttctatgtaatttaagaataaaagaggttttttgtttgtttatttgtttttaagtaccacaaagcaaactaaggtcaaattttaatttaaaaaacctaattgtattttttggggtagttgaagttacagttaagtaaaccgtattattcctgtgtgatatagatgttaaatatccaggggcagtggctttgttttggcattttagctaagggtgaagttttgggacaactcagccataggtgttgctcattgactgttatttatttatttttttctccctctctgttttttaaagttaatgaaattatattaaatgtttcattttggaaacccaatggaaatttaaatgaattgttatttagataataagtaaaaatgaatattagattatttagataacaagtaaaagtgaatattaaatagaggaagaaagactagaatgattcatttactattagaaaaaaatgaagttttataattcacactgaaaacttgttctgagtaacaaccttagaagtaaagctgtcttctaaggaaacgtagttatttcaattttgtgtaaaaagaaaaagtgatgagtattggccttccttttgtattactgttcttaaaatttgcctgccttgaattaaaaaccttctgtaaatgaaaagattgctcagtcttttcctgaagtacttgtcattgtagttatgagattttggctggcaagtatacatcctactgtgccttaaagttctaggtgctctgtaaagatgagtgcagtagtattttatttctgaaacatatttatgaagataaaattggaatatgcagtgattccaaaaaataaagtttttggatataaaacttgccaaatcatttcttgttgaccaaaatgatatttagctagttctttgagaatttgctatgcacttactaagtgcttgaaggcctgtcagattaaagggaagagacaaaggcaatcagttattatttcttactcttttgtaaggattgttgatattaacagatctcaattttgcggtcttacaagaaagacacagcggacattttaccaattcagctgagccatttgctatcatctttgtttgcatattgctggtttagtcagcctttgagtaagcaaaagctgtatttacttctagtctggtctgtgtgaaaaatctaatgaagacttttctatttttttttttaacttttttaaggtggtgatccataagagaaaaatcaagaggcacacaaataagcggcataattaagatcttatttattaaagagaagtagaggaatttggtttcttaaatttaagaagctggtacagttaaagtagtatagatattgtttatgtattttcttacgtgatagagactgaagtggagtttcaaggagaagggagaagggggggtaaaaagaagagaaccaagaaaagaccagaacaatttattaagtatttccctctccacgtttttccttccataagattgaatgtaagtttgaactgacccatcagaattaaatttagaattagtgatttatagaactttagtgctgaaagtgactgaagattgtccaactgcctcacttttatagatgaagaaacagtggcccacagaggtcctgtgatttgcttgaggtcatgcagtacctaatggcagggcttcgcagtctggaactgcttgtgccagtcacaagtgatgctttgtttgaaatgctctatatttccttaagagtaaataaaaccttaattaagatgtttggtgataatcttggtgataagttgcaaccaaatggatcaaccaatgattttgaaaatgtagttttctttttcatcagaaagatgatgcattcattttatttctacaacaactttttgtttttcactgttagaatttttttgttcatgactgcttattttaagatggctttagatggaaatatgaagaggtgggaattaaatttgagcttctagatacaaagacagttttatttctgctttagttttagctcatatatatatatatatatatatatatatatatattttttttttttttttttttttttttttttttttgagacggagtttcactcttgttgcccatgctggagtgcaatggtgcaatctcggctcactgcaacttccgtctcccgggttcaagcaattctcctgcctcagcctcccaagtagctgggattacaggcatgcgccaccacgcccagctaattttgtatttttagtagagacagggtttctccatgttggttaggctggtcctgaactcccgaccttgggtgatccgctcacctcggcctcccaaagtcctgtgattacaggcacaagccaccgtgcccatccttgcctcatattcttttaggagggcaaatattgtttaatgtgataccttgttatactaaagtatgtgtatgtgtaaaactttgcatgtgactttacaaaatccagaggtgtctaagctttaacattacacttatcttaaatttgaccttattataagatagtaatctcattttatttatctttgtcacatcttctcctcctcctttgaaataagagaattgtttggtatatacaaaatcttttgtctgttaactttttggtgtgttttattggggtggttggaaattctctaggtctgaaattcagatttttaatggtttatgcataactgctgaatctcctaaatttctgagtgccctaactcaattcggtgcgaaatcgtccacagtgtggccatcattgtcctaaaaaacaaaaagcacaaaaggctaggaacatgggctttatcttcataaacttaaattcctgttgggaaaacagggcttgttaacaagtgaagtaaagaacagaaccaaccactgactaggtaaattcagattcagattgcctagagataaaagatgactgaaagaatactcaggagagtttatcttgaaggaatgatgaatgctgaacgttgaatagcatttacctatgttaagaagagtgtcttcgtcaataagaataagaatatacgctgtttgagaggagaaaggttttattctgtttttctgtctttttcaacctttgacaaagtaccaagcacatatgagtagacaggtattatttgttgtattaaacctttggctactcttttttgccatcttacgtgacaaattcagttggccatcttgctgaagttaaagatggcacatctttaaaaagcatgtggccctcagcttaatctctgactggtgtctgcatgttgtaggtaatactatgatagtattacctttaaagctgtaattgtcaacctttggtgtaacaaagaatcacccagttttaactcagaaattctgattcattaggcgtaggatttgcttaaacaatcagcattttttactgtgtaccctaaatgattatgacataggtgcttatatgccacattttcagaaagagagtttacaggtttaaggctatgaagaggaattagctattttgcctttaaatatttgaagttttaggcagcaatgctattttgaagcccatagcctctagtaaggaaggaaagcaactagagtactttattatcagtattagaacccatttgggctcctttcccatcccagttatccctttctctagtctgtttttttttgctgtgctatatgttgttcaactatgtggctatccgtctttccttttctctgatccacccccgaaacctactgccatattggccataataaataatctttgttttttaatgtaattaacctattttttatttctcagtgaactcttccagtgttagttgttttggttccaattgttgcttcttggtttccctctccatactcttactcctggggctttaggaaaaacacccccttactgatttagggtggcatttacagccttttgaaagctcttctctcttgagaaatacactattattatttgtaatatttttgttttctttctttttttggggggagggcaggggtgacttaaagactagcacaatagtatgtacttgtttgagtctgggaggaagtaactttttttttaaccctgtaatgcttggatatgatttttgaagcttcttcagatatttaactgcatctttgattgcatatttgtaggttttgcctaacattacatctcatctaatgggacattgttaggtattcactgacttggataaatgagaagaaaattcccctcatttgaattgtttgaagataatcattgcttccataaattagccagactattttgctcctttacttaggagctgcttcatataaatggttgaaattaagttagtaccattattgagtcaactccaatgattaggacagtttccaactatctgaacaatcttccttccattagtatggagaacctacaaaagagttttttgtgtcttgtcaaatgagctgtatactataataaaagtggctgttgagcagtactacaaatgtcttttctggtcatggttctaagcaccttaagttattatatgaggaaaataactcattgtgtgctatttgctttgttgacagagagggagaaattatgcagctgagctttggatatacaaatttctatgcagaaatgttttgattccttctcttccaggtattaacatcatcctcattgtcagagccctcttgccttctatagtttgtatgaagattggtttaacaatttttatattaaaagctatcaaagtgatatatgcacaccattcaaaatttaattcataggtctataatgaaaaggagccttcctcctctgccccttctgactctcagtcctgctgtccaaaggtaaccacttagagaagttgtttttattttttaagtttgtgttttcatgtgatttgtcctcgtcctgtgttctactctatatattagaagctcttcaaagtagcaggcaccagtatgactttacatgctgcagtatctacgtgatagatgcccagtcatatagtgatcattatgtctgggctgttacatggtacaattttaaaaatataaatataattaaagaaaattagtttctgggtttagaaaacaatcccataaatagtaaaactataaaattttataataaaactattaaaatgaagtgtaacaatttatgtacatcttattttttatatcaaaatactaaatggaagtttagtattgtaatggggcaattcattattttttctttaaaaatgaaatgtgcatgtaggaaaatatatataaaacatagagtttaaataaaactataaagtgttacaacatgggtaaatattttgtattttatttaaacagttttgcctcatatttataagtatcttgagaaacaacccatgttaagaaatatagagtatgtctattaccctagaaggcccccactcctattcatgtttgtttcctttaaaaaataactactatgctgacttttgcgataatcttttctttatagttttacctctttgaactttatacacatgaatcacaccatatattctgtagtgactttgcttctttcattcagctttgtgacttatgttacttttcgttgcaatatagtattccattgtttgtctgtaccagaatgtatttattctctcttgttgatggcattagattattttgagcttgggaacacttgtacatggttccccgggacataaatgtagaagttctgtagagcagtatcttcacattgagggatgtgaaggctttgcagagtatagatagtttaatgtaatttagagttcttcattatctttcctaggatcagatatctgccgatgatgacttctaacccattcagaatctttctatggtatattgccctggggtgtaaaatcctccaggaccctaaacagatggacagttgatgcatttcagggtaagctgtagacaacaatatatttgacccctgaaacaattcagtatgcttgtcatttgttaactagagttatttcaaacataattttgaataaaaaataaattttaataaatacatgttcccaattatgcatataaaagcaatcctactatcttgatgtatatgtagtaaagttataaaaatatataacagagaagataccaattttagaatagttgacaagtgggcactgtagcttatgcctataatttgagcactttggaaagcctaagtgggaggatcacttgaggccagaaattcgagaccagcctgggcaacatagcaagaccctgtctctacaagtagaaaaaaaaaatttttttttaagttagccaggtgtggtgtcacactcctgtagctccagctactcgagaagctgaggcaggaggattgcttgagcccaggagttaatgctacagtgaaatatgattgcaccactgcacttcagcctgagtgacaaaacaagaatctgtctcttaaaaaaaaaaaaaaagaaaagaaaagaaaaaaaaatcaaacttagaatagtcaaagaaggaataaaatgagactggagagggatattagaggaagctttaactgtagatgacctttttttcttaaaaacaaaacagaaaaacaaaaacaaacaaactatggtaaaatataaagctaggtggtagatagatgaatcctctttggtttaactgtttcataatactcttttttttttttttttttttttttgagacagagtcttgctctgtcgctcaggctggagtggagtggcacaatctcggctctctgcaacctctggctcctgggttcaagtgattctgctgcctcggcctccgaagtagctgagattacaggtgcccaccatggcgcctagctaatttatctttgtatttttttagtagagatgaggttttgccatgttggccaggctggtcttgaattcctgacctgaagtgatccgcctaccttagcctcccaaagtcctgggattacaggtgggagctactgcacctggcctcataatacatttttatctgtaagctatagtttatttttgccccacatttataagtatcttgaggaataatgtttaatttgaccggtagtaaaagctgacttgaaagaatgtggcaataaactttgcatcagagccaggggcactgagatgcacctgtagtcccagccacttgggaacttgaggttgaaggaatgcatgaccccaggagtttgagacctgggcaacatagtgagaccctcctatttcaaaaaaatgaaaactctgcatcagttaaaaatgggatcaggcacggtggctcaagcctgtaatcccagcactttgggaggccaaggcaggtggatcacttgggcccaggagtttgagaccagcctgcaaaatacgatgaaaccccttctctactaaaaatacaaaaataagccaggcatgatggtgagtgactgtagtcccagccacttggggagctgaggtgggaggatcacttgagcccaggaggtcaaggcttcactgaggcatgttcgtgccactatactccaacctgggcaacaaagtaagaccttgtctcaaaaaaaaagttaactgcctatttcagcaagagggattgggtagattcagatgtaagtgttataagactgtgtgtctgtcccaaataactaagaagatctaggcatacttctagatgaataaatagtaatttccagttgagatccattaacaaattggagctttagttacctagaagtaatttagttaggtttcatcttcagaattatcccacattcaaatacttctcaaaaacacatttcaaaacaaaaacattcataaaataattagtatagtattaacatccatgaacttttaagtagctaatagattgttgaatctaaccagatttactggtatattcagtgtttcatcttgcttcctgatcagtgtttcatgtagcttccttagaattcttactgtaatggtagcaatttctgaatctttagtgatttttgttgttgtcattataaactagatatacattcttcaggtaaagctttcaaaatttaacaatgtaaatgtggaaactgctatagaaagtgaaaacatagatcttaacccaggtttttactttcatcatcccttggctctctttcctgaaatacttcccatagtgtatgtataagcagtggcatggacaaagaacaaatggaaatagaagtcataagatttcattgtctgagggttcctataaagtcatgtaattagaggtctcttaaatttttattatataccttttgatctatattattattgattcattcagcaattattgcctgttacatattattcttgatgttgggatatagcaatgaacaaaaaataaaaactattcataaattatatgcatatattttactaattaacctccatttaaaatgtattataattatataaagattagagaaacatagataaactagattagttttcgatgtgctacatgtgatctaaggcaaggaaagtgtgcacacacacacacacacatacacctcatacctatatgtatttttttgggggggtgggggggagataggggtgtagccctctcgcctaggctagagtacagtggtacaatcatagcttgctgcagcctcaaactcctgggctcaagcaatcctccacctcagcctcccatgtagaattacaagtgcataccactatgacgtgcaaatttcttttctgtgttttttttttttttcctttctttctttcttttttattttatttttttattggtgggtatgcggtctggctatgttgtccaggctggtcttaaactcctgggctcaatcgatcctcttatcttggcctcccaaaatattgggattacaggcatgagccaccatgcttggcccaaagcatgtatatttaacagcattatttttaatcaaggaaaaaaaaaatcccagggagtttttttttttttcaatatgctattctgagaaaagactcctttaaagggcatataataagtaataatatcctgtaagtaaaaaacatatattgataaatatgacctaggaaaacaaaggctctttgtggtcctcaatacattttaagaatataaagggatcttgacaccaaaaagtttgagaactgctgcactattgcaactagtaatttaaatatcattcttagagttttacattattaaattgaagtttaaaaaaatgcaagctttctaaaccagaactagagtaaaaacattaattcgaagttttttttcccaatgagaaaaatcatagactgtcacctttaccatttatttacttgtgtctcctagccctttccacgaagaataaccaattctttaaaattgggaagtatattaaagtattacatttaaaattaaaatatattaaactttctagcaaaggaatgcaaattaaagtcaaatagcccccctgtgtttttatccatcatattggcagtagttcaagcattgtgggttgttgcaaatgatgttaaatgtccatgcaggtattctgttgctaacagtataaactgaaaaaatcttctgcagggcagttggcattatgatatcaaatgctttgaaagtctatgtgcctttcagttcttggtgtaggtatcctaaagaaaatttaaggatgggaccaaagattcagttgtaaggatatttgaatcgttcgttgtgattgtgtagcagttctcaaaccttatacttttttttttcaagctttatgatctttgcatcgtctttatactattaaaattgaggctcccaaagagctttggttcatgtgggttacatttaccaatattaaccaatgttagaaattaaaacaaacttgaaaaatattaatatatttatttaaaaataatacgcccattacattttaacataattatttttataaaggacaagtttgagccaggtatggtgacccaagcctatagtccagctacttgagaacctgaggcaggaggattgcttgagcccaggagttcaagtccaacccaggcaacatagcaggaccctgtttttttaaaaaaaaaaagtgcaaaaaagacaaatatgtttcccaaaacaaaagctgtactgagaagagtgtaaatcttttagctttgacttcacagaagacagctatattctcatatttgcttttgcatgaaatctgttggaatatgttgcttttgttgaagaatatgaagaaaattcagcctcacacagatgtctagtcacaaaaagtagatgtattttaatggccacttcagataattgtggatattctttgatactacaccaaagctcatcaacaaatgctagttttttaaaagttagaacaatgagattctgaaaacctatgaatgaactttttgtcccctgtaacattaaaatccataggtctgtcttgtactttgaatggattgatttttttttttttaacctaagcaagattttgtaacatcatgcgtgagtcatttgggtattgcaaatgttgacatagtatcaaaatcacaccagtctcatcagaaaagccttttaagtgtattgagaagccaacagagtcaaagcggtagatacatacaagttttccaaaattctgattttcagttgaaagcttgcattttataattggtgacaattgctgttagttgttttccttgaagtgatgggcatgctttattaatttttggaaaaatttctgccagatatccaattctgaataataattagttcttttaagtaaaaattacatttcatgaaagcagcagctagtttggctcacaggtcgaagaataatagcataaatgctttttctcaagacaacaatgctatttctgtttatgccagaagtagtactttatttgtacctccaattttatcactcagaatattaaaaacatatgtatttaatggttgagattcaagaaaatagtttttactcttcttcaaagacattcttaagtgaagtcgcctttttaaaatgtgagtgcccagtggtaaggagtagactcatggcttgagggtgcagccttggtcagggcagaggcactcgcagtttcatcctgctttgcttttgcatcatcagggcaagtgtcaacacagtggaaaagccaaataataccttgccattattatgaaaagagttgtgatctcaggagccccctgaaagggtctctggatcctttgtgggtctgaggattacattttgtgaatcgctgtgaataatgcagcattagaaataatacaaatgtctaaaaattaggggttgattaaataaatgttatatggaagaaatatacttttattaaagtttatgttaaatacaagcttataacacagtatttttctgtttttggcacctctctaatgaggaaatcaacattcgtcaaagaaagtgaaggcgttggttctgagtctcagtgcttccatttagttgatgcctttgtgattaagaaaagggaagttgaatagcaggagggggcagttactggcttctccagtaggctaagggatgtttgtatagcaaccttatttttacagcaaaaggaattggcagtggtatcaatcattttttgatacttaataataatatgtggaatgtgccttcaaatgaagttcctccagtagactcaatttatatttaggcattttctgatttacattttcccgttgtgttcttcttaattgaaagagctttcagttgctgcatattatttaacttcagactgaattaaagaaatgagttataagcaggttagaaggatactgttgagttgagccccttgggcttcctgctaagacctccacacagggcgtttctgaggtgtattatctgtactctgcagcagggaggaacactttttgtgagcggcatcattgaagataggatgctttgtgcatccgagatatttctctgttatagtggaagcctaataataatcatgacttgtcttgagtaaggtttaatattttcctaagcaccaagttctaaggagggtttgatgtttaaagttcctttccaaatagccattgtgtttattcaaaattttatgttttagataaacttgggtaaagtatgctggaagaatatatacagcatgctatgtacataaagttttaaaatatactatacaaaatgtacatatgtactaaattataaggaaaaataccattaagattttagatttaagtttgaataattaattcgaattaatgttacatgtgttttagtttgaagggcaacttaaaaagtttgtatttagacataaggtatattgtgtaaattattttattcaaaatgttttcatggtatgaacgttgcaaactagacatcgtgcctgatcctttgatctgtagatcagagaaaaacttgcatattgttataggataatttacaacctgttagtcttaagaataaactgaaaggaagatgtaatacttatctgcccttggtagaacagaacagttacacatcgttaactgtgtttgattgttgggtaggtgatggacactaggttctctgcagctgctctgagactccccaactcactccccatcctgccccccagttagggttatttcactaagcatcagagccagaggataggggaggggagctaatgtgtaaggaaatgggtgatgttcttcttccttcattcttccttcatggtttggggaacacttactccttattccctagatattggggacaatttagccaatacatttacaagtgagagcagagatatactaaagatatgctaggaaggcactaataattcttagactcctataaagaatgagcaagatccttctggttgaaaaatactgggtaaaaatgaaatcgtttttcaaagccattcatttaagaaatgttacttcaggagcctactaccatgcttacagctgattattaggtatatgttaagttctctttaggaaagagaggtcacaggaagctgaagatggacttctgtgaagtaaaatatgaagagtggttttggacattgacctagaatggaatagcactaaactctggtggaattgtaattgtggcaacttatgcttattatagcctaggtaaatattgaccaatatgaatggataagatagctgcattttgcccaagtttatgatacagaatatgaatcatatgagtaatgaattgaattcattcttaaggattgattattagtttgggaggcagtttggcatggtgaaaggtgagcacaccttagttataattaactggaaggttggttaacatgacttgaagcaggcaggattcacctatggagaacagagttctatttggttgtatatagttgaatatatatgagtaaataacatgagccaagtttgggatatacaggaagtgagaagggagtagagatagtttggttgggggatataaattgtagtacaggagagtgctgataagaagccatggtaaaaatgaccaaagatcaaagatgcaagttatcagtcctgctttgttgatagtcagttgcttaaaggttgttttttttttgtggtaggttttttttttttttttttttggataggtatagcagaggttggggggagggtcacatatcaaggtggtcaagtgttacttatgtaaacagttgggtaaaatagtttgagggcctgttctgttgtttagacacttggttttttactcagtcattgtggttttcaaatcttaatttgtgtggtgtttgctcctaagaatacttcttcaaaagactataaatgagtctttgcgtgcatattgaatcttagatcccaagaccaaaatacttttttattggctctgtttgcataaacactcttcaccatttatatgtttgtgctactgtactttcatatattttcacacaaactattggactatttataaaacaagacataaagatgtaacagagaaggcaggaaatacttgacatttgtgtgccatatcttactctgtgcttcctgtcagttaaaccacgatgagaggaacagagacacagatgtacaattgctgctttaatttgccactggggagaccagttaagcataaagctagttttattaaacttttgtcacttgttgattcgagggacgttgtaggcttgtttggtattatatggattgtatgcatcatgtggtggcaattagatgtttgctacagcacctaataggaacatatatcttttacatatttaaaaggtatttacttttgtgacattttttaggccataaaaaaattggcatttgaattcatatatttgatataaattcactatgaaatattaggctaatattttgatcttgaaattttagtatctaattattaacttttatgtattagtatatcaggattctgtaaaactttcaaagcattttgtagtttaccaagtaaattcttacttggtacaacttcaagatgaaagatgaaatggaaagttatagaggttgacttatctaagaaaatacagttagtaaatgatgttcaactacaacttgaatgcaggtgttctgatggtagatcctgtatccctaatgttagggaaaaggtttgttttcattaaattcctattctacctgtttctcagtgattttaacttttagggtcacctttgcttattcttcccagaatatcccccaccccctttcctttcatgttctctctccttggaaaaaaacagatgtgggctatttctttagaaataagtaacatgttacttccttatgaagttttttcaggttctcacaggtatttacccctctctattcattctgtcatcttttggttgacttgtttatttacattgttttgtaattatctgtttacattgtttctttttagatgttgaaccactttgggacaaggatcatatcttatttatctttatttttgtatacccagtaaatggcatatagtagatttcataaatacttgttgggggaataaatacatgcctgatatttattttcttttttctagaatcataaactggttaaagaactataatgtgaatcttttctacaggttgcctttatggtttatttctaagaaataattttattgtaaaagttattttgtacttcagctccacccacccccagtttgtttttgctgtttatggaaatgagatatcttagtgaaattattagtgttttcatcctagttaaaagtggagataacatattggtccattaaaaaatgtagctgaagagcttaattattttagctcgctaagcatcaaaaatctcttacttttggcttcaatctggaaaaaatgtctagccattcattgtggtcctgatatctccactgaataaatggaaataataattctctttattactttttgcttctccctgtattattttctgttgtcaccaagttttttgtgcctcagtgattggagggttataaattgcagtcgtcttgtcaacagagcaataattttcacaaataggactttagcttagatctggccattctaggaatgtcttataaagtttatatattaacagtttttccagccaaaaattgatagaagttactatgtctttttaaacaataaatctaaatgatcaaagtcaaatttaaggatttaatttttaagattgaaggaaaaattatgaagctatatgaatttaatttttaaggagttttagaagaaccaaatagttattttgtttattaaaacttaggtagacatgtggaaaatagtttatagggtttttgagtgtccttttacatgtcagacctcccttttttgtgctctttgttggggggtgttgatgtatttctgagtttggatcagaaaaatacatatatgtacgtcactttgacaatagtcagtgaagcttagcttaccaccagttggttctgggaagcaagtacatgcatcatgtgaaattctatagaatgctaaaacaaacgtatgaaaacactaatcttttactgtttaatgaagaattttagtaagtaaatattaagaaaataaaaggtcctttgatcttgacctagtttgactttttaatatacactttacttaatattcttttaaactgtgtttattaatatatagaaaaatttattatatgtcttttgttttcaagtagcttataatcttaagagatgggacatagtaaataattactgaattacatgggagaatgaactttgcccacttctgctatagcatacatattactatgatttgcatttgccttagttgatagattgtaagcgcctgtagggaaagtcttcttagctacttgttgctttcctacccttctcccttacccacaagtgtctggcagataggtccctaaagagtgcttgtccaaaagaatatagacgacactgatttatttatttatttatttttttgagatgggacttgcctttttttttttttttttaaggtaaggtcttgctctgtggagtgcaagtggctctaacctcagcctccgaagtagctgggaccaccagctcatgccaccatgcccatctaatttttaatttgtgttgagatgggttctcgccatgttgctcaggctggtctcgaattcttggcctcaaatgatccacccactttggcctcccaaagtgctgggattacaggcatgagccactgcacctcgccctgatatgatttctgcaggccatctactattaaaatataggaaaagacaatataggaagaattatttcttcttctccaggtatttctatttataaaggggatgtttttaaaaatcccagtacacagtgtcacatttcagttggctcaaagtcaaaattaaatcaaaatgaaggcgttgaggttacccctaagtaaatcagctttacctggaacagcctccttttggatttatctgtacctatttcccccccagattttcccttcccctcaccttatatactcacagatcgtctctgaaaggtaaaaaaacttctccccacaactcttagtcccccatttactgtaggagacgtcacattctctgtgtccagttgtcaggggttggattgtaactaggagttagatattgaacgagagagacagaagtttctttcatgggttttaagataacagcctatgttgcctgacaatccccatttttttttttctttgaaacaaggtcttgctgttttgccctgcttggagtaagtggctgtctatagttgtgatcacagtgcacggcaaccttgaactgttgggctggagtgatcttcctgcttcagccccctgctatgggagcgtgccactgcatctggctttacatttttaaagcagaatattttgaggggaaacagaatgttgtgattaagatcactagattctaagccctatgagggcacaaattttggtcggtttgttcactgctgtattcccagcacttagaacagggtctctcacgttgtatgtctgttcttatgccaaccacgctattttggttattatagctttatattctattttgaagacttgtagtgtggtgcttccagctttgttatttgctatttgagatcttttgtggttccacaaaatatggatgtggttctctttttaaaaaaaagatagatggagtcttgctatgttgcctgggttggtctcaaactcctgggctcaagtgatcctcccatcttggcatctcaaggtgttgggattacaagcatgagccaccatgcccagccttcatataaataataattaaaaaaaaatgttggccaggcacagtggctcacgcctgtaatcccagcactttgggaggccgaggcaggtggatcatgagatcatgagttcaagaccagcctggccaacatggtgaaaccccatctctactaaaaatacaaaaattagacaggcgtggtggtgggcacctgtaatcccagctagttgggaggctgaggcaggagaatcgcttgaacccgggaggtggaggttgcagtgagccgagactacaccattgcactctggcctgggcgacagagtgagactctgtctcagaaaaaaaaaaaaaagtgtttttcctatttctgtgaagaatgtcattggtatgttgatacagattgcattgaatctgtagatttctttgcgttgtatctaattatttattttatgatttatttttatcatctttcctaatctccttgaggacgtgtcagatttttgtatctatgcagagatatcagtagttattagagatgtttaaggattaaataaaaagcagtatactgtacatgttttactttgtaaaccataaagaacttattagacattaggtattgctagtaaataataatataaataaaccttattgtgatattgtacaattcctggatgtgtctttatagtaaagtatttttttaaatctagtaagtgcccattacatctactgagacaactttgaattcttgaactttccaagagtacaacaaagcgataaagcagaaaacacctctgataaagacccaggttcggcccagtgtggtggctcacgcctgtaatcccagcaatttgggaggccgaggcaagcggatcaattaaggtcaggagttcaagaccagcctggccaatgtggcgaaaccccgtctctgctaaaaatacaaaaattagcccggtgtggtggcgtgcctgtagttccagctactccagaggctgaggcagcgggagaattgctggagataatgacactgtgctttagcctgccaaacagagtgagactctgtctcaaaaaaaaaaaaaaaaaaaaaaaaaaaaaaagccaggttcaatgcagcctcatttggtcaactaattatttttacaaaagcatcttctgaatgtcaccttgtaagaaaatgaagattttgtgaatgctggtgatagcagtctgtatttcagtgacgaagaaaggtggttctgttatttatatcacatatttcttcattggataactaagtcagcatcatctattcaaaatatttaatactgagaagatatagtcatccaaagatgcaacagttcatatatttcaaagttacactggtgttcaagtgaatgatgggcagttttgatgttcagttgaataataagaaggattatgtggtaattagtcatacgttttcgaaaatcttattttcctatttctcccctcttccaattcttaggtgaagaacaaaaacatggagtaaattaggtgatttaaagagttttgccacaccctgagcagaataaaaagcactgttgagaatctctattttaagtaattaatgaagaatttaaggagggcagtatacacattggtgatgcgaagttttcaatgtagcagtcaagctgtggaatgtctgtttaaactgtcctcatcgtttttggatggtggttgccacatcccacttacatgacttgcattgggctttatagtcatcgaccaccatctattgttgcaacccagtttgataacctccagcaactttttttacttcttctcaaatcatgcctaaattctactgcctgactttctatttcccattgtgaactcttagctcttatcaggctgttaactatctctaaactttggtcatttttgagtctctgcattcttttgtgtcggcattcacgtacgcatacacgcacagacacaatatattttactatcttttcctttcccctttagtctctccaactcctaccttccttctgaggttcagtttagttcccacattatctgtgaagtgttttctttacctgtttgaccatctcgtcttctaaaatactgcatttatgcatttagttgcttctctcggtcttgttgcaaaaaacaagtttcatgggaacaagggccatgcattatctttatattttccacagtgctgagcctaagggaaattcaataaatacttaacaacattttaccacgaactccatcaataatagcacaggtgcctctaaaattagatatttgggatcttttgattagttctggatgcatcaaataagcataactaaactattctttttttgtttgtttttgagacggagtcttgctcagtcgcccgggctgaagtgcctcagctttctgagtacctgtgactacatgtgtgcaccaccatgcccagctaatttttgtattttttagtagagataggatttcatcacgttggccaggctggtcttgaactcctggtctcaagtgatctgcctgccttggcctccataaaacagtttcctattagagaaaacctaatgccaggatatttgatgcactttagttaatagtaactgaaatggattcaactgatttaaaaattgattgagaaattatattatgaaagatgaaagtctaaatctttaattgttctgtatatgttttacttattaatggtatttaaagtttgcttctatctaagatttgtacaatagtaaaatataaagttaatgtataatttataaataccacatacaggcatacatcagttaatgactgggatacattctgagaaatggatcattaggtgatttcatccttttgcaaaaaatcacagaatgtacctacacaaacctagatggtatagcctactacacacctaggctatatggtatagcctgttctcctaggccacaaacctgtacagtatgttactgtactgaatagtataggtaattttaacacaatggcaagtatttgtgtgtttaaacaaacatagaaaaggtgcagtaaaaacatggggactactgttgtatatctgcttcattgttcaccagaatgttgttatgtggcaaatgactgtatatatcttacagtactaagcccatggccttccatattttcatttctcatcttgtggttttgctgcttcttttgttttgtttttttgagacagggtctctctgtcttccaggctggagtacagtgatgctatctcagctaactgcaacctccaccttttgggctgaagtgatcctcccgcctcaacctcacgagtaagctgagactgcaggctccaccacacccagcgaatttatttatttttgtagagatgaggtttcacctttttgcccaggctggtctcaaactcctggcctcaagtgatctgaccacctcggcctcccaaagtgctgggattatgtgcatgagccactgcgcctggcctgcttcttgttttttgggttcatttgagtttagaagcttagatgattgccagacagttacaaagatgattgtaggaagaatctcattttaaagatcctgacatgaaacatcagaactctttgatgatatccaagctgacttagaatcgttttatgtaatttaaagaagaaaagaggatattgagtgtggtggctcacacctgtaatcccagcacttgggaggccaaggtgggaggaatgcttgagcctgggaatttgagaccagcctgggcaacatatcaagactccatctcttaaaaaaaaagaaaaaagatggccgggtgcagtggctcacacctgtaattccagcactttgggaggccaaggtgggtggatcacaaggtaaggagtttgagaccagcctggccaatattgtgaaaccctgtctgtactaaaaatacaaaaattagcctggcgtggtggcgggtgcctgtagtcccagctactcgggaggcagaggcagaagaatcgcttgaacctaggaggtggaggttgcagtgagccgagattgcaccactgcactccagcctgggcaacagagtgagactccgtctcaaaagaaaaaaaaagattaaaataataaatgaagaagaaaagaggtagactgtgaaaacagatcattcagggttttttttcactcacacagggagcaggaagttttgtgcacaaggaatcataaagtctttcaaatgtgttggtaacttgggaaaagatggaaatgtttatttccctggagattatgtccttaaacctggttgcactgtgacttgaaagaggatcctaaaatgtcacaggaacaaaaggttgtgattgtcagagagtagttggaaaggtctggattcggtggcagtgagtacagacagaaggcctggaaagaggtagtatatattgggttcttggtgagattaaggcagggctgacttcggcttcttcaatagtgggatggggaagttggggaactataaaatgcagaactgctggattgttgtttttgagatgatagtgaagagtattaagattgtgttggagctatagtttaaaaaaaaaaaagactttattttttagagccattttagattcacagtaaaattgagaggaaagtacagatttcccatatacctcctgcccctgcacatgcatagcctccccgttatcagcctctcgctaatcacctgcaccagagcggtgcacttgttacagttgatgaacctacactgacactttgtcacttgaagttcatagtttacattagggttcacttatggtggtgtacattttatgggtttgggcaaatgtcacttagtaataagcatttaagtttccacatgtctttttgtggcttgatagcttatttctctttagtgctgaataatatttcattatgtggatgcactacagtttattcacctactgaaggacatcttcgttgcttacaagttttggcaattatgaataaagctgctgtaaacatccatgtgcaggttttgtgtggacataagtttttacttcctttgggtaaataccaaggagcacagctctatggtgtaagagtatgtttagttttgtaagaaactgccaaactgtcttccaaagtgtaccattttgcattcctaccagcagtgaatgagaattcctattgttccacatccttgcctgcttttggtgttgtcagtgttctggattttggccattctaataggtttgtagtgacacctcattgtcattttagtttgcatttccccagtgacatatggtgtggggcttcttttcatatgctaatctgtatatcttctttgctgaggtgtctgttaaggtctttggcccattttaaaatcaggctattttctctgagttttgagaggtccttgcatattttagataacagtcctttaatctgtggtttgtcttttcattctcttgacattgtctttcacagagcaaaatttttaattttaatgaagtccagcttatcaattcttcctttgataaatcctgcatttggtatctataaaaagtcatcaccaaacccacatgcatctagatttttctcctatgctatgttctaggagttttattgtttcctattttccatttaggtttgcgatccattttgagttaatatctgggaagggtataaggtctgtgtctagattcttttttttttttttaatgtggatatccagtttttctaccactgttggttgaaaaaactcttttctttattgtattgcctttgtccttgacaaagatggttgactatatttatgtggtgccattaaccgtgctctctattctgttccattgatctattttgttctttcaccagtacctcactgtcttgattactataggttataggtgtatttttaagctcaatccatagaatatttccgttcacttctccagtctaggtattcagacatcctgtcttacaaatctgactaccatttcctcacaccttccacatcatgaggagctattttagccttgttaatacatttggagttttgcctgtaggtgatggaagccattaattgtcagagaagtaagttgatcatattttcacttttggtaaatgactcctactccaggcttaagagccactggagtggggctagaatagaggtagtaagggccgatcaaataaatatatgaaagagcatttcacctaataatgagcatgaagtgatttagatgacctttaaatcttgctttcagttgttggtgtgcctccgtgtaagagtgaaacttcttataacagaatacagtttctaccagaagagagttatgctgtgtgggaattggaggtgggggaggcgtgtcatgtagcaaaatctcctggggaactttgaaacaacatatccctggcttttcacccccaatcagtgccagcatgaaacagttactaatgggaatctgctgtattctcagatgggggaaccattgcactagggcatgtcttttctaagaaaatggaagtattaactgggagaataaagggtcacagaaatgaaacagtttacttgcaagttaaatcttgtttgttggagagagaaatttttttaactgcctgaacaggttttgctgataaagacgttttagcatgtttatgttttctttttaatgaacagaattaaaacagtatctcataactgttagatatttcgcttgtttatttctttctttttgagactgagtcttgctctgttgcccaggctggagggcagtggtgcgatctcagcttactgcaatttccacctcctgggttcaagtgattctcgtgcctcggcctccaagtacctgggattacaggcacccccccaccatgcctaggtaatttttgtatttttagtagagacgaggtttcaccatgtaggccaggctggtcttgaactcctgacctcaagtgatctgccctcttgggcttcccagagtcctgggattacaggcatgagccactgcacctggctgatatttctcttttgattttgaattctctttgttttcagaacatgctcaaaaaaagagttaaacttgagaccacaggtatggacaggtctaggtattcagtctgtttggctgttctgcagggtgctataaatgctaccctggtatcagtgtattctgataccaggttagtccaagtggccaatgatgggaagtgaagaactatgtgaaagaactggaatttcaggtttgggtagtgagtaattgtggccctgccttcagagtcctggaacttttcacctggttgtcagcaaaaaggcaaacacatagaaaagtcagtctgtttagtttgatcatattgattttttttttttattattagcatggttgaagctaaggtgaccttgatcaagttgccaaaacctgtttcaggtttgcttaagtcaccagaagtttgattgagacatcctatacaaaaaaaaaatcgatttgtgctttatttacataaaaataaaactatacttttgataacgtcctgggcacttccctctgcttactccccctcaattaaaaaatgcctaatttaaattaaagaacccggccaggtgcagtgtttcatgcctataatcccagcactttgggaggcctagacgggaggattgcttgagctcagaagtttgagatcagcctcaacaagatgatgagaccccttctctacaaaagaaattataaaaaattagtcaggtgtggtagtacacacctatagccccagctactcaggaggctgaagcgggaggatcacttgaggccaggagtttgaggccatagtgagcaaggatcatgccactgccctccagcctgggcaacaacgagaccctgtctctaaaaaataaataaaaactagttcctcgcccgctgggtgcttaagttgggcggatagtagcaaacgggctccgctagaggacagagccgcccagccccgctccccccagacccatcggtgcactgcccacacctgcaggcaactggctaattgggtcttgtagctgaaatgtgaaaaaggcagcagtcccaaaatgaaggaacacctgctgtgtctcaagcgcctggaaaccagaggcccaacaacatctgttgcttttgttggtgctgttgttgcagctgctcctgcctcactgttaggaatgaagaaaggggaaaatgcaggaagaaccacacacactacaaaaatggagagtatccaggtcctagaggaatgccaaaaccccactgcagaggaagtcttgccctggtctcaaaattttgacaagatgatgaaggccccagcaggaagaaaccttttcagagagttcctctgaacagaatacaacaaagagaacctacttttctggattgcctgtgaagacttaaagaaagaacagaacaaaaaagtaatcaaagaaaagagaaaaggctagaatgatatatgaagattacatttctgtactatcaccaaaagaggtcagtcttgattctcgagctagagaattcttgagttagagaggtgatcaacagaaatttgttggctcctaatcctcacatgtatagttctctccagccccaagtaacatcttttcagatgaattccaggggatgttcaagactttgactctaatgaaaacactacaaaaggaaaatgttgccctaactgatagaaggtcccagtttgggaattgattttattcctatgataaaagctctaagatgagtagggaaaaggaacactatcaagcattgatgacaataaccaaatgtaatatttttaaatatgtcatatgtgcaatgtgaaattcattcttccttcattatttctcatattaaatctcatttcagaaattttagaattttaaaactgttgacttatacctaactgctatcactgcataacagcttttaaacagttagaaataaacattttagaataataaacagattgtgtttctatcctaagcttggatacatttcctttctaaagatctagctcttattgctgtattaaaagaatgccacatacaatgcttactaatggaaatgtgtgttcacagatgcacttagggagcgtagtgtaaaaacatcaggaacttaaaattacaaatttgatttcaagttacatttctgtctcatgcgactttgggcaaatcgtttatcttctctgagttcattttctcatctgcaaatgacaaataaaataattatcaggatggctatgagcattaaataaacgtggaaagaataaaatgtgacattattttatcagagttcttcaacacaataattgttattttatgcttgtattaaatgtcattttaatgcactttcccctatttttttccaaaacatacaataaacatctgatttagctattcatcagaacatacaatcatattttaagatggaacactatatcaatgttattgctttgctcaataatgtgatcccaaatcactacttgcagttcaccatcacctcaaatctatagaaatgtttctttcaatgacatacatagatagatagatatacaattgtaggttaaaattaaagtttaaataagagaagtcatttgaaaattttatttccaaaggaaataaaacaacattcccaaggacagaaataatatcaagttatttgctaaatatataaatgagttataggcctaagactaagatataagagattgacaattagaaaacacttttcaatattaaggtagtatgattttctttaacaattttacaatgaaaataaaaacttaataaaaggtggtaacgggccaggcatggtggctcacacctgtaaccccagcactttgggagactaaggcgagagaatcacttgagcccaggagttccagatctgtctttgcaacaaagtgagaccctgactctaagaaaaaataaaaatgtttacaataaaagtaaaatttaaaatagtaatgtgtccatgaaaactttaattttagagtagttttatatttacagaaaaactgtaaatagaaaggtcccttacagacctatgggacatctgtcaaaattaataaaccagtattggtcattaagttcatactttattcagatttccttagtttttaacctgatgtccctttcctgtcccaggatcccaccacattacatttagttgtcatgtttccttaggcttctcttagttgtgacagttctgaaagcttccttgtttttgatgacagttttgagaaataaactggtatttcgtggaatgtccctctgtggagatttgtctgatgttttcctcatgactagacatgggtttttggtttttggaagaacacaaaggtaaagtgccatgcttatcacatgatatcaaaggtatatgccatcatcaggactcttcttagttgtgacagtctctcaaactttaggcttctcttagctgttgatgttaaccttgatcacttagctgagttagcatctattatgtttctccactgtaaagtaacacattttttttttttttttttttgagacagagtctcgctctgtcaccaggctggagtgcagtggtgcgatctcagctcactgcaccctccgtctcccgggttcaagcaattctgccccagcctcccgagtagctgggactacaggcacacaccaccaagcccggctaatttttgtatttttagtagagacgggatttcactatgttgcccaggctggtcttgaactcctgagctcaggcattccacctacctcagcctccaaagtgctgggattacaggtgtgagccactgcacctggccaaagtaatatatttttaaagagattatattgaaggtaaaatttctggacatttacactgagctaaacaaattctgagcagattcttcaaccctgatattaggttccattaagtgattactaatacatgctataaagaaaatacagtaaagtagaaaaataaaagtccaaaagtcttatcctgaatattcacctaatagaggcgaaagtgaatttttcccttgaactatctgggtaaataattacaataatcctccatatactttcaatattaaatatcttagtcttactcattgtcataagaggtaacttaaactggtagttttgcttagtgcatttctatattgccctccactagtcaatgaacactgaatattgaaataatgtaaaagacctgatgtatttcctaccagctttaaccaatttgtcataaatatgtttcttgtgtatgatttttgaatgtttgctaaataatgtgtttggttttgtaaaattatgtatcgaatgtgtataaatttttactaccatgttcatcatacttaatctataaccatatattgtactccaccaatgtttattagtggacaataaagaagttttaaatgcatgaatacaacttaagagacaccacacttggttattttgcaatgccagaataacagtggatactcaataaattgaatagttaatccagattatgtttcctccaatttaagcttttctggttttttaaattcccccttcctagaatcagttttatcattttacctatgtacaataatatatttctggaaaatgctagaattttcaccatgtagtagaatttgagcacgacaataatgtaaaaaaattcagaagtctcaaactaggtagctttctttgagttttcaaagtaaatcaagatagagctgttttcattttactatattgtggaaatctatggatgttgtgtaaaatgcatgtgcattacactgacttaaaatgttttgaattaataaagaattcaacaataaaaaaattaattaaaaaataaaagaatgcttaattttaagtagctatcttgcatacctacctaaaatatattcatagtaaatacatggtacctgtttagattgcaaaaacatagttttaaactttctctcaactttcttaaattcgttgaatatttgaaaaaatttaaatgaacagttggggtatagaaacattttctttttcaattatgagaacactgagtgcaatgaaatgatttgtttgccttgtgacattaacttgtgttttttcccttcaactttgtgtgtagagtacctggtttagagaaagcaggagctgagaaagtatgactattcttttttgggaaagttcaaatctggtttcttaactatacctacattttgggatgtttctttattgttttttccatattcgcatattttaatgtaaattctagcaataatactgtatttaaaatagctagaaaggctaggcgtagtggctcatgcctgtaatcccagcactttgggaggctcaggtgggcagatcacttgagctcaggagttcgaggccaccttgggcaacatagtgagacactgtctctactgaaattacaaaaatcagtcagacgtggtggtgcacacctgtagtcccagctacttgggaggctgaggcatgagaatcacttgaacccaggcggaggttgcagtgagctgagatcgtgccactgcactccagcctaagcgatagagcaagactctgtctcaaaaagaaaaaaaagaactagagagaaaaatatcagtacaaatctattttgaagtattttaatgagttactaaattgtggtagccttctaaaaaggcttatacatgtttcctttttactttttaggctgagtgaaaatgtaaggcaagatgatatgatatagtaaacttgggagataataatagtaaaactctaagacttaaagtagtaaatagggaaatctacaaaccctctgcaccagttgtttcagttaaaaatatggttgaaaatgatttatcccaaatatcaagagattgcataatatataaaagcattttaattgacagttgtactggggtatggtaaggtacttttgctaggtatttgtctaggggatttcttatttttccagatattctgctaaggaaaaaatattaatgaagttctgttaatatagatataaaggtaccagtaggaaatctgggcttttcttgctttctttgccactaactggctgtgtgtccttggacacatcagaatgctctaggcctaaattcttttttcttttcagtgaatatgttgtcctaggtaatccttagatctttttcagctctaatatcctgtgatttcacacttttagattgagaatgggcaaactttggaagactgtgtgcagtttatcttcataccactgacttcatttctgctgggagctaatatagagccttctaccatgttataatagaaaacagattttttaaaagaccaaactatggtcaatcacacaggaattcagtcattacagattatgggtttattgcttgcttctcatttctacttggtataacttcacttcttttctctcactttcttactctgttttctttcatttctgttatattttttcaatggtttttccgaatattgcatttcttaccatgactatctgtatatactgaaaagagcccttttattaggttaccacatcttgtgaaagttctttctgttcagttacttggtgtctagagttactgtagcattccagttttttagatactgccaacctacaaacatgccatatgtacataaacagacacagtctgaattacatacttcattagagaagtcattcaaccacgtcattgctttaagctggtatatttcaccttctttatcccagaattgtctgatctaaaacctttttgtttgattgattctctttattaattttctttcttttcttttttttttttttttgagacagagtcttgctctgttgcccaggctagagtatagtggcgtgcctcggcttaccacagcttctgcctcctgggttcaagcaattctcctgcctcagtctcccaagtagctgggattacaggcactcaccaccatgcccagctaattttttttttgtgtttttggtagggacggggtttcaccatgttggtcaggctggtctcgaactcctgacctcaggtaatctacccgcctcggcctcccaaagtgctgggatacaggcgtgagccacggcaccggactatttattaattttcaccataaacagttggtaccatagtaacttaaaaggagagcagtgattttcggccgggtgctgtggctcacgcctgtaatcccagcattttgggaggccgaggcgggtggatcacaaggtcaggagatcgagaccatcctggctaacacggtgaaagcccgtctctactaaaaaatacaaaaaattagccgggcgtggtggcgggcgcctgtagtcccagctactcaggaggctgaggcaggagaatggcgtgaacccgggaggcggagcttgcaatgagccgagatggcgccactgcactccagcctgggcgacagtgagactcccactcaaaaaaaaaaaaaaaaaaagagcaatgattttctaaaaatatatttatgaattcgtgggtttaatatccttgtgtctaaaaacctttctgaaggaatcttaaatttacattcaatcagtgatcaattttgactatcatattttttttagtacctgaaatcttctataataaattaaacaagtagccatttgaagtggttgtagtagctagtagtgtggctgagggttttgtgtttaccatcagtgaagtcattttgtttggaatgaggcataatgggactctgtgttagggaagcttgccagacagagtgaagtcctcgccttgaagcagcaggatttgttaaaaagacgccaaaccttgaagcactggaatagaattacagttttgttgacaatgggctataatgttctttttctggagtctagcaaatagctatggtaatagagacttccagggagtacagaaatgacccttaaggaattattagttacctagcatgcacctgttacatatttcttgcatatacttacagcgctaaagaagctaatgttaattcagtgcatgttatgtgccaagtattctgcacatgcatttttgcatctacacaacagctctaggttttggtattactttacccgttttacagaaggaagagacttgagactgacacctattttatggaaagaggggactgagacaccaagcaagtaacttgtccagtcttctgtcacactgcagaagattggcacccaatcggtctgactccagagcctgttctctgaactgctttgtgttactattttactttaactccaaagcttattttggggatgacaggttaggaaccttgttgctaagtattcctgtggcatgtctccttggagaataagaatatggtcctcacccaattaagagacatctgagccagcctaagattttttattatctggtagatgtctgcctggatgccctctgaaaactgtgcaaataagttgaccgcttatgtctgtgtgatgaagaagtagtttcacttatgtttttccttgttactttataaagactgacactttgaaaaaaacatgtttgagaactattaatacagcagagtgcttcctgactataatagataattaaggatgggtaaatttaaacaagttttaaatttactgaggacctttcaatttgttaggttagaacagaagccttttttctaatccgagtgcccatattttttttccatctaagaccgtatttgaggaattagatgatgcatttagttttggacatgttttttacacactgacttcaaggggcactgatgtagacttgtcttatagtttagtgactggatttggagctcagaagctgaacctagagatggagattttaaaaattttttacatatgcgtttacttaatctgtgttataaactgttatagcagaaaggactttggtggattttagaggcccagctgtatattacagttttagagagagtcctgatttaggaaacaagaattctagttttagttctgttttgcttgtagaccgtgagaacttgaccaccccaatttactaattaaaaatggaatcattgatttagatcttcagtcttgtctgttactgaaaaaattgtaagatacctgggctttgtaatcaaagattataagaatctttgatatctacaggtgctccctctggatcaggtatcagaaaatgtattctcaagaatcaccttgatgcagaagagtatataagtacacaggggagaggaagaggagcaggaaagatgacagagaatcaaagacatgattgagccagtaaaatgcttttctttgcttacacattttcagtttgtggacttctctatagaaataagcaaaagctacatgccagagcaaaagtgtctttttctgctgcaataagtggcttagtgattgtggggagccatttcagttttgatttattactgttagttgttagtatgtataaggtgtgggtatgttggttgcttatcctgattttttagatttctgaaagacaactgttaaagcacagtagcagtgtggaagtgctggtacgaaaaggtacatgacagcagtggaaaagaaagtgaaacttaaatttacctagacgtattcacactggccattggcacaatgtcattttgcatttatgaacaaatgggttttgaaatagccttctggaacctaatcttttacagagaaacttctgtatcagcaaacatcccttgattctggttatgttttcttactctcgtttttcaagcttgtgataatagtttcctctttatcagaagtatatcagttattcttttttaaataaaggatatttgtagaaatagcttaaatatctaatgatatttatttattgaacacagagtctcattctgtaatgcaagctggagtacagtggcaatcatggctcactacggccttgaactcctgggctcaagtgatcctcctgcctcagcctcctgagtagctaggatcacaaatgcacacacaccaacacagccaactaattttttattttttgtaaagacgaggtcttgctatgttgccccggttggtcttgaatgtgtagtctcaagtgactccttccccaccagcctgctaaaatgctggtgttacaggtgtaagccaccatgcctggcctgataagatatttaaaacagtatttgtcatcaatataatcctttttgtcatcactgtgggcacacaggtttgggaggtacagaagaaattttagacaatggttatttccccagaagaggttttgcttcagttgtcttggtgcctggcacattgccttgcaaataattggtactcaaacatgtattcagttgaattaaggggacacagttttcaaatgtaagacaatgtactacaattcatgctaaattggttgtacgggcagtaattgctgtgtttttgaagggagcagtccttgtagtttgaggcatagatgttgggaggctttgtgaaataaatggggcttgagcattgaatggaaaagatgggattgaatgctggcaagtagaagatgggtgtgttgcaggcataggaaataacagaagttgagaaaagaggcaagattgaatagtttgtgtggaggaacataaggcaggtctactacagaggaattgggttggataataatttaaggaaaaaggtattataaataataataagtacaaggccaaatgtatctatctgtgatcaatttaaatcaaaacactttttttttccctcttctagatatggtacattgctcaaaaaccacctgaatgtgctaaaaatactttcccagtgttggagttaaacttcctgttaaaagggagtggatgagagtgggaaatttgctgggttggaatttagtgtagtgagtagaaatatcatctgaattggattcttaattcttattttattttgagttcttgctaggaaaatcacagtcatccatgatgacccctaaagcccaggacacatagggacttggctttacagaaattaggaaaccgattaagtgatttggctgacacatactagctggatttacgttttcagggaaactgattcactagatcagcttcatccccagacttgtctctttaaaattattaggaaattactggccatcctttccttggagtcaacttcttttttaaagtgtttgtaataaaactgtaaatgctaattcaaagaactaatgttatttaatgtgattatttttgtatctttcttttcaggccataatcatttgatgaaaatgtagtaagattgtgataaacacctaaagaattttttccttttgttagtattgataactttttttttaaataggcaaacatctttggcagacattttaaaagcctttgtcccttcgctgtgaaattgttttcactactaagttgcgtttctgtttttctactattgtaaagtgcagttctttgcatgttctaatttgccatgacgtggtcaagtgctgtttccttcctgttgcttgcaagcctatactagagataaggatacatttcagtgcattaaaaaagaagccactgaagacaggcttaagcatggtaatttttaaaacattttacttatcagaagcctttttaaagaacagaaagagtgggctttaatttctgcttatttttaaaagatttaaaaatacttcttactaaactttaaatgtatttgattttaaatccttatataaatcctcttaaaggtgaaaatatatacgttgtgaaattactcattgggtagcagtttctatgtatgtgctttgctgagttggtgaaaagaaggaaattgtttatatatcctttattgcgattacaaccctcattattgctggggttttttgaccttttttttttttttaatattgagtacttttaacagtagtttaactggagagtgggggagagaggcataattttcagtagtgacagatgatcttagcaggagcaaactgttcaaataaaatatgtaacttttaaaaaagagcgtatgtgcattagtcgtgtcgattttatttaaaaacgttaataataaaaaaatgctttagcgatactgccctctgtatcagttattatatcctaagtgggtgattgctttttcataactaatctgagcttttgttttttaggccaagaagcttgagagaagaaaaatttcagaaaaattgtctcaatttgactagaatatcaatgaaccaggaaaactgaagcaccttccctaaagaaaacttgggtatacaattactccacagacagagctgagggttttttacccaaatcagtcactggattttgctgcctgatacgtgaatcttcttggaatttttctcatgtggatctaaggggaatgctttattatggctgctgttgtccaacagaacgacctagtatttgaatttgctagtaacgtcatggaggatgaacgacaggtatgagattcagagaaaatttcattttaatgactttattatgatttttctattcatatcagaaaattatttcctttaaaagacaatgagagaaactttattgaaagtaaaaatttatagatgaaatatttggaggaaatattatactatgttttaagcaccagttaattcatgaagaataagtcttatccttagctttgatatggtaacaaggaagtaatacctttgggattcagcttgtttttttgtaaaatgagacttaacactaaatgccttaagtaattatttttaagtactttgaaaagttctagagaatatactgccttttaatgtatgtggttaattaatgtttgtaatcatgggctacttcttcaagtagatgagacaacgttagcggtcccataatcatacatcatttcagtccaaagcatgtgactctgaggaagttacttaacttctctagatctagatttcatcatctgcagaatgaggggattgaactgaagaatttctaaatcggctttcagtgaatttatataagatgtgcaaattactgttttcagtacataaaaaagatctaggagatactgagtaaaggatctaagattaattttagtctccttcccccctccccacaacacacacacacacaaaagaactggaacgaggctagagtttcttgggactttacaattaacttcattttaaacaagttatatagggaatgtaagacatgatatgggagaaatagtgtacgtgttggagagactcagacagggtactaggaaaaatattttgagaaccaacctaaagttgatttatcactgaaataagcctaatgctcaacacctaattttaataggccaattataatatgtaatgcctttattctggaaacatagttactacaaataataaaattcttacttttggcagagtgaatttaatgatttttataaaattaaaatttttttagctgtgttgtccattgaagtgacagaacaaaaagtttataaataaacctacaaaaggtgaggatttggattaagttgccttaacagcaggatgagctttgactagggaggataacaggttcagggagagaattgcttagtcttgattaaaaatatattaatagtgatatggatttaatctagagacaatacaaaatatattttaggaagaaaggtgttttgaatttggtttaagacaggatgtttgtgtgtatattaaggtttgaaacagtgtgtttactatgcagccctcttaaatgaaagatgctgtatatagatgctaggcttgatgtggtgaggtttgatctcaggatgtagcagcagaggacaaagccctaagccactcactaatatgctctagttatagtggatttgacactctttggaacatgagagaagtgaattttacattatggtaccatattcatacatgtgtctacatagcctaaaaagagttttgcaaaacaacacttatacacttactatgtatgatatacttagtttgttttgcagaggttatttatgtttttggaaagggagatggtactgttagcttaacatcagcatgtacatatatgtattttcttaagttatttgtttttgtctaacaaaatgaatctatattttgtgcaggtgttataaggattttataagtattaaccatgtaaggtaaatactgatccccattttataatgaggaaattgagatatcaagaggttaagtcactttcctggaatcatacagccagtaaatagtagagccacaatttgaactcagccagtttgattctcactaatgatgttttatatattcttgcaataatgtgtgacaatcttactgtgttataatcagcatcaaaatgtttacaactcttggtgagttttggcgtcttcagtctgtggccatcagcatagcaaatgtaactgctttgcaggagggtagatccagtgctgttggtgatattagcatcttacctaacctggggctctacctccctgtttgcttattaggttaatttgtttttaatggaaaagcaataacgtgccatttgtattaataaaagaagtcacctaataaaaagatacataaaataactagtgaaaaatctctcttcacccttagtcctaatcttgttttccttcccagaagaaactagtattaagtattaatattttgtgtgtaatttttttagaaaaatgtctgaacaaatgaacatacatatatacaaaactgcatacagaggttgcttttaagacacaaatgaagttatgctaaatcttttttgtgtctcatttgtttccactttattataaatatttgtgtgtatgttgattctacatcatttatattttacatcatgagcagcccattatttattttacagttcctgacatggctgttaccagcattttgctatgatgtacaatattgcagtgaacatccttgtttggaaggcagtagatctacctagtagtagcggtggttaagagctcaggtactgaagttgaaatgcctgggttgaatcttggctccgctgcttattatctctgtgactttgggcaagttactcaacctttctgttccttggtttcctcatctgcaaaatggggatgaaaataatagaacctaagttataggattgctgtgagaattaaatgagttgatgtttctaaagcttttagaactatgtctggctcatagctaatatttacggagcactataattttgtcattatgtgtgtgtgtgtgtgtgtagtgtatctttgtacacttatgtgattatatctgtagggttattaaaaacagaattactgagcttactaaaaatataaatacaaatattcttttaaaaggctgtgttacgtggacataaagatggacaagtctgtgttacgtggacataaagagggactactagatgggggaaggaaggaagcaggcaagggttgaaaaactaactattgggtgctgtgcccactgcctgggtgataggatcaatcatacctcaaatctcagcctcacctatgtaacaagcaatatactcatgtaacaaacctgcacatgtaccccctgaatctaaaataaaagttgcggggggtaagaggagctgtattaatttctactactactaatagtgtatttcccaaaccattatcaacagaagtcctttttttttttttggccagtctttagggtggaaatgacattttactattttaatttgtatttccttgactactagtggtgaagtggtttatttgtaaattttatttattttcaattagagttttctttgatttacttattaatatatccttttgcccagtgggaattttttaagtattatggtcactacattagaatcattgatattttctctcagtctagtgttgtcttttaacaatgtgatatcttgtgcgctatagaaattttaaatgtttttaataaaatatgtcaatattacaaattaataatattagttttgggggcttttcttgccttctgcttaggaaagctttattctcttcactcctgtcactcctaaaattagtatatactctctttacattttcttttcttttttgttttttttttgagactgagtcttgcctcgtcacccaggctggagtgccgtggtgtgatcttgactcactgcaacctccacctcccaggttcaagcaattcttctgcctcagcttcccaagtagctgggactacagacacgcaccaccacgcccagctaatttttgtatttttagtaaagacaggctttcaccatgttgcccaggatggtctccatctcttgacctcgggatctgcctgcctcggcctcccaaagtgctgggatttcaggcatgagccaccgcccccggcctacattttcttctagtatctttcatatgtttggctcctcagtccatctgcagtttatttttgtatgatgtgaggtattcatgatttgaagattcttcccccactcccacaaatagtggtgttagcccttcaccatttattgaatgttttatgtttttcacacttaaactgccacctttgttaatactaaattaccatgtgtacaggcttcagttttgaacttcctagtgtattctccttcgttgaactgtttttatattgtgccagtatcacattgttttcattagaatcattttatagatttgatatccgataggatatcctcctccccccaaattggaataggattttgaatgaattttagagttagcttgttaagctacatgaaaaccctgttgggatttttaactttttaaagttaaaaagtatttatgacttttaaaataatgtattctgttttggctgtttataaaatcactgaaggcaccagattagaatatattttttgttttcagttatggtctaggttataaatatatattagtctaaagaaactgacactattaatagggttgccagcattttgatcatcttcccttattcagttcatattttccagaattgcttggcactcttgagtggagatggcaggggtcatggcgggggtgttggaaaggaaatatcaatgctgttgatgctgacaatttaaaactctgttgttgctgtctgttctaaactgggaatatttgtagctgagaatgaagcacttctatgggagagcaaccccatcagtattgaatgcaatatccctttatgcaatggtgctttggtttgatcttaacaagcgtgttagcatggtgaatgtatgagaagaagaagcaagcagaagtctatggatacaagtttctaaagagaaggaaacctatttacttaaatgttccaggagttaatttaatgaagaacagccggcatagtttaatgctttttataattttgatatattatatgaaaaaaacactgtatttttttttcagtcattggttttaaaagtagaatttctggcaaatcatatttgtgtttaatagacttaagtcactagagagaagtttggtgacatggaaaaaatgaacatgtggaacaacaaatttttatagaatctcatcacaatataagaaggtagtcttagcactttcctctctagggtgtaaattggcttcctccgactgctaattcctggaggttaaagagtaacagtgccgggtgcagtggctcatgcctgtaatcccagcactttgggaggccaaagcgggtggtgtatatcacatgagagcaggagttcgagaccagcctgaccaacatggagaaaccccatctctactaaaaatacaaaattagcaggcgtgatggtgcatgcctgtaatcccagctattcaggaggctgaggcaagagaattgcttgaacccggtaggtggaggttgcagtgagctgagatcgcaccattgcactccagcctgggcaacaagagtgaaactccgtctaaaacaaaacaaaacaaaaagaataacagtgccttgctgtcttttatacaagctgcccagtgattttttcatgcagtgtttgggaaacactattcaatgtaacacagataaatgcaaagtgctgtggatactgagaatggagccattgactgcactgcaactttgggaatgcttcaccatggaagttgaactggatctcaaaggaggatctagtttatctgacagatgaagaagaggaggtgttctagagcagtagagtgtaccaaaacttttaacagattctcttgacttcattatcagtccaaacatcttaatttatggttagaaacttttcacagtgtgcctgtttcacactatgtaattttccagaatgctttcctgcttccccactgtttgctcagaaatgatctccaacattcatacctgttgcatatttaagtctaataatctttcaagattttagaacaaagcatactttttccaggaactcatcctaaaataattccttcaagaattaacaactttattctgttatttctatgttgcttattatcagtctcacgtttgccatcttaaattttcatatacacattactaattttttcaaatgtgttaaattatttgaagtaagacattgtcttttttccccttaatattaccaaagcctttaatatcactgagtcctcttaaagattttttttctttttaaaatctgttgaataagtgatctcttctataaaataggtaaaacttacctgttgctagatgatctgggatatataagtgttcagttatggttcttatcatatcagagcatctctgaataatgagagggtgataccttgcccacagctgtcttgaccacagaatacattttcccaggacctattgtccacattctcatttggtgcagggacaatgtagccatgtcactacagttctaagaccagaaacagatgctcatggaatcttttttctgaagtatttggaactgatctgttgtacatttagtggaaaacacttcaaataacttttaaagattgtcattgaaattgtaaataaataaaatgtgttaaatgacagttgttcacatttattaaatctggttgtaggcatgtggatgcttttgtttttccctctactctgttgtatattaaaattgtttttcaaaaaaaaaatcagagaaactaacattcatatagaactttcctttttccttatatgctatttcctgtatgtaagaggataagtcacaccaacctgccatttttcaactggaatggcaagattctgttaggtcagagattaggtgtacctcataaagtaaggtagaaggaatgagttgatagtgtttaatgtgtaacttattcagcgccagtgatgagaagggcaggaagctggagtgttgctactgatctgtacatggacttagtggatcctctgttatttaccttaaaattccaggttctatctgctttggttgccttctttttaaatcttgtcatatcaaacttaagaaatccattaaaagcttggccatttgtgaaactaatatacagaggttgcttgtttatttttggtacacttggaaaagtctttatcaaaggagttatgtcttagagtccccagctacaagcctgattgccttctgggggagatctgactttgcataaaggctgaggccctcttcaggttaagtgaaggaacaaccctgcctgtggtctaacatttggcttatctctttgcccattcttggcagcaaggaggctgatagttgttatgaaagaggagtcagtgtggagagtaggaacttattactcttttttgcaaaatcttcctttaactgccccctagccatcccacagaggcccagggataacgtcctgaaaatgaataagatgagatcattgtatagggtagaacatggactagatgggcttcagaaactttcagtggtgaattttagtagctagtgtttagtgagcatcttgccccatgcactgtgctttatagggattatcctatttaattcttacaacaatcctaagaagtaggtgctcctaattctcactacaaaagagtcaagtgaggctcagcgaagggaagcaacttgcctgtaatttcatagctactaagtgataaagctaggaattgtaacccagcctgtgcctttaaccactaattgaataatactagccactgcaacatgtaagtggtgaaaagtagtttaaaatatggaagaattattatatcctgcatttatgattttggcaaaaaagtgttactaattttagctaattagtataattacaggtagatggttcttatgcctggcatacctgtatatgtaccttttaaaaaaacagctttattgcaatgtaattcacataccatataatccatctacttaaagtgtacaaatcaatggttttaagtttatacagaattgtatgtctgtctccataatcaattttaggacatgtttatcaccccaaagggaaatctgtacctgttagcagtcatgacctattcttccccactcttcctagctcctgggaactactaatctactttctgtctctgtatgtttgcctattctggacaattcagttatagtaaatggaatcatagaatatgtgctgtcttgcgactggcttcttttactttggcatcctgttatcaaggttcatctgtgttgtgccatgtatcattactccattctttttattactgaataatattgtatcatatggatataccacattttatttatccattctgtacacattttcaaagaacactttttaaaatgaggtttgtgttggtcagtttcttgtcagaaatagagttggcaacgtcttctcccagaaaatactcaatcacctagaatagccttcctgggtaaaaaaaaaaaaaggaaattagcacctctgttgcttctaaaaataacttaaaaaaatttcccctaacatttgacacctttgatgtgtcttagttttgctatgtgatcttgaaaatttttgtctcctttccatttcagtgaacacatagcacataaaagataggcagttatataaacagttagtgtaactggccttttttaaaaaagagggtcattttcaacatatttagagagtactgatgaaaataattgtttgtgtgtgttttagaaatagtaaccaaaattctcaatattagagcaattcttcttttggaaaattgccaaggaattgttgttagaaatgctacattataatattttgactggtaaaacatttgtaagctgacccatttaacctgttcccactaaatgtgatgttgaaagtactgaagatacgagaccaggaaacttatcagcaggatgatgcgaagattaaagttaggaaagaagcttccctcctaaaaggtgatcttttaggtgacagtttaatgatttattatattttatggttttacatgatttctgcatttgccctattctactttattttgtggcatatgcaaaataaaaacaagaacttttagaacaaaattccattgttctgttggaaaggagctactgggaagcccagctatctgtaatctcctccctcccctttcctacctcaacacacacattcggaaataatgtattatttaaagacttaggtgggagatgattttttaaacagtgattgattagtgtgtgttcagtccactgcccacaactttgacataacatttaatcatgaaaactgatgtttgtcaatcaagagtctgtgtgatatggcattaaaaaaacatcaatttgggagcctggctctagctgtgtaactttagacaagtttttacatatcattgagctttatttctttcacaaaaataacagaattacctcccaaggttatgagcattaaatgcttatgcaatgcatttacctatagcatggtacatggaacagtcctcatattaatgacctgagataaatcaagaaaaagctttaatagctcttgtcttacactggataatctctattatccaactgggtaagtgaggtgatgaaagtgatttttgtgacttgcataccagttatacaaattcattcagatcgttttgttttgttctgttgtcacatttttcctttgataatccagaatggctgtcttgattctagaataagccaataaacttgtgactcaggattttaaaaatctggtggacttatgccgtaagggagcattttcctttaacatttgtttcgacatagtttgccctggcgttgttcagtttttttggagtaccactaatttctcccatacctatgagcaggtagtatgaattttccattctgggagagactctattgtagctaaactgcctgtattcaaggatgccttacctcattttattctttgctgtgtacatattgtataagattcttgtcaaagtccatcttttcatagcagaaattgccctttatgattttttaaaattctttgagttatatggaatctgcatgtttaaaacacttacctgtctggtagtgactactctgatatttattaatctacttagtttgtaagtaaagtaaacatttacatctggttaaaatttactatacccccccccaaaaaaaaactacctgtttgtttacctcataactgattctgtttacatatacccacacatacacaacccaccaatactattaagcttttaatgtggacattccaataagaaaacagatcattctcattgactcttactttttgagatgtatggccaaattgtaatttatcctggctacaaaaagaagaatctaggcaaagactaaagaaagccaattgtcatgacacagttacactaggattagactttgttaaaaaataactccacaaggatttgcaatggaatttcaaacattatcttggggaattctggagaaaagaccattttacttagacctttatgtttttgatggtgctgtgcaagagagaagccaggattttttcagaaacactcaaatactggccagacgcagtggcgcatgcctgcaatcacaacactctgggaagccaaggcagaaagatcgcttgagcccaggagtttgagactagcctgggcaacatagggagaccccgtttctattaaaaaaatagctgggtgttgtggtgcctgcctgtggtcccatctactcaggaggctgaggtgggaagatcacttgagcctgggaggtgggggctgcagtgagttgtgatcttgccactgcactgtagcctgggtgacagagtaagaccctgtctcaaaaaaaaagaaaaagaaaacaaacttgtttcagctgtaggtctaatacagtgatcatttagaagataactatcaatctatatataatatacattttttatccaagcgttaattgaaatgagactttcattatgacttagtaataaattctaagtagtttatctataggatcctgtactggtagtggttaaacttgtggactctagagtcagattgcttgggttcagatttcagctttttctggctgggtgactagtatgtgtcaataatatatagcctagtgttgtggggattgagtggataaagccatatgacgtccttaacatagtagctgcttccgtcatcactacattaggggtaccactgtattctattttatagtttattatattgaaagactcccaaagacagagactagagaacactttttacacagcgctgtagtgagtttttttagttgaaagtacattgaccagacacttgaatccttttttccccttaattaaaccacatgtttatctatgtgacatttatagcaggtacataatccataaaaatgaggatattagagaacaaacgccattgggaagtgtaaggaggctaatagagacaagtatgttttcttggcacggaggttaacatccaaacatacttggcacgaagattaacatccaaagcagcatctttgcatgttaacctccatgccaagaaaacattacttgccttagtcttgaatacaatgtaaagataacactgcctaacatcttgtacagctctttgtagtttacagtcttttctgtatacacttggattcttacaagtcactgtatgatagagatcgtatttttcccgttttctatagtataatgttatcttgaatttattactaagtgactaggagacctgtattagaatctttcacctgtgatagatttgtagggcaagcttacaaaggcatccagagtaattactgttcaaagtaacctagctgaattactaaataagtctagattccagttctgatttagtaacactcttttagagtatcaactagaggataatttgtcttttagctgttcgttaatttcctcattaatcttgacgacacttgatttgtttgtttatattttaagggatgatgggataatgcagaacagtataaggatttgctatatcatttgagctaatgcattgaaatattttaagtttttggaatggtaataatgtagatttttttttctttgaaaatgtgccagtaacaatgaaagaaactgaggaaattgccagggaacaatccccacatgcacaaaacctgtaggcccagatagtttcgtgagtgagtgattttcaactttaccagcccgggcaacatagtaagactctatctctacaaaaaaatttaaaaattagcatgatgtggcagcctgtacctctgatctcagctgcttgggaagcggaagtgggaggatctcaagcctaggaggtagaggctacagtgagccatgattgtgccactgcactctagcctggagtctcactgacagagaccctgtcttaaaaatttaatgaactaatttaaacagtttcggttcagagagagtttcctaattcagttttacaaaactgacataacactgataccaaaacctggcagaatttgcatacacacatataaacactaggctaatctaaaaatttatgtgctgtttaataattaatgaacacttattgtctcttacccttgccaggccctgcacgtgatatgcattttatattttcatctttaaaagcctgtatggtgtgacaactcttgttatccccattttacaagtaaggaaaacatgtataatgaggaatctcaaagaggttgaaggaatgcatgttacccagaaacacacaactgtaaagtgccacttgtattgaaattgactgacctgagagagcccaaactcttaaccattatgctagggtataagagagaaaaagaaccataaaggaaaaagagaatatggaagactattaagtaaattgtcttttatactgattatatctaggattagtgcgattttttactttttcccaaatacatttatgtataacatttttaagaactagactcatgtactacacctgtagtcagtaaaactatgatgttcttataatttagaccaatgtgttgagcagtgggtactacaactacataaacttttctgcctggttgctaaaactgctttttattttataataaggaataggtccctgggcgcaatggctcatgtctgtaatcccagcactttgggaggctgaggcagatggactgcttaagcccaggagtttgagaccagcctgggcaacatgacaaaaccccatctctacaaaaaacacaaaaattagctgggtgtggtggcacatgcctgttctcccagctattcatgtcgctgaggtggaaagattgcttgagccccagaggtcaaggctgcaatgagctgtgattgtgccactgtactacagcctgggcaacggagcaagaccctgtctaaaaaaaaaaaaaaaaagaatatagaaagtgtttacagggagcttgagttaatcaacagaaatatttggagctgttttagtggcgtatttttttaaagtatgtggagaatttggctatgaagaattcttcacagaaaactttgtactgggctttggaaatctattgtacaatcctagcttgctttgtgtaatacatcaattcctgaaatcatttaaaatacactttggaatttagaaatagtagaaaccattgaggaggggcactatatggaaaggaagcaatgatgtttcatactcttggaatataaatatgttctgtattatttattcccaaagataattattaaaaatgtgccatggggatttgttgaaaggatttcaacttttcactttgttcaccagtcaccctaattttttgtgtgtgtttatccatgtagatgtactgtgtgtagcgatttcctttaattttatcatggtttatatgaggtaatgaaggaataccatcatagtattttgaagatgttttgaagttttgtttctcccatcagatggacctctgctttttaaacttcttattgaagtgtagcattaatataaaaatgtatgtcggtaataagcatgcagtttatgaattttcacaaagtgaacacacatatgtatcaacatttgcttttagttgaagctaaatgttgttgctaagtgtggatggttaaggtttgttcacctatgttttgaaaagactattctcattaaaaataaaacaaaatcaaatcccaacaaagcttaaaggttaaagaaagcaaaagaaataataaataaagcaaaaaataattaataaacaaaaaggacaaggcatggtggctcacacctataatcccagcactttgggaggccgaggcaggagaggattgcttgagcctaggagtttgcgaccagcctgggcaacatagagagacctcatctctacaaaaaaaaaaaaattagccagacatggtggcatacgcctatagtcccagctacttgggagactgaggcaggaggattgcatgagcccaggagttcacagatgcagtgagctgtgatcacgccactgcactccagcgaggcgacagagcaagaccctgtctcaaaaaaataaaaacaaaaccatgcctgtccatgtgagattgtagtaagtcagtttttgagagtgtttatttctatccgtatcaaatattgaagggctttaatcatcaaaacattttatttattgcttactatatgccatgcattatcacaaatgatttatttacacattattcttacaacaattccagaagatactattattcttattttgaatagatgtaggaactaaagcttagagaggctggataacttgcatgagttcaaatacccaggccatggtggagtcctaccttaaataagaacctgagtttttactgttacaccctgttcaccatgtgtgtatgtagtgcatttgctgcatggtaaagtactgtcagatcgtgttgtaatagagtaaggtgctgggtttttgttttttaaatcaaatgtaaaaggaagtgatttcaagaataattcagaagtcctcaaagcagtgtcttcataggataaggctttggggcctcagtctgatttgaaggctgggcacagggatttgtctcaaagatgtgttttcatagcaagtgcagtgtttaatttgtgtgcttattggacaggctttggagtcaggggagctgttgaagactgtgggaggagtaaggcaccagacccctcttggtgttttcttgccttgatgcaaagatgttgcgtgaactactcgaaggtgtgctcattttgcacctgtctttaaaaagtagtgtctgctttggaaaaatgctagagactaaatttaacttgctttttgttttgggaaaatattttgtaggtatttcattttaagctattttagagaggattttgatgggatgtttcacaatcaccatataccagattgagttctgctattagagaaacttggtaaacaagttatatgaaagttcttgtgctttttgatacccaaaaacttgatgaacaaaattattaatgaagttggaataatgattcatggtttctgaaatatccacataggaccttggattgtggtatgtggaacaagcaagcctagttaggggagtcacataatgtcctgcttacattggtcgctttccttctctttttaacttgatggtattgccacatacgtgatcaaccacaagtggaaactatatcgtggacaatgttgaaatttggggaactgtgactctcttctgctaaaacttggtttgaattttattattgctccaaaaatgtttgctgaaattttgctttcaacatatatcctaaatttatctataattaatagaaaggggaaatctctttggagctgttaagaccttcaagaaagttatgaaacaattgaaaattactttatcactgcagtaatttgcttctagatattgaagctttggaaaccctgatctttgatagattttagttccaggagatcttccctctcttgttcccatggtttgtggtttattttggttctgttcaaaaaccaaaggggaaaataatctgcaagtgacaaatagcaaaagatctaataatataaaaatgtaattgtttgaattactaatatcccagatcttagcaagaataattagagctgactcaacttagggaatgcagttttgaatgttgtcattcttcagagcggtggtcctgaagcctggatgcaaattggacccacctggggagctttaatattaggctctggtcacacccccagatagtctgatttattttatcccatgtggggtcaaatattgatattcttaaatgtttcccactgtacagcgaaaattgataagcaccagtagaatttaattagatttcatgatgcaaataaaagaaaagatgcttaatctaattatttaaatgatgagagtttttagaagtgtttggaaggtttggaaggtcattttttaaagtagcagccagtcaaatggaatgtaatgtttttgttaaggcatcaaagaagcattgaaaccttcatttctttttttttttctttgagatgaaatcttgctctatcacccaggttggagtgcagtggcataatctgggctcattgcagcctctgcctaccagattcaagcttctcatgcctcaggctcctgagtagctaggattacaggtgcacaccaccacacccagctaatttttttattttttagtagagatgaggtttcttcatgttggccaggctggtctcgaactcctgacctcaggtgatccacccgcttcggcctcccaaagtgctggggttacaggtgtgagccactgcacccggccaacaccttcatttcttaaaagtaggtaacatcttattgcttactattaggagtgtggctattttatgaatatctgctatcttcctgaagcccatcttttaaataaatcttgggaaagggtctgtttgaaatggtgtggaaaaaattgaggtgggtaagatttgatgatcttcagcaaagaaacctgaagagtaatatccaatctcaatttagaaacaatgaaaagactagtttatacaagttatttcgggcagagggaacaaattgttaaatgacagacttaaaaccaaattaaattaagtcctattattggttgaattgtgcctgcgtgcacacccacacaccaattcatatattgaagttctaacctctagtacctcagagtgtaaccttatttggttgttggaaatagggtcatggcagatgtaattagtaaagaagttacactacaggagaggggagcccttactccactacctggtgtccttataaaaaggggaaatttgggctgggtgcggtggctcacacctgtaatcccaacactatgggaggccgagttgggtggatcgcttgagctcaggagttcgagaccagcctggggaacatggagaaaccccatctgtgcaaaagatccaaaaattagccaggcgtaatggtgcatgcctgtagtcgcagctacttgagaggctgaggtgagaggatcgcttgagcccgggaggcagaggttatggtgagctgagattgcaccactgcactccagcctaggtgacagagggagagctgagatcacgccactgcactccatcctgtctcaattaaaaaaaagtcggggggtgagtggagttggatttggacacagagcccatgtaaacatgaagaccagccatctataagtcaaagagagagacctggaacagttccttcccccacagtctgcaaaaggagccagccctgccaacaccttgatttcagacttttagcctccagaactgtgagaaaataaatttctgctgagggacccagtttgtagtactttgttgcagcagccgtagcaaactaatataagtcccaatattttatttgttttgaaaatctaaacctaggaaaattcagcatttgaaattttactatttctttaaaaggtagggaagcagttctctagaaggaattgtagaatgtgtggttctagagttcttaggttcttgatgactcatactttagccagttactagtcaatccagtttacaaagcagttcatcatgagcccagatcagcagctggagtttcaggagtgtgcattttttttctatttatggtagtagagtgggaagaatctttctagtcacctgagaggtgtttcctaaatgtattttgtatatacagattcaagcctcttacctgacttattcatagtctttctttttttttttctttttgagacggagtcttgctccgtcacccaagttggagtgcagtggtgcgatcttggctcactgcaacctctgcctcctgggttaagtgattctcctgcctcatcctcctgagtagctgggactataggctcatgccaccatgcccagctaatttttgtatttttagtagaggcagggttttaccatgttggccaggatgttctcaatctcttgacctcgtgatccgcccgcctcggcctcccaaagtgctgggattacaggcgtgagccactgcgcccagcacctaactattcatattcttatgaaaatctgaagttggtctctttcttatatatggattaatagcatcctggggaaacgagagatgaacaactttgaatatacatcccatgtcagtggactagaaaagaatggaccatgcctttcatgataaaagcaagtacctcagaaggagaaggctgtaggactaaattaggagtgatcctgggaagtgccctgctgaccaagaagaactggctattcccatgagaaattttgttatagactctgattggtgaagccttggaaataatagtgaaactcatacctccacctcaaacacagctccttaattattctggttttctaaacagagccaagtaagtatgccagcagaacaaatctactatgtttaaagctgactacaatagtgtataagtaaaggacatggaccctggagtcagttcaagttaggtttatgacttggagtagattatttcccttgcctctgttttctcatgtgtaaaatggatagtccagtgtgtctccatcatagcattttgtgatgattaaatagagtgataattcacgtaaagcaatgtgcaaaatgtctcgtgcatattaaatgttggttaatagcaatggcagcagctatgtggccacagtgcatgctactctcccattttagtgtgtaagagtgaataatctcttctcgtgaaatgttataagctcagacagtagaatccatgaattcaaaatattaacaaagcaaaacctggaagggcctgtaggatcaactggtgctcttcattcatttaaaggttcagaaaataaggtcatgaaatcagggttggagaaggccctaggtctcctggttcccagtttttcttttctgctacatgtggctgccttctaaatcacagaaccatgtgtctcttttcattcttcttcttctttttttttttttttttgagacagtcttcttcactcaggccagagtgcagtggtgcgaccttggttcactgcaacctccgcctcccaggttcaagccattcccctgcctcaccctcctaagtagctgggattgcaggtgcccgtcaccatgactggctcattttttgtatttttttagtaaagacaaggtttcaccgtgttggccaggctgatctcgaactcctgacctcaagtgatccacccaccttgccctcccaaagtgctgggattgcagacatgagccaccactcctggccactctctttttttaatcccaaagacttcaaaactacttttcattcttaataaaccttttgcttcaaaggaaacgtttttttctcttgacgtttgtgtgtttgaaattttccttattaaatagtttaaaaattattaaatttaaactgaatttaattatgattgtttaaagcaatttggagtatgcctgactgtacatttactgtctgtacagtaacagaacaaagaaattggtagcagtgattgcctctgggaagggcactgtggtagaagtgacattgattataaaggagaattctggagaatagagtaactactggttagtagaacaggacaaggaataaagtagtaacaagtatctgtggttaaccaaaactcaagaactgtatagactcaaaaatttggaagtatcccttgttatgtacacattagcactctctacccaagctacaggagccaaatagatttggttagggaggaatactttggtttcatttgggtgagaactgctcctgtgaattgcattttacacgcctgtctctgacttatcagtggatgaagtgatgagctctgttcctaccttgtacatgggtttttgcagcataaaagtgcttaattctggactaagccttgttagaagaccaggagcttaattgagcttttagaagagaagaaaaggaaaagtgttttaacaagtccatgtttatgctaggtgggattgcatgtctacaatttacctgtcaaaaaagggaaagggaaggctagctacacttttctttaaggtgtgtgaagtgtatttatgtgagttacggtataatttttttctttctttttttttcagtgacagggttttgctgtgttgcccaggctgaagtacagtaggtattcacagatgggattgtagcacaggacagccttgaactcctgggctcaagccatcctcctgtttcagccttccaggtagctgggactacaggcacataccaccaggcctggcttctatagtataatttttgagcctcctagtttctgttttaaaatttgttttactatttgaagagccagttacttttctagctagcttcctcttttctaaaacaggaagaaagattttgaaataaaacgatccaaatgtgttttaggattattaaccataaatttcagaacatagcattctcgaaggcaaggatattatctgtttagcacctacaatgtgtatttaatttaggtaattaaattattatgacaagtaatgtctaacctcagtgtgtagttttgtaaacattaattttaaaagattgaggctgcttagttgcaatgaaaccataaataatattttgaatatagcagacttacttaaggaaaatagcaaggtgcctggcattattatctatgagcaggaactttttcttacatttaagaagatggcttgaacctgggaggcggaggttgcagtgagtcaagatcgccacactgcactctagcttgggcggcaaagcaagactccatctcaaagaaaaagagaagattctttatagagaagtgtttagttaagaaacataaaatttacatagttttgagttaacttcccacaagatacatattagtaacttgataatagagaaacctggtagatactaccttaactaagtgatcaaaattaatctaggcatggaggcatgcacttgtagtcccagctatttgggaggcagatgcgggaggatcacttgaacccaggagttcgagtccagcctgggcaacagagcaagaccctgtctcaatagtatgaacataaatatatattaaaaattaatatccccagcaatggggggacaaataggtattttggaccccctgacatgatatatttgaaagaacataacattatttctttggtattcctaccaaaaatgcaaactgaatctaatcataaggaaatatacaaacccaaattggtagacattctacaaaacagatgacctgtactcttcaaaagtgtcaagattgtgaaagacaaagagcaaagaacttctcagattaaaggaaaagaaattgttccaggttaaaggagttattaagaaacatgatatttactaaaggaaacctataaccaaaaaagatttttttttaactttttaaaaggacattagtgggacaattagaaatttggataatgtctaaagattagataatagtattgtattaatgttattttcctagttttgataattatgctgtctttatattagatagtatttttatatttaggaaattaacacaaagtaggattaagaagcaatatgtctaacactttcaaacacatcagaaaacaatataggtagagaatgataaatagatgtggttaaatgttagaactgagggaatatgggtgaaggttgtatgggaattatttgtgctgtttttgcaacttttataagtctgcgattatctcaaaatgataaaggaagtagtatcttaatgaggtttgccgctaattaactgagtttttagtaggttgttaaaaaccctctctgggtcagtttcctcatctataaaatgaggtagctgacttacattaaattgtatgggtcctttccattctaaaattctgtgatattataactagacattaggagtaatagtttatactcttaatatagccatacttgaaaagaacaataatagaaaatgagggttaattttcccacttaagtcaaaagctgttgttaaaacacagcctttgtgccaagcgacagtgtaatattaagctcacagatttttttgttttgccaaaaaacttttattgagatttgatttaattaacattttatttgtatgtcacttcttggttcatgcttatgcattaatggcatcttattattattatttattttatttattttttgagaaggagcctcactctgtcacccaggctggagtgcagtggtgcgatctcggctcactgcaacctccgcctcccaggttcaagtgattctcctgcctcagcctccctagtagctgagactacaggtgcatgccaccgtgcccagctaatttttgtatttttagtagagatggggtttcaccatgttagccaggatggtcttgatttcctgaccctcgtgatctgcctgcctcggcctcccagagtgctgggattacaggtgtgagtcaccgcgcccagccttcatttttaaattttaatgccattatttggttgtaatagatacaaattacctaatgcctagaaagattatagagatacagcctgatgatctaaaaattaaattgatggctagtataaaatagttttgagcattatttaacaaaagcaaaactgtgttaatcctttgttttcattttcctctccctaacccttcccagcttggtgatccagctatttttcctgccgtaattgtggaacatgttcctggtgctgatattctcaatagttatgccggtctagcctgtgtggaagagcccaatgacatgattactgagagttcactggatgttgctgaagaagaaatcatagacgatgatgatgatgacatcacccttacaggtgcgtgtgtctccatccagtaggaccttgctgcagcacagctttaggcagtgtcctaatcctgaggatgtgggggcataaaacgcccctaacttggttttaaactgtattaccttcagaaactacagccctacatggagaagaaaattacattttctgtttcatctgctggatttagtactgttttgtcatctcccatttctcctttcctaaatatattgagatgaatgtgacaaaataagaggcatttaaaaggaaccaaacctcaattcatcaagtcttcactgagcagttttttttttttttaagagatggagtcttactgtattgcccagcctagacttggactcctgggctcaagtgatcctcctgccttagcctcctgagtaactgggacaacagtcatgcaccaccccacccagctcactgagtactttcttatatgccttcctccatattcctgtgaacaaaatgagttgttttgtagggaaagagagaggaatgttcttttcttaccactgccacaggaagcaaaatggtgggccatgacccaaatgtacgataaggtcctgggatttatagatttcttttctggttcagtcagaactagtaagatattttaaacttgaagattaggctacataaatgtgagattgtagtaataatactttcatcacttagaaattggtacatgctttctctttttgttcatttacagtcatatatcttggccagggatgttgtggatatttgagaaaactgtttggaagcaaatatttgcatctttattcgtaaaagaaagtttatcagaaataggcaagatgaggtatatctgtagatttcatggtggcaagtactggggctgccttgttctcagctttaccttagcatgtagcacaatgccttagaactgaatagtaagtctaaaggcgggttctgatctatttaggaagttaacatatgatacagtaatgttttaaatcggggaaaggtagaatgactgtatccatctggtgggggagaggccccactgttaacattggttgtcaatacctcatctttgtgttgtcctctgttttagtcacttctcacattgctataaagaactacctgagactgggtaatacttataaagaaaagaagtttaattggctcatggttctgcaggctgtacaggaagcatggctggggagacctcaggaaacttacaatcatggtggaaggcgaaggggaagcaggcacatcctacatggctggagcaggaggaacagaaggcagggtggtagggggtgctacacactttcttttttttcttttttttttttttaaatgcacaaatttattttttctcaacaaacacacatcttaatgcctttacaacttttatctccccaaatatatcttgcttttctttatacatgctgtatacagagttgttttccttatatttagtagttattgcttttttgtgcccttttgggtcctgaatttacacatcaggcatagatcttgggacaggaaagagctgtgaagcaaattcctggaagatcaaaccccttccagcatggccaggtagcacagctgagccagggatgatggggccatattgggtttggctctgccttgcagctggcagtccaaacactgaggacatgcatatttctgcaggcctcactatggtcatctgtccaaaccccagaatccagagactcaaaacgaaatacagtcatacagtaagatatgtgcaaggtttcagggagcccagcagccagaccttacacaaatcaagcaagtttaagaaatattccagaagtagcagttttatgaccttaaaacatgtaataggctgggcacagtggcccatgcctgtaatcccagcactttgggaggccaaggtgggcagatcacttgaggtcaggagttcgagaccagcctggccaacatggtgaaatcctgtttctactacaaatacaaaaattagccaagtatggtggcatacacgtgtagtttagctattcggaaggctgaggcaggagaatcacttgaacctgggagacggaagttgtggtgagctgagatctcaccactgcactccagcctgggcaatgagagcaaaactccagctcaaaaacaaaaaacaaattaaaaaaaaaaaagtaatagagacgatgtaaacctgtcagtagacccaggcaaaaacaattatatttaactgacaatcctgaagcctttccaactttctttttttttttttttttttttttgatcattcttgggtgtttctcgcagagggggatttggcagggtcacaggacaatagtggagggaaggtcagcagataagtgcagataagtgaacaaaggtctttggttttcctaggcagaggaccctgcggccttccacagtgtttgtgtccctgggtacttgagattagggagtggtgatgactcttaacgagcatgctgccttcaaatatctgtttaacaaagccatcttgcaccacccttaatccattcaaccctgagtggacacagcacatgtttcagagagcacagggttgggggtaaggtcacagatcaacaggatcccaaggcagaagaatttttcttagtacagaacaaaatgaaaagtctcccacgtctacctctttctacacagacacggcaaccatccgatttctcagtcttttccccacctttcccccctttctattccacaaaaccgccattgtcatcatggcccgttctcaatgagctgttgagtacacctcccagacggggtggtggccgggcagaggggctcctcacttcccagtaggggcggccaggcagaggcgcccctcacctcctggacggggcggctggccgggcggggggctgacccccccgcctccctcccggacggggcggctggccgggcggggggctgacctccccgcctccctcctggatggggtggctggccgggcggaggggctcctctcttcccagtaggggtggccgggcagaggcgcccctcacctcccggacggggcggctggccgggcggggggctgacccccccgcctccctcccggacggggcggctggccgggcggggggctgacctccccgcctccctcccggatggggcggctggccaggccgggggctgactcccccacctccctcccggacggggcggctggccgggcagaggggctcctctcttcccagtaggggcggccaggcagaggtgcccctcacctcccggacggggcggctggccgggtggggggctgacccccccacctacttcccggacggggcggctggccgggcagagggactcctcacttcccagtaggggcggccgggcagaggcgcccctcacctcccggacggggcggctggccgggcggggggctgacccccccacctccttcccggatgggcagctggccgggcagggggatgacccccccatctccctcccggatggggcggctggccgggtggggggctaacccccccacctcccttccggacggggcggctggccgggcggggggctgacccccacctccctcccagacggggtggctgccaggcggagatgctcctcacttcccagacggagtggctgccgggcggaggggctcctcacttctcagagggtgtggctgccgggcggaggggctcctcacttctcagacgcggcggttgccaggcagagggtctcctcacttctcagacggggcagccgggcagagacgctcctcacatcccagacggggcggcagggcagaggcgctccccacatctcagacgatgggcagcctggcagagacgctcctcacttcctagatgggatggcggccgggcagagacgctcctcactttccagactgggcagccaggcagagaggctcctcacatcccagacgatgggcggccaggcagagacgctcctcacttcccagacggggtggcggccgggcagaggctgcaatctcggcactttgcggggccaaggcaggcagctgggaagtggaggttgtagcgagccgagatcacgccactgcactccagcctgggcaccattgagcactgagtgaacgcgactccgtctgccatcccggcacctcgggaggccgaggctggcggatcactcgcggttaggagctggagaccagcccggccaacacagcaaaaccccgcctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagctttggctcggcattagggggagaccgtggaaagagagggagagggagaccgtggggagagggagaccgtggggagagggagagggagaggagggagagggagagctacacactttcaaaccactagatctcatgagaactcattcactgtcacaagaacagtaaggggaaaatccatctccacgatccggtcacctcccaccaggcccctcctccaacattggggtttacaattcaacatgagatttggagcggggacaaatccaagccatatcactcccttttttttaacaaagcattttttgcatgtattcacattttttgttcagagcaaaccaataaaagttttttgttgaatctagagttacttttcccttaccagtgagggaattggactaatcaggttagaagtttctattcattgctgtctgatctgtatgtgtaacagaataaacaccactatgcatgtatctgggcttgtagttagtgggggtttagcagtgtatcctgatataacttttaaagccttagggtaaggctacagtctttgtaagttgaggaccaatgtctttccggaaggagtgtttcttcctagttctagtcatcagggaaggcattagttctcagagaggaaaccagattctctgtttgtgttttttcttccctttgccttacctcccaacttaccaaagctttgtttaactcttccatccttttctgagcaatgtcatgaaaaagggaagaaccttgtaatcttcgttattccacagtgggggtgacggggagcctttgagaagctctaggggaagaaagagataaggataggacatttttgttcttacacgtgttaggtggcgcttcagatgatgtgttagtttgctaggactgccataagaaagtaccacagactgagtggctcaaatgagaaatttattttctcacagttctggaagctagaagtctgagatcaagatattggtagagttaattccttctgaggcttctttctggacttataggtgacttgtcttccagtgtcttcacatggtcttatgttttgtacctgccagtgttcatatttcatcttagagggacactaaccatattggattagggcctacactaataacctcattttaactcagttatctctttaaagacattctgaggtactgggggttagcatgtcaacatagaattttgggggataccattcagcctataatagatgatattaaagaattactgtaggccgggcacggtggctgacacttgtaatcccagcactttgggaggccgaggcgggcagatcacctgaggtcgggagttcaagaccagcctgaccaacatggagaaatcccgtctctactgaaaatacagaattagctgggcatggtggcacatgcctgtattcccagctactcaagaggctgaggcaggagaatcgcttgaatctaggaggcagaggttgcggtgagccaagatcacaccattgcactccagcctgggcaacaagattgaaactttgtctcaaaaaaaaaaaaaaaagatttattgttagtatatttaagatatgatagtagtattgtgttagacatcttttagatacacatgctaaagtatttagagataaaatatggtattttagattccttcaaaataatcctgtacagagggtaaggacttgagggcagtgagtggggtatggatgaaagaagattggccatttggtgataatagttgaagctaggaatgggcacatggggattcattatatatactatactccacaatttttattttgtttaaaattttcataataaaaatatttgaacagatgcagcggctcacacctgtaatcccagaactttgggaggccaaggagggaggatcacctgagcccaggaattcaaggcctggcttgaggaattcaggcctggcttgaggaattcaagtgagcaacatagcgggaccctgtctctaaaaaaattttaaaaattagctgggcatggtggcctgagactgtagtcctgtctactcgggaggctgaggtggtaggattgcttgagcctaggagtttatggttgcagtgagctataattgagccactgcactctagcctgggagacagggtaagaccttgtctcaaaaaaaaaaagcaaaaccaaaaagatttaatgattttatgaaatttgaggcttagattatattttgagctgtcatcaaaatacataaatttttttttagtcttgccaaaaaaaattaaagttgaatttcatcaagcctccagatatgactactcagttagagggggtatagaaaaacatgttaagctacacaataggaatatagttggcaaaatccaaactatgggaaattctacatgaataaacagcctgagttcttcaacaaataaattgcaaagtaaaaaaagctagacagatgaatggcaactcagaaatgtaaagaaagttaagaaatgtatcagtcaattgcaatatgcagacttaatttgatttaagcaaaaaactgtcttgtctttccttgcactgccaccatttatgattttttaacacaattgaacatttgaatgctggttggctatttaatattaaggaaatattgattttttaatgtaatagtttctgttttttttttttaagacagagtctcactctgtcacccagactggagtgcagtggtttagtctcagctcattgaaacctccaccttctgggttcaaacgattctcctatctcactctcctgagtagctgggactacaggtgcgtgccaccacgcccagctaattttttgtatttttagtagaaacagggtttctccatgttggccagtctcagactcctgacctcaagcaatctgcttgcctcggcttcccaaagtgcgggattacaggaatgagccactgcgccagccaggtttggtatgattttgtgtgtttatagtttatatatatatataaactaaaatattaaatgatgtattctggttctagagataagcggtgtatgactttcagagtaacagatgtctcgtagttaatttaattttctcttcaaatgtgttgcagttgaagcttcttgtcatgacggggatgaaacaattgaaactattgaggctgctgaggcactcctcaatatggattcccctggccctatgctggatgaaaaacgaataagtgagtgattatgattgtttatgtttatgtactttgttaagttactcttgccatctttctttattagtaaaatcaagagattagaaatgatgttatatattttttgttacaatcacattttaaggtatagtaggaattgaggtgcctttgcaaaaacgtagagttaaagatgacattttaatttgagaatgaagcctttgggaacaaaaaaatgtaatttattacttaccaaatagaagatcatgcagaatttcttctcttaacatattgatgagagtattagggtatcaagggcccaaatgattataatttagtcatctctgtagttatcagcaaataggcaacaatctattgaaaattttactgacacatcatggcataaaattcactgccacattattgatctgctttaaaattcctgttctcctttgggcttttctgacaagcaatcaaattcataaagtaaattattgctaaatcagtctaaaatgtttattcaatatttgctatattcacagcagcaataattaggcaataacatgagatacaaatgagcagatactgttcctttcctcaagcttacagtttaattttgaagacagttacttatgtaaataactacaaagccaagaataaaggccacaagagtgatagcgaattgctctagtagcagtgggtattctagctgagaatatcagagactggcttcattgaaggagtattctgacctgggctgtaaatgacaagcttttaataggtagaagagacatgaaaggtcattcaagctggagggaatggagttaaagatacaagacacagatctgttaaaaaaaaaatgaatgaaatctttgagatcaagatgttttggtgtggttgaagtgtaagcttcatggtgggtgggaaatgagattggaaaggtaggtttggaactagattacagaagctttgtaaggcatgctatagagatgggttgtgattatttttttgtttgttttttgtttttcctatgaactatggaaaggtatgtcagttttgttttttattcccctaattttatggtcaggtcagacttaggtttcagaaaataactctcacagcaatgtgaataatcaagaggagagatgagacagactggtgataggaagtcaagtaagaaagacattgaaatagctcgccgtgcctggactggtttagggtatttgattttgggaaggggaacttaaacgcaggaatagatttcaagattttatttctactttaatcttctagtcataatagaaacaagaaattttctcaatcgttttttaacttataatacacagtggactataattagttgattttattttcattagataataatatatttagttcacctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggtaggtgggttactttgtttagggcgcatagtcaagtcttggtgtgaaatctagatatcacttttattctacatagttctttcctgctgcagttaaaacttatgtaagaaaaacattgaaggcacaaaatggaaattatgagttatttcttggccaggcacggagattcatgcctgtaatcccagcactttaggaggccgaggcaggaagattgtttgaggccaggagtttgagaccagcctgggcaacaaagcaagacctcatctctacaaaaaattttaagaattagctgggcacggtaggcacctgtagtcctagatacttgggaggccaaggtggaggatcccttgagctcaggagttacaggtttcagcgagctaaggtcatgccactgcactccagcctgggcaacagactgagaccctatctctaagaaataaaataaaataaaaataaataaataagaaaaagaggtatttcttcatagtagaatcatttcttttaaaaaattaaagtattgggccaggtgcggtggctcatgcctttaatcccagcactttgggaggtgggggtgggtggataacctgaggtcaggggtttgagaccagcctggccaataaggtgaaaccccgtctctactaaaaatatgaaaattagccgggcatgttgacaggtgcctgtaatcccagctacttgggaagctgaggcaggagaatcacttgaacccaggaagtggaggttacagtgagctgagaccacaacattgaactctagcctgggcaacaagagtgaaactccatctcaaaaaaataatgataataattaaattattttatacttttaaaaagtttggtctatcttacagaaaagggattttccaactttttaaagcctcaaatttttatctaaacccttttgtccttgggtaaggtctagtcagcttccttcccaggggttattgtttgaaagcctccagtctgtaccggtgattccagtataagactccagttggaaaaatacaatgggttggaaatcagcaggtaagtaactgaagaggagtattttaggatgtgttgagtgggaatttttaactttttgccaattaggaccacacttgcattctaaagtctgacaccttttccattttattgccttctgattctactcatgcttgcttagtattttgagtataatgtcttgattaatagcatcaccacccacccagtaacctaagttcatgtgaaagtcagggaaattccaagagctgaaaatgaagaggaaaataaaaatagtaaacatgagccgacactgcagcagctcagaagggctgagaaggatatgccgaggggctctggttttattgtccgtgttgaggcagaagcttaggtcttgggctacgcaagatggggtatcggacagagacctcagcatgtaactgggacccttgaagggatataccctcttgggggaaagaaatccacccattggcacagacagatgtcaaggaagcttgggtcccattcagccaggcctctgagtggagaaattctggtttaatttcttttgggtaaatacttagtagtggaatggctggatcacatgttaagtgtacattaaatatttttcagaaacacaaactgctttccaaaaaattttttctccatgtattaaggtggggcagtcataggacttgcctcatttatttcctgtctctcagggatcactggcttttgttgaccgatgtccaatttcttcagtaccattgtttcatacctttttttctgtgtttttaattgtttcaggtgggaagataaatccatgttctgttattccatcttgactagaagaggaagttcccacctagtcttttttaatagccttattcttcgaccatgtttttgttcttttgctttaaaacctctaatcatactatgtaaagtttctatttaataattctgttatgtgtgattcttagagaactaatcctagggtttcctagtctactgcttctcactcagaaagtgtcttcctcatgtattctgtgataccaaaatgtgagttcagcttcaacggggctttatctgaggaaatcttgtatggcctaggttgaatgtataacccacctgagcaattctataagagcttctgcctggtgccccatagttattacagtcctggggctacatctgtgttaattacttggctggcaattcctaatgttagtggtagtttaaaatctagttgtaaacccaggttaagacaggcccaggattaactatgtttatagaaaaatttgtacataaatggctgatctcaactcattgcatcctccacctcttgggttcaggtgattctcctgcctctgcctcccaggtagctgggattaaaggcatgtgccaccacacctggctgatttttgtatttttagtagagatgaggtttcaccatgttggccaggctggtcttgaactcctgacctcaagtggtccaccgcctcgacctcccaagtgctgggattacatggatgagccaccctgcctggccatttatgtacaaatttttcttaaatatgtagtatttgtttacccagtcagcagttaatgggatttgggttgtttgtagtttggggcaactgcaaataatgctgctaagaacatttgtgtatctttttttttttttttgagatggagtctcgttctctcacccaggctggagtgcagtggcacttttatcaacacagtaaaaataccactcaacaataaaacaatatacgattggtacattcaacaaaaatggatgaatctctcaaaataattgtgctaaaagagggaagccagaagaaaaaatatgtttctacagtttacccccaaacaatgtgggggttagggccgtcagcctctgcagccaaaaatccatgtaaaactacaggcgagccccaccatacccagctaatttttaatttttatttttgtagaggtgggtctcactatgttgcctagcttggtcttaaacttctaggctcaagcattcctcctggtttggccttcccaaatgctgagattacaggtgtgagccaccatgcctggccaaaggtcttcatgcttgttgtgtttatgttggctaggctgaggagggaggaggaagaaaagggtttggtcttgctgtctcaggagtagcagaggtggaagagatggaggaagtggaaggggaggcaggagacacaggcacacttgatgtaactttattgaaaaaagatccctatataagtgggcctgtgcagttcaaagctgtgttttgtttgagggtcagttttatttttatataaagctctagaaactaccaactaatctataatgacaggaaacagatgagtggttgcctgtggattgggcagggtgaggaagggcgagatgtaaggattacaaaggggcacaaagtacttttggggtgatgaatatattcattgttttgaatgtagtggtggtgttagtatacatagtcaaaacttgtcaaattgtaaacatcaaacatacgtagtttattatatgtcagttatacctcaataaagctgcttaaaaaataaaaggctaatatcctacttaatgttgaaaaactattggtatgataaagaaccaaatggaatttatagaaataagaaatgaaattgggccatgctcagtggctcatgcttgtaatcccagcactttgggagtctgaggcgggcagacatcctgaggtcggaaattcgagagcaacatggtgaaacgcagtctctgctaaaaatatggaaaaaaattagccaggcatggtggtacgtgcctgtaatcccagctacttgggaggctgaggcacgagaatcgcttgaacccaggaggcagaggttgcagtgagccaagatcgcaccattgcattccagcctgagcgacagagtgagactgtgtctcaaaaacaaaaaaatgaaatgaaattgaaaacatcatgtgtggattaaaacatagactagtcactgcttaagaaagaattagtaaactccagtaaatttagtgtggattaaaaaatatgaaacagttacagacatggagaattaaatgaaaaggtctacatgtttaatcaaagttccagaaacagaatataaaaagtgaggaagagacaatattcaagagatagtgactaagaattttccagaatcacattaatcctcagcattgtgaatcctgagtagttcagctacaataaatctaggcctaaatgcattgttggtaaaaatgcagaacaccaaagacctctcttcaagttctccccactcaaaaaaaagaagccgaccggggagaaactacattacttcaagaggattgattttttttttagattggcagtttagaagctctcaggagaggctggaagaattagacatcttcaaagggctgagaagaaaccactgccaaacaaaaattctatatctaaccaagctgtaattcacctgaagctttgtacattaccaccttgaatgattaggaagatgttggagaggatggatactgggttgggagtttttactggcagcatctgttgtgactaaagctagtggaggaaagtagtggaaataaagacgatatctattttttttaagctggtatatattaatagcataaaataaggtggaggttactgaagtgttggcttctaatactggttgtcatgaacacagccagaagaatctgtctcatgaagggttctctgcagatgtctccagtgatgaaagtcgagatacttggctgactagcatacatttggcagtcttagagactgaagagcgggctttttgacacttttctcccttcctttcattcacccaaatgacttcagaaatgttttcctattccatttctggggataaattgtcactgaccttgtgatttttttttttagctgtaaaattctgcttttctaagttattgccctgccctgtgttatatttacctgtaattcaccacagtaatctaaaccagagcggcagcctcagggatgtttgggtaggaggtagtaactcttcattgtttctcacatatagaatggtagtatgttcagacagcatgatcatgatctcaacctaaatacaaggcagtggcgctgctaggccatggttctagatacttggcaaaagaagatcacaaatacggctttagaatagtttatcgaccccactctgaggctattgggatggacttatttagacattgatggtgggtaaggtaactatgaagtttgttgtgaattgaaaggtacagaaaaacgagatgtttttagaaatacacaggaggatagcatttaactatgtggttcaccaaaattttgcctcacatattttctgtatttctagagtttgggaagtttcttatacttgagaactaactgtatacagaaattatttaatagagaaaaaagctaaaaatccacttctcctaccttaaaaagcttgtataattaataggcagacaaaactgtatggcttatttttggagcccacgttctaccaatgtcaagagcattctccaaaagtttaagaaagcactaccagtatgggtacttcaaaggcaagctatagtaatttaaattaacttcatttttacagatataaactgaggtgtcaaaggtatcatttcttacataagtgtgtttatggtttaacctgcattaatgtccaagttttattaaagttgttttccttttagtaaacagcattttaagagacctgtatatgtgacccatgtataaaaacatttggcacttgaaatttagggtaaacgacaaaatagctgaattgtccattttctctcacttttgaaggcaaatatttatgcagagctgtttttatttcaggaagaaaaactaaaccaccacgaccagattccccagccactacgccaaatatatctgtgaagaagaaaaacaaagatggaaagggtactactgtgtaatacttataggtcaaataacactcagattgctttatagtgcctacctattataactagaaaccaccagctttcttgatatactgcagtggatcttattgctgccacatgcttattagatacatttgccaaattcttaaaactgatagtaaagtagaccaagaaactcgtttgagtgattttcacttacctgtcaaaataatctattcttttcatttaataaagagactcttggaagaatttaaccaggttagattttcagttcatagaccctttaatatgttgtcttgaaattcaagcatttgtataactgttgcccaaatttgaagaaaactgttatggccgacctgctggctctaatctaaagagaactactgttgagagagttcacaaagagacagaaaaaaattatctcaaagtactttctcctaaatcatcacaaatcttacgacaagattgctttgttcacatattttatatgggactcataaaaagatctttattagatgctaaaaattatgaccattatatcacccatactaactaaattatgtcaccaatactaactgaattatgtaatatttttgtataaatataaatggcacttctaagacttttagttgtcttttttgaggttcttttaaatgaaattttggtcatttagaaagaaattgtttttgtttcaggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtatgcgaagttttggtattttattgtgttaagaatatcattttctaaattgtaaaaaaaaatactaagcttaagttcagcaaagcaccaatagtggtaatgcaaatacataataagagggtacattttcagtcaggtgcggtggctcatgcctgtaatcccaacactttgggaggctgaggccggtggattgcttgagtccaggagtttaagaccagcctgggcaacatggcaaaaccctgtctctactaaaaatacaaaaaattagccaggcgtggtggtatgcacctgtggtcccagctactcggcaggctgaggtgggagaatcacctgagcccgggaggttgaggctgcagtgatccagattgtactactgaactccagcttgggcaactggagtgagaccctgtctcaaaaaaaaagagggtgcattctcaaacatgaattgcaagtatgatatgttagttattatagtagaataaatcagtgcttcaggagtactactagaaatcatgagaattttgaacaagagtaacattcttaagctcacttttagttcgtttttcggtgattctgtcatttatccttcaagatacgcatgtatttgagaaagatgtattggaaataagaacgatctgaatgacttttaggggatagacagatatagatataaaatttagcagtcttaaactaaaactctttaattacagtttttgggtttttttaacatacactttttaagttcttgattttgttaaaatagatgacaaaagttggatcactgctattgcatatggttaaattttatacacaaaagtcaatcaaatttactgaatcaaatttaaactgatacatttgccaatttaaatttattgaatcaaatttaaactgataaaatttgcctagtaggaacatttctagaaagccgtggaggagaaacaatttcttgaggcttttggtagttttgattatcctggcaagttggcagaggggggctgagtgtggtggctcgcttctataatcccagcattttgggagcctgagaaggaaggatcgtttcagcctgggagttccagatcagcctgggcaacatggcaaaacccagtctctgccaaaaaatgcaaaaattagccacgtgtggtagcatgcgcctgtggtcccagctactgaggaggctgacgtggaaagattgcttaaggccaggagttcaaggctgcagtgagctgtgatcatgccactgcactccagcctgggcaacagagcaagactctgtctccaaataaataagtaaataagttagcagaaagaggaagaaaagtgaaagaccagaggattccacatagtttatcaacagtcccccaatcagcattagttttagatttagttggtaataagaacttatctctatctgtgcataaatgtatgtttatctcatataaaataacagccctttatttagaaattcttttctcattagtttgattccaactttaaagttttgtttatgattagggaaatttgattttgttgaatattttaattgatgtttgattgattgatgaaattgtctgctttgaataggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggtgagaaaaccaaactactgatgcttatcacttcaatatgtttctgaccagagacattatttgttaagtgggtcaagattcagaaatgaaaataaaagtataaaggtttcaagctagaattcttggttaccagatttttcaggagcagttactattatgtcagtcctctgattatgccactggtccctttatttacattttgacattactggcattattctgtcaaatactacacctttgtataactggattgatacatataagaaattatctagatgggagaaaatccagggtttcaaatctttattcaggccaagtcagaagcttcaaaaattcaacataaattgacatattaggacattgagagtgcatagagttccaagcaataaatgttattccttggaagatcctatcttcgaacaattctaaagttcaaataggaagggaggccaagaatctaaggtcctcttttagagtggcagaagttgaaaaagtaggtttggttttttttttttttttttttttttttttttttcagttaaatcagatttgcctcagagccccaggatgagatgctaaacaacaaattgactgagaggatctgtctgccttagactgatcttcgcagaaatttgggactagtctcagctgacttagaatgggagtatgggaggaaggcagaaaattatatggatatttgtagcatttttctgtttatactgtcatgaatttctagaacatgaaccataataaaatctagcagccctttcaaagccaataaaaattattatttgattacttttattagcaaacttcagtcttacatttttatattccagaatataaatgtggaggttttgctcagttgatcttggagtaaggtaacattacctagaatcaaggcagacttagaagattcagtcttctttgtatagacaatttaaaatgtttgaccttgtgaaaatattctcttaaatcttcacttgatttgcaaggagtacaaagatgacctttacatttttaattggatgctacatcttttaactgttattaaaggagtatatcttgagtagcccttatccaaaatgcctgggaccagaaatattttggatttagaattgtttcggattttgaatcgttgcattatacttacccggcacagcatcccaaatccaaaaatctgagatccaaaatgctcccgtgagcatttcctttgagcatcttattggtgctcaaaaagtttcatattttagatttcagattttcggatttgggatgctcagtgggtgcttatttaactcttactgtccgtattctccccttaatgttttatatttccctaggccctgtgggttacaggtgatgactgggtgtctggttgggagtgtgtggttcctcccattggtttctaggctgtttgttgtttgtatttgtgttgataggagacctacagtggccacagctgattccatggaatttttttagcatctgtattcaaaatattctttttagactgtgagaataaaaccaaaacaaaaaactctagctttgaaagatactaaattgtagatattatagagtaggtttttgttttgttttgtttttttgagacaaagtctagctagctttgttgcctaggctggagtgtaatgacaccatcatagctcactgcatcctacttccaggactcaagcagtcctctcacctcagccttcctcatagctgggactacaggcatgtccagctaattttttaattttttgtagaaatggggttttactttgttggtcttgaaccaagaccaaccaagcaatcctaccaccttggcctcctgaagtgctgggattataagtgtgagccactgcatctggcctagaatggttttttattaggacaagttctggttttgttatttcttatattttttgtttgcatttttgtaattacccaaccttttactatggaaaatttcaaagtatggaaaaattcagctagtactatgaacacttatttactatccacctaaattcacaaattgatagcattttgcattatttgttttctctatttatttatacctttttttctctttgactatatctttcttgatttttgatgacttattaataaaatcagaggcttttaacttttttccctgtggttgagagaagatggaatgtatatgattatatatataattagataaattattaatataacaacaagagctgacacagagcactctttgtacttcatacactttacatatagtgaggcatagaatcctcatagctcaatgagaatagataatatccccgttttatagatgtggaaactgaagcaaggagagaccagggaacttggtcacatgtagcagatggtggagatagtattttaatgctagctgtttagctgcaagcattgaagttaatgacttgctacactgcctaccgatttacataaatcacaggaattgtcagttatttacagtaaaacagcaacatcttaattttgtccttcactcatttctttttatttcatgtgattgcatgtatctatgttgattcagttaagcttttcttaattggtgtacagtatatatgctcagtttttacaaatttacaaaaagaagccagtttgattctggcttcatggtagtcaaagaaacaacaacagaaataaactgctggtaaactattttctgaaaattgccccttggtaaacattggagaccattttacctagcataacttttatttatccaagcattaataatttttcttaggatcttttaaataaattatcctggccaggtgcagtgcctcacacctgtaattccaacactttgggaggccgaggcgggtggatcacctgaggtcgggagtttgaaaccagcctggccaatatggcaaaaccccgtctctactaaaaatacaaaaattagctgggtatggtggcaggcacctgtaatcctagctactcaggaggctgaggcaggagaataacttgaactcaggaggggcagaggttgcagtgagccaagattgcatcactgcactccagctggggctacagagtgagaccccgtctcaagtaaataaataaacaaacctgtgaaaatgtataatgtgtaggttatcctaaaagcatatagaagctgggcgcggtggctcatgcctgtaatcccagcactgtgggaggccgaggcgggtgaatcacgaggtcaggagttcgagaccagccttcccaacatggtgaaaacccgactctactaaaaatacaaaaaattagctaggcgtagtggcgggcgcctgtaatcccagctacttgggaggctgaggcagaagaatcgcttgaacctgggaggcagaggttgcagtgagctgagatggcgccactgcactccagcccaagtgacagggtgagactctgtctcaaaaaaaattttcagctcttcagccttgctaattattagatgtgaaattgaatcacgttaattattttgagtctgtttccttatctgtaaagcacagatgataatatttaaccttccacttggctgtgacaattaaatgacacctgacacctgagtagatcctcaacaaatgctaaatgttatatggtctgtgttagtttcagaaattttgataaattgtaaattagcaatatttttccagttgtttacaagcagcttaggagatttttaaaaagtagtcagctgtaatagaatctgtattacataatacaaccagacgcaactgacagtttaatcattaactaagaagaaagtaattctgtggttggcaaagacttaataatattttatttaatctctgaatttgtattattgaaaattgttttagaatttgttccaataagccaatatatttgcatcgtagatggtatagataagtgtatgcattttctgacagatggcagtcaggtgtctcaagaaaaggactttttttttgagactgagtctccctctgtagcccaggctggagtgcagtggcacgatctcactcacactgctcccttcacctcccagctcctggttcaagcagttctcctgcctcagcctcccgagttgctgggattataggcacgcgccaccatgcccagctaattttttttttcttttttttctttttttttttttttttgagacggagtcttgctctgtcaaccaggctggagtgcagtggcgcgatctcggctcactgcaagctccgcctcccaggttcacgccattctcctgcctcagcctccccagcagctgggactacaggcgcccgccaccacacccgactatgcccagctaatttttgtatttttaatagagatggggtttcaccatgttgaccaggccgtcttgaactctgtaccttgtgatccacccaccttggactcccaaagtgctaggattacaggcatgagccaccgtgcccggccaagaaaaggacatctttttctaatttaaacagaagcagcgaagtcctagtggtagccctgattagcaatatggaaaatttccaagtacattattgcttgtgtcataccttacagaaggaaagaagaatgagagaggcatatattagagagttgtaactgcctattgtttaaggatagaataataaatactcatctttagtatttactaaagatgaagttgctcaggacttaagtggcggcagtctgttgtaatggtaaggcggcacatcggctctgcagtcagatggcctctcttcttctctaactggtcaccttatgcaagctgttgcaacctgtttgtgcatcagtgttttcgtatgtaagatggggataatatttgtagggtggcaaggttatacatattataaggttatgcatattgatgtaatctgtgtgctaactatatgccaagtactattttatctatgtgtatgttatgtaaactcttgtcatgggaagcccttaggccttttttatttaaaaatggtatctgggctgggcacggtggctcacgtgatgccaatgatgtcaggagttcaagaacagcctggccaacgtggtgaaaccctgttcctactaaaaatacaaaaaaattagctgggcatggtggcgggtgcctataatcccagctactcgggaggctgaggcagagaattgcttgaacctggaaggtggaggttgcagtgagctgagatcacaccactgcactccagcctgggcaacagagcgagactccatctcaaaaaaaaaaaaaaaatggtatctggctatagcgtcaggtactgtacccaggctcccatctcaccccagatttccctgaatcaaatgggcaagagaacttgggtggccatctaagtttggtaatctgtatcctgcgtgaatgggcgggctctagtcatcctgtgtctttattcccacttcttttgaacgtgtcctgaattgctctgggtctttgtttcatctttccaccaagccaatttgtttttctcctccactattttatttctcatatgtgagaaacagactgcataactaactttcaaaatgtagctttaataatctagtggtaatatttaacgcttggtttatggagactagtctagctgtcagctgtttgaaatagcaagtatctttcattaaataactttacagaattcaaaggaaacagttgacatccagatactgagatttttcaacaccatttgttttatactatattaacaataaccttaactataaatttcagagctgtgaactttttaaattagattgactcataatatcatttatgtaactttctcttcaatgagtgggattaacaacctacataaactagattttgcattaaaggattttatgttaaactgtagctttatgaccaaaatttgtgaaaattatttgaacctggaaaactgctaaaacatgcttctatgtatttttccaaagcttagccatattttctctaccagtccaagagccctgacaggttaattataatcatggcttgtttcatctaaatatgacatgaaatgtgagctattaaaattctaagaattctgtcatatggttaagactgaggtaggttttttgtttaggttaattaagcacttctccctttatatgtaaaaacaggttgaatacaattatatgaattttggtaattattgtggatgagcatgttggtaacattatctctcaaatattaaaatagcaggccgggcacagtggctcatgcctataatcccagcactttgggaggccgaggcgggtggatcacctgaggtcaggactttgagaccagcctgaccaacatagaaaaccccatctcaattaaaactacaaaaattagccgggcgtggtggcacgtgactataatcccagctactcgggaggctgacaggagaatggcttgaacccaggaggcagaagctacagtgagccaagatcacgccactgtactccagcctgagcaacaagagtgaaactccatctaaaaaaaaaaaaaaaaaaaaaaaaagcaggaatgaatcaaacagatttgcttttaaattcctaattttaagaagctcatgcaaacttcttgctaagcattttaacatcctcctccttccccaacaaaattagctcctcatttgtgttaatgtggccctatgtacagacctttcttccatagcactcagcagatggtatcatagttaatggcctgagagttttgtgttaggcatctctgtatgtagtgtttaatacaaagtctggcatgatattggtcatgctctgttgaaaatatgggaagcagcattttgaaacacataactggtattttgtaaaatgacttgtcaagtgttaaagttttaaatgatgtagaatatgctaattgtctcactttaatttcatcatctcaataggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggactagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctattatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaattctcagtgtctgttttcaggcaaaagtttcttaaagaataagtgtgcagagaatattactagaacatcagcattacttaatgtttataaataaatttcattagtcagaattgcagaatatcatcctttcacttttcctttctagcaggccaaatggcaatttctaaacatcacacaatggattaccaagttgtaaaaattagacaacaataaaatattcccagcaataatattaaacacacttttgttttgttttgtttttgagacagagtcttagctctgtcacccaggctgcagtaaagtggcgtgaccttggctcactgcaacctccacctcccaggttcaagctattctcctgcctcagcctctcaagtagctgggattacaggtgcccaccaccacatccagctaattttttgtatttttagtagagacagggtttcaccatgttggccaggctggtcttgaactcctgatctctggtgatccactcgcttcggcctcccagagtgctgggattacaggcgtaagccaccatgccccacctaagcactcttttgaaaacaagttttctagttagaaactaggtcagttagtagttaaacttggaaaacatagaaaaattttcttatgaaaattaaaatctctgtaatccaataccccatatccagaagtaactttcacttactcattttttcatgtttgtgaatattcttccaaaatgtgattttaaaggctgtgtaatactatattagtataccaaaatctagttaaataaaacctttttaactagataagttagttttatggttttttcaccacatagatagtgaatatcagtgtcttagttcattttctttgttgctgctataacagaatacctgagactgggtaatttataatgaacagaaattgatttgcccacagttctggagtctgggaagtccgatatcaatgcaccagcaggtttgacggttctcattccaaacagtgcctgaacaccgtgtcctctggaggggaagaaggcttcatcttcaaatggcgaagacagaaaagcaaagacagcccacttccacttccaaaagactttttatttatttatttatttatttttttgagacagatttttgctcttgatgcccaggctggagtgcaatggcgtgatctcagctcacctcaacttccgtctcccaggttcaagtgattcttctacctcagcctcccaagtagctgggattacaggcatgtgccaccacgcccggctaattttctatttttagtaaaggtggggtttctccatgttggtcaagctggtctcgaactcccaacctcaggtgatccgtccgcctcagcctcccaaagtgctgggattacaggcatgagccactgcacccagccaagcctttttatgaaggcattaaacccatccatgaaggtggagccctcctggtctaatcactgcttaaaggcctcacctcccaatacctttactttggcaattaaatttcaacatgagttttggagggaacaaacattccagccatagcatacagtacataatggttttttaaaaattaaggatcttgcattatttttgagtcagttatccttataggagatatcagataaactctatttataatagtaacaccatttaaattgtgtatgggttttttttactttaagaagtatagtataagaatttttagagacactgttatttaaggttattggaatagtgtacaattaccatgaatactgaaattttaaagatgggaaaagaagtccgggtgcagtgtctgtcgcctgtcatctcagcactttgggaggccgaggtgggaggatcacttgagcccaggagtttaagaccagcctgggcaacatagtgagatgtcatctttacaaaaattcaaaaaattagccaggtgtagtgatgcattcctgtggtcccagctacttgggaggccaaggcaggaggatcacttgaggcagggagatggaggctgcagtgagccatgatcatgccaccacactccagcctaggtgacagagggagaccctgtattcaaaaaaaaaaaaaaaaagggagaagaaagtcatatagtaagaaccttaggacttcaaaagcttagtcttttggttttaactaagtaccagctactgaggaacctgtttttcccccattagaatatcttatgtatccatatattccttttttatatctatatctatcatcctagttgtagtcttttctatgttattcttgccacagtttattcacttaaaccatatatgagtgtgtattttgtggcaggcagtattctctgtgctggaggtaggtcagtgaacaaaacagacaatagcctcccaagtgacttcctgcttgtgaactcttagtttatcaatatgaactgtttttactcacacttctgacactaaaagcttgggattttttcacacccacacccagttctgacaccaactgggtgtctttgtcctacaattcagttcaattctgaccctaaccacttggagttagcacagaccccacaggttaaggggcttagtctctcaaaactgcccctccttcagatgcccattgcaagtcccaggtttccacttgtacttctgaccagctagctataaatcaggggttcccatgacccccacccacttaggttggataatttgctaaaagagcacacaaaactcagggaaccaatttactggtttacatttatgtcaatttattataaagaatagagctcatgaacagccaaatgaaaaatgcataaagcaatgaatgggaggaagtgaacagagctgctctgccgtctcacgatgtgccacccacctagcacctcaaagtgtttaccagcctagatgttctccagacaccatcattttacgagtttttaaatgaagcttttattacataggcatgcctgattaaatcattggccattggtgattgaactcaatctctacaccctctcctctccttggggatgggactgaaagttccaattctaattacatggttggtttctctggaaatcatttcccatcctgaaactatctggggacccatgaagtgtccaccttattagcataaactcaggtatggttgaaaggagcttgttacgaataacaaaagatgctcttcccttctaaatgccaaaggtttcagaagctagggtgtcaggaacctagggataaaagccaaataaaatgtttttattgtatcacaatcatgcacctatttacagaatagtctttctaaaatatcccttggcagtttgggcaacatagtgagaccccatctccagaaaaagtaaaaatatcacagtgcatggtggcaagagcctgtagtcccagctattcaggaggctgaagtgggagatctgttgagcctgggaggttgaggctgcagtgagctgtgattacagcactgcactccagcctgggtgacagaatgagaccctgtctcaaaaaaatcaaataaaaatatcccttgggaatacataatgttcatatatggaaaccctcaatacctttctacttgtaggataaagtccaaaatccttagcttaccattcaaattcctccatcaaactgggttcctaggccaactatttcagtgttatccattttttttttttctttgagacagtttctcgctctgttactaagtctggagtgcagtggcacaatcttggcttactgcaaccaccgcctcctggggctcaagagttcctcagcctcctgagtagctgggaccacaggtgtgtactgtgcctggctaattttttttttttgtatttttgtagaaaggggtttttgccatgttgcctaggctggtctccagctcctgggctcaagagatccgcccccgcttagcctcccaaagtgctgagattacaggagtgagcccttgtaccctgccgatgtttttcttaaaatgcaaattttttggttccaccccatacttactgaatttgcatctcatgggaaagctgtacaatttgcttttttttttttttcctcccgagacagagtctcgttctgtcgcccaggctggagtgtagtgtcacgatctcggctcactgcaacctccgcctcccgggttcaagcaattttcctgtctcagcctcccaagtagctgggattacaggcgcctgccaccacgcccggctaattttggtatttttagtagagacggggttttgccatgttgcccaggctggtctcgaactcctgacctcaggtgatacggccacgtcggcctctcaaaatgctgagattacaggcatgagccatcgtgcccggcctctacttgaattttgcaatcagtttgtcaacttctaaaagggaaaagcctctgggatttttagttttattttatttcagagatggggtcttgttatattgcctaggctggtctcggactcctggcctcaagcgaacttctggcctcctgtctcaggccccagtagctgagattacagccccacttgggattttgattgggatcatgttgagtctataggtcagtctcggaagatctcaacaatattgagtctttgactcatcaatttggaggagctctccatttttcagtcttctttaattttttttttttttttttgaaatggagtctcgctctctcgcccaggctggagtgcagtggcgcaatctcggctcactgcaagctccgcctcccgggttcacccattctcctccctcagcctcccgagtggctgggactacgggcgcccgccaccacgcccggctagtttttttgtatttctttagtagagacggggtttcaccgtgttagccaggatggtctccatatcctgacctcgtgatccgcccgcctcgccctcccaaagtgctgggattacaggcgtgagcccccgcgcctggccaatttcttttcttttctttttttctttttcttttcttttcctttcttttcttttctttttttttttctttttgagacggagtttcactcttgttgcccaggctggagtgcagtggcgcaatcttggttcaccgcaacctccgcctgctgggttcaagtgattctcctgcctcagcctcccgcggagctgggattacaggcatgtgccaccatgaccgactaattttgtatttttaatagaggcggggtttctccatgttgttcaggctggtcttgagctcctgacctcaggcgatccacccatctcggcctcccgagtcttctttaatttctttcagcaatgttttatagtttccagtgcacatgtcttgcatatctcttgtcagatttactttttagtatttaatattttttatgttactgtaaatgtcatggctttttacattttaaattttgattattagtgattttgctttaaatcttttttctattttattaaagtataactttgtaaagtgcacaaatccgtatataaaactttgtaaagtgcacaaattcataaacctctctttgggaaagctttattgtgaaaaagatacaaataagatagtcttgttagattcagttcgaaaggaaattatcaagtgtaacacgcttacttaaggatggcctcgacattagattgggaagattttctctttcaaatgaatgaaaatgatccctttcataggaagatgttaggtaacacaggataagtgactaaatattttcactcttcgagttgaagaccaactatccttcaagaaatgtcccctaatccagcatggttattcttcaccttctttaaattaaccaagcgaagtacattggcatatttagttgtgtcatttgaatatgaaaacatattttatcaatgacttcttaagtatttgtctgtccttcctcccaaggtttcaataaactgatgccaagaatttatggagaaaattataaaagtttactaaaagatatgagaaacggaatgaatgaagcaagcaattgtgttcatggacaggaaaaggcaatacaagggaaagatatcatttctccccaagctagtctgcaaaataaataaagtgaaacatttttgttgttgttgttgttgctgttgtttttttaaagacaaagaggctcgcactgttgcccaggctggagtgcagtggcatgatcatagcctcaacttcttgggctcaagcgatcctcctgactcagcctcccaaatagctgaggcacatgccaccatgcttggctaatgctttctatttatttattttttgtacagacaagttctccccatcttgcccaggctggtcttgaactcttgggctcaagcaatttttctgccttggcctcccaaagtgctgagattacaggcatgagctactgcacccaggctgcacaaatcttgtgtataacttgatacaattttatgtctcaatacacttctgtgattaccagccagatcaagatatgtaacatttcctgcatccaagaaggtttcttcatgcccctgctccccaccctccctgacaaccaggagattcccttatgatacctctcactacagttttttatcttcatataaatgaaatcaatcatgatatactctgtctggcttctttacctcaacttatgtatataggattcatccatattgtttggtatagtagtagtacattcttattcattgctatgtaatttttttatccaatttgaggacatttagattatttccagtttttgctactgtggataatgctgcgatgaatattcttgtatatgatcataaatactcaggtatatgcccagtggtacaattattgggcagtatgttatgtgtataactagctttagtagatagtgtctgatatagtttgggtatgtgccctcacccaaacctcatgtcaaattataatacccaatgttggaggttgggcctgacgggaggtaattggatcatgggagtgggtttcttatgaatgattaagtaccatcccccttggtactgtcctcgcaacagtgaatgagttcttgggaaagctggttgtttaaaagtgtgtggcacctccccccaccctacttgctcttgctcctgccacgtaagatgccggctctacctttgccttctgctatgattggaagcttcctgagggctccctaaaagcagaagctgctatgcttcttgtgcagtctgcagaaccatgagccaattaaacattttttctttataaattacccagtctcaggtatttctttatagcaatgcaagaacagactaataccgtgtcacacagttttccaaaatgatcaactaatttaaactctcatcaacaatatatgaaacatatagttgctccatattcttgtcaatgcttggtattggaagtcctttaatttaagccattctggtggtagttttggaatctcataatttcaatgtccatgatacagctatttttttttttttgagacagtctgactctattgcccaggctgtagtgcagtggtgccaccttgctcactgcaacctccgcctcccaggttcgagcaattttgtgcctcagcctccctagtagctgggattacaggtgctcaccaccacgcccagttaatttttgtatttttagtagagatggggttttgtcatgctgcccaggctggtctccaactcctggcctcaagggagccacccacctcaagctcccaaaatgttggaattacaggcgtgagccactgcgcctggccatgacatagctattaatatagaacttttcatgttggacctataggtcaatcttggaatttgccctttcagaggctattcatatttatatgcatattggtgcatggcaggggctggtgtacacaccttggtgtatggctgagccataactggagcatactgagaataaccctattctaagtgtgtttggagtcctaggctaaggaagccaggagtagccaacactaagattcactccttatctatgaaagacatccacacccctgctccatctcttagaacacaggctgtacagtggagcaaggccctttgttttgggttaaatggaggttgctagaaggagggtgctaagtgaaaatgctatatagactacatgcttttttttatgaacagtagtggttctccaggccaccccaccaccactggaccacccctgtatgtaagtcctgaataaaccttatatctccttagctggctctgcctctcctatagtaccatcccaatcggaatcaatggggatctggaaggacaactggccatttagataacaagtgaaaattaaccaatgtaattggttacattgtaacattattattaaaaatatttttaaaattactatataacatattattattaaaaaatacatatgaacatttcaataaaggcagaaaaagcacttgatattgaatgctttcctcttgatgttacaaccaagacaaggaagtccattatcactatttctattcaatagtggacatactagccagcaacaaaactaaaacgtataaagattacagagaagttaaaccatctttattcacgattgcaagattgtcatcacataaattccaaaagactctacacagtattacaaataataagggaacttagcaagatgcttgaatgtaacatcaatatgtaaaaatcaatagcgtttctatagtcttacaacaaacgagaatatttaaaaaatgctatttaacatcgcattcaaaacactattcaaaaagaaatctaatgaaagatatgtttgatctctatactgcagtctatccaaacacagctgcattaaagtataaatatgtgtataatctacaaaacattgccaggagaaattagaggccacttaaataaacggccacttaaatggattgaaggacttaatattgttaatatactagttatccccaaacagatctatagatccaatgcaagcccagtacaagtcccagcagttttgtttttttttaaactgacaagctaattccaaaatcacctagaaatacaatggccttagaataagccaaagcaatcttgggagaataaaggacttcaagacttattataaagctacgttaattaacacagtttggtagtggtataaagtcagataaagaccactccctccagctcctcaatctgaccccacccctggaacgcgctggcagctttccccatgggatgtgcatgggtcaaagggcgctgagggaggacctgaacgactgggttgggaaacaaagcggccctgagatcacttcaggccaccttccgcccctcagtgctttcgtatagaaaaggttttccttcttgatctgggaagcccactaagaagaaagcctgggctgtggagttatgaggaagggaatgaatagtacgcgggcgccgggcgcgtctccccgggcaccagaaggcttttagccgctgctaggtcagaacgacttctagcgagtcccagcccttttccattcccagcgcaatgatcgcgggaatccaggcgccatccaggcccctctgttcactgaaaagaccacgcagccgccagtgacatcacggagacgaaagccatgataaaacccagggaaaacggagctcgaagtagcttgtgttttatatatatatatatatatatatatatatatttttttttttttttttttttttttttttttttgagacggagtcttgctctgtcgcccaggctggagtacagtggtccgatctcggcttactgcaacctctgccgcccgggttcaagggattctcctgcctcatcctcccgagtagctgggattacaggcgcgtgccaccacgcccggctagtttttatatttttagtagacggggtttcagcatcttggccaggctggtcttgaattcctgacctcgtgatccacccgtctcggcctcccaaagtgctgggattacaggtgtgagccaccacgctcggcctgtagcttgtgttattaacggacaaggaaacgcccctgcgcgtacacgttcttgagggataaca

SEQ ID NO: 1961 - DNA, 3572 bp, Homo sapiens
cgggacgagtcgagctcttccagccgcccgatgcccacccgaacctccctccgatccagacaccttactcagtccccgggaccagcgttccgctgttcccaactacgggtgcccagacgatccaatccgcgttcgaaatcgcctcctctcccctccccctacaggggcggctcgctggctcaaggccaaggagctcagcgcgccgcctccgcccggaacgcaaacagctgttcccagagacgtctccgctctcaactttgccaactactccgcacgcactttgaccagcggagcaaccgggacctctcaaaagacgatagagaaagaatacttgaagaacgacctagtatttgaatttgctagtaacgtcatggaggatgaacgacagcttggtgatccagctatttttcctgccgtaattgtggaacatgttcctggtgctgatattctcaatagttatgccggtctagcctgtgtggaagagcccaatgacatgattactgagagttcactggatgttgctgaagaagaaatcatagacgatgatgatgatgacatcacccttacagttgaagcttcttgtcatgacggggatgaaacaattgaaactattgaggctgctgaggcactcctcaatatggattcccctggccctatgctggatgaaaaacgaataaataataatatatttagttcacctgaagatgacatggttgttgccccagtcacccatgtgtccgtcacattagatgggattcctgaagtgatggaaacacagcaggtgcaagaaaaatatgcagactcaccgggagcctcatcaccagaacagcctaagaggaaaaaaggaagaaaaactaaaccaccacgaccagattccccagccactacgccaaatatatctgtgaagaagaaaaacaaagatggaaagggaaacacaatttatctttgggagtttttactggcactgctccaggacaaggctacttgtcctaaatacatcaagtggacccagcgagagaaaggcatttttaaattggtggattctaaagcagtgtccaggttgtgggggaagcacaaaaacaaacctgatatgaattatgagaccatgggaagagcactcaggtactattaccaaaggggtattctggcaaaagtggaaggtcagcgcttggtgtatcagtttaaagaaatgccaaaagatcttatatatataaatgatgaggatccaagttccagcatagagtcttcagatccatcgctatcttcatcagccacttcaaataggaatcaaaccagccggtcgagagtatcttcaagtccaggggtaaaaggaggagccactacagttctaaaaccagggaattctaaagctgcaaaacccaaagatcctgtggaagttgcacaaccatcagaagttttgaggacagtgcagcccacgcagtctccatatcctacccagctcttccggactgttcatgtagtacagccagtacaggctgtcccagagggagaagcagctagaaccagtaccatgcaggatgaaacattaaattcttccgttcagagtattaggactatacaggctccaacccaagttccagtggttgtgtctcctaggaatcagcagttgcatacagtaacactccaaacagtgccactcacaacagttatagccagcacagatccatcagcaggtactggatctcagaagtttattttacaagccattccatcatcacagcccatgacagtactgaaagaaaatgtcatgctgcagtcacaaaaggcgggctctcctccttcaattgtcttgggccctgcccaggttcagcaggtccttactagcaatgttcagaccatttgcaatggaaccgtcagtgtggcttcctctccatccttcagtgctactgcacctgtggtgaccttttctcctcgcagttcacagctggttgctcacccacctggcactgtaatcacttcagttatcaaaactcaagaaacaaaaactcttacacaggaagtagagaaaaaggaatctgaagatcatttgaaagagaacactgagaaaacggagcagcagccacagccttatgtgatggtagtgtccagttccaatggatttacttctcaggtagctatgaaacaaaacgaactgctggaacccaactctttttagttaatataccaaagcttatgaataattgtttgttaattgaacattttcaattatatgcagactgactgattctaagataaattctaaggaggtttctaattttgtaattgttaaaaatagagttaattttgactttgttagatgagggaggaaaactcaactgtttctctttgttatctaaatgtttcagaattcaatcgtgaaggaacaggcattttacactatgaagacattcttttgagatttttatttcagttgctatatcataagcatttttaaagtttcttttctaattttacattgtattagattttctgattcttttgtaaatacagaacttaaatagaaggcaacaggaaatttatataggaactattttcattccacttgtgtaagttaagtcttgactctttcaaatgcaaaaaacctattttatgctttgttaaaattatggtgtcacttagattgactttagttgactgcactatataatatagaactatgaatatgtagaataacatgaaaaattggaggtgctggtggtatggctgaccctgtttcagaagcaggatagtataaaagcatcagcctaagaatggcactcccactaactagctatgtaatcttgacctctttgggctttagttcctctcataaaaggaagagatgtattggactagactagatgatcaccactttctcttctagttctaatttttttaattctaatacctatattttcaagttatgtcaattaaatcattatcaggttatttcctaatgtaagaatagctaaaatgttgcagagaaataagtgacccaacaaaatttattcatctattatgggtaagatctgccataaattcttcctaaataatttgtttactaactctttaggccactgtgctttgcggtccattagtaaacttgtgttgctaagtgctaaacagaatactgctattttgagagagtcaagactctttcttaagggccaagaaagcaacttgagccttgggctaatctggctgagtagtcagttataaaagcataattgctttatattttggatcattttttactgggggcggacttggggggggttgcatacaaagataacatatatatccaactttctgaaatgaaatgtttttagattactttttcaactgtaaataatgtacatttaatgtcacaagaaaaaaatgtcttctgcaaattttctagtataacagaaatttttgtagatgaaaaaaatcattatgtttagaggtctaatgctatgttttcatattacagagtgaatttgtatttaaacaaaaatttaaattttggaatcctctaaacatttttgtatctttaattggtttattattaaataaatcatataaaaattctc

SEQ ID NO: 1962 - protein, 724 aa, Homo sapiens [sequence omitted]

SEQ ID NO: 1963 - DNA, 53158 bp, Mus musculus
  misc_feature (1)...(53158): n = A,T,C or G
tcagagctcatgcttccccctagccaccctccaccctggatgggagtcccctgccccttgaaacattgacaccccatcctgccccacttctcaccgagtcctccctagctgagacacaggttctggctcaagactccaagagatgctgtcaccccagggcctctgagtagatgccacagagcaagacctgtgtgtagcgcatccaattatgtaggaaggagggtggggacccctcattctttcatcacgtcacaaaggggaatgagcaagcccacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtcagccggacaccagtccccaccattatctcctgtggagtgagcaatctctgaggaacttagaaagttgttggcacagtagaaagagacaatttattatttattttgctctgtttttggcttttaaagatcttattattattgggctggagagatggctcagtgagtgagaccggagtccaaatgtctgcacccacagaaacaccggtgcagagaaaggaggcttgcaggggctaactgcctagcagcctagctccaagtcagtgagagactccgactcaacgaaatgaggcaggactcatgcctttgattccagcacttggatggcagaggcaggtggatctctgtgagctccaggttagcctgatttacatagtgaattccgagacagccagggctgcacagtgaattgtcttaaaaaaaaaagagagagaaggagagagggagaaagagagagaataaggtggagattgatagaaaagagaaaagtactctctatgtcatctggcctctgtgagtctgcacagataaacccacatgtgtacacacacacacacacacacacacacacacacacgagaaagagagagcacttgccattatttacttaatgtagctccctaacatttattgaacaccaggcaaccttccgaatatttacatgtcctttaatatgcatgcgtaatttgcatatgtcccgcccccataccgtcacgggggagggggtttggcggggaaggagctgttatccctttcatccttaagggacataaagtcagaccacacgactgaggagtggtggaggagcagagcccaggctgctctcccaacctgtcttcctgaggctcccagtttgtttgtttgattggggggcgtggctcctccctgctctgccccttacagagccatgtgaggagctcaccatggggcgagcatgtgagcacagcggttgttggttgctgagttcctagcatgatggttgctgagtgcctagcatgagactgagcttgccattttcaacctcaataggcaggccctgttggatgggtccacgggaggtcaagggtatgcggcagagcttggcagagcaccgacacttgctgccgagagagtgacgccaggccaggtcccgtggccccataaattagaacaacacccagagccctgggcctgggacaggaggcgctgccaggagctacttaggattcaggtttcaggctggtgcccaggagtgggagggctgagaaaggacctggcaccccacgtgctaggctcacagtcgcttcacttagtggggcccctgaggctcttcctcgctgagcagaggtccccaagttaggaagacaatgtagccccaggagcacacgtccccaaacaccaaggtttagaagtgactggctcctctcctgcccacacatagccatgctggaccctgagcccaagagtccaggacaggaagccactgttgatcgtccccattggaccccagactcttatctacaaataagcgggatatcagggggatcttgagacccccatgagcctcttgatcaagccccacttaatcttctctgggtccttgcttggaggaccatggtgaggactccaatctatgggctctcccaggctcgcacagttcattcacgccctgccgtgagggtcccgagacctctctgaagcaaggatggattctgcaggaatctgtgtgcttgtctgtgaaatgagatgggtcaggcaggctttgtggggttgtgtaaagtatggattgagagcccgtggcttgcagtggtaaattctccgtaagttgttgttgtgggtcggattgggtatattacagtatacatattacatcatgataaaccagttactgccctcaaagtgttcatgagacccatgggaaagaccctgttagcatttggggcgctggctaagggaaagagtaaggtgatctggctgatgggatcgggtaagacttcctggaagaggtggcagctatgctgggtcttgtaagacgggcaagggttcctcacacaacagatgataattcccatgggagcaaacccacctgacaggaaagtggaccccatgcagacagtaaacaggtaatttcagtggctggggccaaagatcaagaaatgggccctttgggtgctttgctcggggattagatgttgttctgtgggtaggagggagttctggaaggcttctgagaaagggagtcaccagagatcagactgtttcttcctgtggacagcaccagcaccctgtgatgggttcctggtagaccaggtagagaaggaggcaggctacatacatgctaaggtttgcctccatcgaccctgccccggccagtgccagccctcaggactctggccaccacaatagtgaggatcgggcatgaggcctgggctgagatctccctccctcacctcacctctgttgctgagggtgcttacggggctggcacccacaactcccccttccaactcctccaaagtctcgggggcaggatgtcacaccccggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaggctggaggaccctcagtggcagtgttctccctagtgtcctgagtgctgtcacagtgttcttccctctgtgctgagggctttttagcccaggggtgagggggccttgggatgatggggagatgggggggtgagaagttgagcctgactcccctgtgtgctgtgatcgctggcatgtgactgaacagccttgcaagcacacagcccccacctgtctcagatgaccgcccccaggaaacccaatgccacagagccagggatacctgaggacaaagccagtggggggacgaggcagtggccagagacttgtcagaggtgaccctggctggcacactctcaggaagtgcaccaaggagacacaggcagagagatagtcagaggaggaggtaaccaggcttgtcctccacctgagacctgaggctgagctctaggctcaggaggagctcaggtgtggccctggtgacactcgactgccagaggcaaagaagccgagccaacgccatccaccatctggggagtgtcctgttttcgcttctcagtggctacttaactgccatgagtcctggttgtcttggtccatgggacagtaaaacatgtcccgtagcacatacacacatatcatgaagtacactagtaatcccagaacatgggtgatagatacaggaggaccaggattttaagccagccttggctacatagcaaattcaaggccagcccgggctacatctgccccatctcaaaatatatatatataaatgaatagtgtttgctggagagctggctcagcggttaagagcacccgctgctcttccagcagaccagggatcaattcaagcacccaggtggcagcccggatctgtctgtaattcagcccaaagtgatctgacaccctcatacagatatccatgcgggcgaaacaccaatgcacataaagtaaaaataaataaatcctattttaaagcagaaaggaaatcagagctggagacccagcctgtcatcccagctgctcagaagctgaggcaggagactggttgccagtgcctttctgggctaagaagagagttcaaggcccacctagacttaagtaaacgctgtctcaaaaagtaatgaaaacggaggtgtgtggcggaggctccccaggcaggcatcctctcaaaatggaaggcagacgtttacatcgtaacaaccaggctgattgaaatcagctcaaatcatgtctgttttctgttccactagcgggaaccagtgaccggtgtgttgtctatgtcccacctaacccaaccttctcctccctctggctcctccaggctgaggnnnnnnnnnnnnnnnnnnnncatatagtgcttttggcctttagcagctacaggggcagtagtgggttgagggtgggggacatgggaagctgggtggccaggcatgaagccatacacccataacccgagcacttaagaggcagaggcaggaggatcaagagttcaaggcctgctttgaccagcatggggcatatgaaatcctgtctcaaaaactgaaaactgggagccagagagatggctcagtggttaagagcactggctgctcttccagaagacctggttcaagtcccagcactcacatggtggttcacaaccatctgtaactccaaatctgggggatgccctgttctgggcttcaaaggtagacacacatgcaggcaaaaccctatacgcataaaagaattttttaaatgaaaactagtgctggcaacatagctcgcaattttgtgtctagcatatgtgaagccctgaggtcaattcctaggacagaaagaaggaaggagaagccgggtgtggtggcacacacctttaatcccagcactcaggaggcagaggcaggcagatttctgagttcaaggccagcctggtctacaaagtgagttccaggacagccagggctatacagagaaaccctgtattgaaaaaccagaaaaaaaaaaaaaaaaaaaaaaaaagaagaagaagaagaaggaggaaggagaaagaaacaggggcctggggaggaagaaagactcagagagctgaaggaaacataagctgaggcaggaggattgctgcaagcttgagaccagccttgtgagtaccagactaacccgagctatacggtgagcgtgttcaggatacacacatgcaaagagagaccaggtgctcgcttcggcagcacatatactaaaattaaaacaatacagagaagattagcatggcccctgcgcaaagagagaccaggacttaagaggcagagacaggagcatcactgtgttgcagttagcctgggataaatagcagattagagatgatatgcatagcaccacagacctcaccattgataaagtgcgttgctgagcaatcggggtgggatggtttgcccagatgatgaaacaaggccagatggtccccactctgggctctagagaatattactctagcccatttgcagctttggcacctggtgccacgcaaagaaacaaatccctggggcttggctgatgctgcacacacagcatcgtgctctcaggaaggtgttgggtgtgtgtgtgtgtgtgtgtgtgccagggaacaggtcaggtaggggagaggagccccctgtctggttggattatctgggagaagcatctaacagtccaggagtgcttcctggaggagggggccctgcgtccagagaggactgatgcgctgggaggtagggggttactcctggtattttgtttcattttttttttcattgtaacctgtgacctctgcccttctctcctgtccccatgtgtgcatctcaccaaggtcactgtcaactactatgaagaggagggcagcgcccccattgaccaggctgggctcttcctcacggccattggtgagttggtgctgtgggccaggggtgtcttcactttgggggacctagaaaagaactcagggcaggtttcagggtggcagactggctcctggagctgcttccaagtaatgcaagcttcggagcggagtgtgtgaaccctgagactccagggacagggggcaggggactcctgtggaggagatgtgttgtggtgttcccttcacaggctctgtgggctgcagagagaaagagaaaagctcagagcctctgtccagccctgcacacacacacacacacacacacacacacacacacacacacactacagcctggagtctccaggcactgccactgtccctgacaatcctcaccaccatcccagccccagccctgggcacagagacacagcctagggtccttaaatcatctggtccaggctcttcatttgatccacaaagcatgatgtggcccagagaggttaggaaactcattcacaggcacacagcaacagtatggcaggtcgagttccaagctggaaacaaacccctcagttcttcccctgcagggccctgctgtgggtgtcagggacactgtgggctgagcagaatccagggctgtgacccttctgaataatcagtccctgctacacataagattttatctttattgatgccttcaagctagaaggagtccagacgctcattcggccatccagctgtggttaaacattgacagtggtgggaaccaccatctggacagtgtcccctgactcactgctatagaggtggggtgctctgagaagaaggaaatggaaaaggaggcagataaacacagaccgtttattgagcacccactgtttaccatgctccagaccttgctgtctacccatcaagacatcagtctatccaaaggcaacgaagttgcctgggttacacctagaaatggttgataggtcaccaaatcaagccacttatctcattttctaagagttgtgaaacttcctctaaaaaccggtacttctctgtgagaccccccccccttctcttctcttgtggctctttggaggctggaggaccctcagtggcagtgttctccctagtgtcctgagtgctatcacagtgttcttccctctgtgctgagggctttttagcccaggattgagaaggccttggggtgatggggagatgggggggtgagagttgtagcctgactcccctgtgtgctgtgatcgctggcatgtgactgaacagccttgcaagcacacagcccccacctgtctcagatgaccgcccccaggaaacccaatgccacagagccagggatacctgaggacaaagccagtggggggacggggcagtggccagagacctgtcagaggtgaccctggctggtacactctcaggaacacaccgaggagacacaggcagagagatagtcagaggaggaggtaaccaggcttgtcctccacctgagacctgaggatgagttctaggctcagggggagctcaggtgtggccctggtgacactcgactgccagaggcaaagaagccgagccaacgccatccaccatccggggagtgtcctgttttcgcttctcggtggctacttaactgccatgagtcctggttgtcttggttcatgggacagtaaaacgtgtcccatggctctcccaaagacaataaggagaatggaagcttatctctatgagagggaaaaaccaacattagtaaacgattgtcttcagctagcaccaccattttgacaataaaaagcaggcaagggggcggggttgagatggctcagtagataaatcctgacggcctgagtaatacatatatatatcacgcacatacacacatatcatgaagtacactagtaatcccagaacataggtgatagatacaggaggaccaggattttaaggccagccttggctacatagcaaattcaaggccagcccgggctacatctgccccatctcaaaaatatatatataaatgaatagtgtttaatggagagctggctcagcggttaagagcactggctgctcttccagcagaccagggatcaattcaagcacccaggtggcagcccggatctgtctgtaattcagcccaaagtgatctgacaccctcatacagatatccatgcgggtgaaacaccaaatgcacataaagtaaaaataaataaatcctattttaaagcagaaaggaaatcaatgctggagacccagcctgtcatcccaactgctcagaagctgaggcaggggactggttgccagtgcctttctgggctaagaagagagttcaaggcccacctagacttaagtaaacactgtcttaaaaagtaatgaaaacggaggtgtgtggcggaggctccccaggcaggcatcctctcagaatggaaggcagacgtttacatgttacaaccaggctgattgaaatcagctcaaatcatgtctgttttctgttccactagctggaaccagtgacccgtgtgtggtctatgtcccacctaacccaaccttctcctccctctggctcctccaggctgagggattagaggcagcagctcagaggcagggacaccctgaacgtccctagacactaggcctggccccacagaagcaggtctgagtgcacctcactgggactgtctaagcccacattgacagcaggaaccggggcctcagcacagacaggaattagccgggacttagcctcctctgtccatctcatggtgatctctcaccctctccgtcatccccagcctcagtgtcaccgcctggaaagggggggggggttgtagagcattctagcatggtgcctccagggattcaggggagtggggtgtgcacagggcctgtttcaaggcccagcaggtgctgagcagaggccctcctctctcctctcccttcttactccctgcctggagagacatcatcctgaaatatgggaacaaaccaaggagcccctggccaaatctctgtgtctgatcctgctgtgtgaccctgacaaacagaccaccctctctgggctctactcttaccctccccccaccctcactcccgcaatagactttattgaggaaagttgggggagggggagaagggtgggagggaacagtcacccttcccgctgaggtcccagcagaggagcagaggacgcatactggcacctcggtgcctttctcccctatgtgccttgggtaaatgctccacagaccggagcttcccccaggcccagggcaggaacgttcagcatccacaccaggatgcccttcttctcccagaccccagagtgcttcttcacactgcatccatctcaaacctctaggacaagtcagaagaccaggccagcacagccacggtccccagggctggccgctggcctaaatgcagccacgactcctgtggctaggttcccagggcagtggcctcaaactcaatcctggtgacatttcccatgaatctaccccacacccccggcaccaggcgccacctgacactttggggctattctgggtagctgaggcaggacccagagcctctgggaaatgtctggagcccacaagctgtgaagcaggtgtgttcccctctgtggggagggcagagcccagaagggctgttctggcctctccttgttggcctatagacaacgccccattagagcccgggagaaggtccaggggaccactggtggctggggaggctagaaggcagtggagatgtaagttgaccatggggacagtgatggatccaagagaactgggaagtactgtgggaaatggagaggaggtggccgagagactgtgcacacagagttcattatgggaaggaagctggcaggtccttccgagagtaatgaatcaggacacaggctgggtggtggtggtggtggtgctcgccttccatctcagtactcaggaggcggagtcaggtagatctctgtgaacttgaggacagcctggtctgcatagttacacagagaaaccctgtcttagagagagagagagagagagagaagagagagagagagagagaagaaggagggggagggggagagaagagaagagacaagacgagacgagaaaggaaaagcctgttatgtggcttagtgaggccagggcactgcagggctcacaaccattggtaactccggatctcagggatccagtggcctttgcagttggtacaactcctataaccaaaaccccatgctacagatgaggaaatacgggccaagagaggttgtggaacctgtccaaagtcacatatctcatgaccagagaaccagagttccaacctaaggccgtctcatgttgaaccttctctctaccacaaggctctacaaagcttttctgtgagtggatgcctagagtgtcttccccaagagaaaggggtcaacagggaccctgccctagatcaactgtctgcacctggcaacacaggttccctggcaacacaggttcctttagatggacggggctggagacatgatttctcaacaaaaataaaatgaggagagacggaaaggcagagatggaaacacagacaggcctgtgtatgcactgatgctcctgagacagaccagaggagggaattggaaattgagcccctggtttgcctgccacctgtgaccttgggcatgtgatctgggtctcccacgcctctactgtgaagatcagcctcctgtccctgccagggtttacagggacacaaagctatttgtgtctgctgagggtccctgggagatgatgacctcagccaggccctgtcttccagcaaccaagtgaatggaggagccgcccccaccacttcccactgggctcctccacttgcgccacaactggctggcttgctcacgattgtctcttgtctgcagagatctcgctggatgtggacgcagatcgggatggagaggtggagaagaacaatcctaagaaggttggttagctgccttgagggtggacactatcccgaccctgacatggcggggggtgggggtggagggcgggactgggttgggggacagggggatggacttccagggcaccacagggactgcatggggcattcagccagagctgtccatcagagaggtcagctaccactgcacacatggggcaggaggctaaggctgaaagcaggcagcagaaacagcacagcagcagcgatgggccccaggcaggccaggctccctgtgggaactgtttccctaacataggccacagatctgatggaagaatggatgttcctgagacagaggctgcccaggaaagccatttgtttccccctgtgcctcttttaaatttaaagtcgtcgagggtggtgttagcacacaactttaatcccagcactcagtgggcagagacagacctggtctaagtaacgaactctaggccagctgaggctatcgagtgagaccctgtctcaagaaaacagataactataaattaaaattaaaaccggcagaggtggctcttacctgtcagtgctcaggaggcagagacaagaggattggttgttcatggccaacctaagcaaaccctgtctttactgggggcgtggggaggggtgttatagagaaatctcttaaagacagattgtaggtcttgataatcctgaccaaactgctccggaggctggagatgtagctcagttgacagaggacctgtcttcaatgcaggaaaccccgagtctgttccctggcattgacctggggctaagcaatcaacgaaaaggcgtccagtcccttaacgagaatgttcatacctggaccagtgaagttttcatcagtgtctttgcccaccttgtgaacaccctttctagtagctagtagtggttgtgcatgctaggaatcccagatctcaggaggtagaggaaggaagatcgggagttcaaggccctcctctgctatatggtgagttagaggccaactgtgtgagaccctgtctcaaaacacgaacaaatttatctcttggattgtaggaccaggtcagtcccagaggataacaaaaacctagagagaccaaagttcaaggaagagtccttctcctgggcacttgtcctggagatcggaaaggcaccttcagggagggccaagtggagctgatgcagaaagagggaccattgtggcaaaggtctgggagtctctggggtgcagacgggcatccatgtgggtagagcatagtgtgtggaagagcccagatgccgaggccgtgggtctccgcagccttgtgtctcaccagccttacagaagatctgagaatccaggctttatctgagctaacagtgagggcttcacacagggaaacggcatgatccagctggaggctgctctgggcactgtgactgcaggagagaaagcagagcaaggtgccggccccctcgggagcactcagagcgtgtctggaatcagtcacctcaagcctgtcttagaatgtcacttcctgccaccatctctgccagacacggtcatctcacaccagagctgaggcccacacgccccgttcagccttcctgtctctctgtgctcttgaatgtgggtcctttctgggtactggatttggtaatggagccttccaggtcccagctgctgtcctggagggtaggaagtactccttaccgtgtctgtccctcagtatcccacagaggttgcatgatgacggaaccaggggtggccttgaccatgtcactgctgttgcaggcatcctggacctggggtcctgagggccaaggggccatcctgctggtgaattgtgaccgagacacaccctggttgcccaaggaggactgtagtgacgaaaaggtctacagcaagcaaggtgccagtggggccacactgggggaccgtgggagcgtgctgttctgtcccgggcaggacagagggtgaggcaggagtatacttgggcctacaggggatgatgctcaaaataaatgactgcaaatgccattcaactacacctcgacaggcacgggtagagacaagcggggaaggaccagcaagatggtgcagagggtaaaggaatttggcaacaagccagatgatttgagttcaattcctgagacacacatgataaagagaaagaacagattcccacaagctgttctctctctctctctctctctctcttacacacacatacacacacacatacatacacacacacacaaacaggcacacatacatacacacacacagacacacacatacacatacacatatacacacacacatatacacacacacatacacacacacaaacatacacacacagacacacacacaggcacacacacacatacacacacatacatatacacacacatacatatacacacacacagacacacacatacatacacacacacacagacacacacatacatacacacacacaaacagacacacacacaggacacacatacacagacacacacacatacacacacacatatacatacacacacacatatacacacacacacatatacatacacacagacacacacacacacacacacagatgacaaatagataagtcaggcaaatctgagttccaggccaatgtatgaggaaaaaaaaaaaaaaaaagactagaaaaaaaccccgaaattcctaaagggttgaccagttctccctggtgctagagaaagtaccttttccttaggcttctggtagttacatgcatgaagaaggggccttgaaaaagccatggtgagcccagctcccataacatcctcttcctactctcccttatctacccacagacctccaggacatgtctcagatgatcctgcgcaccaaaggccctgaccgcctgcccgccgggtatgaaatagtcctctacatctccatgtcggactcggacaaagtgggcgtcttctacgtggagagtgagtgatccaatttttgcatttgcagccactgcccctctctctggatacagnnnnnnnnnnnnnnnnnnnnttctccctggtgctagagaagtaccttttccttagcttctggtagttacatgcatgaagaaggggccttgaaaaagccatggtgagcccagctcccataacatcctcttcctactctcccttatctacccacagacctccaggacatgtctcagatgatcctgcgcaccaaaggccctgaccgcctgcccgccgggtatgaaatagtcctctacatctccatgtcggactcggacaaagtgggcgtcttctacgtggagagtgagtgatccaatttttgcatttgcagccactgcccctctctctggatacaggttccccaaggccatggagcccacagagtgactcccagatatgtatctcgctcttcccctgagaagattcaatggcctgtgtctacatgcttctctccagtggccaggggtggaagtcaggatcctgtagccttcatgatatctgaggccagataagcacctcctccaaatagcgccaggcgtttctgagtttcagaagtccctagaggtgccatagctgtccccgttttcctcctggtggtgacagggtgtcctgggtgccaccatgccctctaccttgaagctattcatctaatctgcttatgccgtagagccaccccgtgcccatgcactgtcccctcacccccactgccctggaggagccgcccctgattgaggaaaacctatcagaagaagtgacacagatcgggtccctgagaatgtcagcacagagtctgcactggctaaggtggtccagagaggcctctctggggagtgacatttgagatgagactcaaagggaataatgagaaggagctggtgagaggctgaggaggagcaaacttaacaggggcacagcatacagcaagctggaaaaggggggcagtttcagtactttggaggaagagcaagaccaggctagtgagctgagctgggagagtcgaggccagccagccaagcggggagggccagagcaaagacagggtctgcagtttgttctttgtgcagcagagtcccctcagggatgttgttttcgtttgttgagaccgggtcctgtggcctctaactccctatgtagggaagggaggatggccttcttcactctctgaccctcctgccaccccttccgagtctgggattatagccacacaccatcatcatgccccataatgtggtgctaaggatcaaacccagggcctagttcatgctaggcgagcagtctacagccagaccacatccccagcccctagggtttgggacagaactgttgaagtctacccatgggaggagttccccatgtaaagcgccctttgcagtttgccaagcactgtgggctctgctgtctggaacccagagctttgagctttaccctgggaccccttctggacagggccctcacctcaaggagtgacttagctgggacactgacggacagaagtccaccctgggctctgatcgctgcttggaatgtcccgagtcaggctggctccgctgtcccagggagctgagacgctagtgtttacatggtccaggccagagttgccatgcagcagagggggaccagggggacccagtctgggctttgcctcagccttggcattgacctgtggctaatagtgacatccctgcattctccagatgtttcttcgctttgctaactggagaactctcggggctggctcctctcgctcgcacctctccccttcacttgccatttgagatgggtcctgagctggcaagaaagcccccaccaccaccaccccctgctgtgagcacacggagaatgtcccctggatgtcttagctgggccaccatctcacagggagggtggttgctgggttgccccgcccccaccccccatagtcagtttctagatgtggactcgaggtgccttagttgctgctcctgtgataaaatactctggcaaaaacaatttagaagaaaaaaggtttgtgccatctcaaggtttcaggttacagtccatcacagcaggaaaagcacatcgtcagctcagctctctcctctcttcattctgtccagggtccagcccatcaaatggtaccacccacattaacacacctcagttaccccaattaagaaaattgttcacaggccaacctaatctagatggttcctggtggggactttccttcccaagtgagtctacattgtatcaaatagacaatcaaccaagggaatactcttgagtcaccgtggcccagcacaagggacaatggattttaatcttttttctttcatggaagcatatgggggattttgtccaattctgactaccctgtgtgtcaactgtcacacatgtgttacttcagtgtcacaacctgtgtcccaggagagacagtccagttccccacaaggtcaggagctgggctctgggatacccaagggccttctctgtagtgtgtcatgggctgcatggggcccccactctcatgctttctgagcccatgagaagctctctgtaaaactgtagctatcaagcaatagctggaattatatacactggtgattattaggaccaagatggacagaaatcgccagtggtccttgcaggacctagggactttatcctctaatctcgggtctccccagaagtcggggacttaccttctcccacaaggacatagtaatcaacttgtccccatttgtccaggacctccctgcgttttagcactggatgtctgtcatgccatctatcacaggcaagttgagatggacggtcatactatgtctccttgtcactgaaaaggttgtggcaagtcagaccacgtgctggccagccaaggcagatgactgaagctcaggagaggccagggggtagctggcaggtccagcgcaaggctgaggccactcaataggagtgcattgttggtgcctgcaaggacaggcagccacgtcgggggtggcaggctctgcactaatttggggactctgaccatcgatggagcctctttaaaacaagggctgtgttgttccggcctgagattcaatctgcctggtgttggcacaaactgccagaaagcagccccaaatagaagatgcattgtgagtcacagggcatagtctacatagggaggagaaagccaccagccgccagacactaggcagaacaaatcctcccaccagacccacctccctcggctatggctcctcttgtcccaggccctgtgagagccttgggagaaacttgataacttcagcttctgcaagatcagggtggcttcggtgtttgacatctctcccctgaacacagctgaagcgcagcctgggtcatggcggatgttgcgggtaggaaggagtcgccatagatacacatccaactggatctgagcagagacgggaccctagggcacctgccggccttatgggtgagaaggctatcactttctgtgctgacctgtggaaggatgcttggcatctcagtgctcagccctgcccctgggaggctgaaatgctacttaacttccatctgaaagacattggatagcaaagcactgagttacacaggaaggggcaacatcaccacaccctccctcccagtccccttaggtcccagctgtgttacccatggttatccaggttctcaaggttgctgaagacatcattactgtggcatctgaagtgaccctgtaacacagggactactgtcccagttagcaattgagtgacctgtttgagaggagaatgaaaatcccaggtttgtaacttgcaaatgatgtctggcctggaagtccctctgacttgggaagtgaatcaggtcacctgttcatgtgtcactcagaatcaggctccaggtgagcacactgtctgtcctgagggaggtgctctcgcaagcctgtgttccgggcgacatcattcttgattgtctttagccgtgtgtcccgggcaaggtcctggtccctattctaacccttaggcagctgggcatcaagcaacctgtgtcatccttgctgaaagcgctaagctgaacctcatctgccctttcagatttgcagggtgtaaagaagctgcttcaggaactctgtagggccctagttccaggcctttgccaatgcaagtacctcctccctccacatcctcccaggcaccctgctgactcacggaggtgtctccaagccacttctctctgctcagaagtctcccctgccctccccaccctgcgtaacagataagatcgccactccacgctgccgttagatacttcccacatctgctctctttaccatgggctgagtaccacccttagacacagagatccttgctcatgctggccaaagtaattcaattcatgggaccagccctgaaatcccctgtggggcctctcccgcagggggtgatgggagtcattactccatccaatggacatttattaaattcgatcatgtaccagacaggcagatggcccggcaggcagggctgtctctcacaaacatttgcacaggatgccatggggaaaggtccacacagaccctggcttgctctctggggatgcacaaaggactccttgagaggattatgaacacaagttttccaggcagagggaccagcgctgtaaagagctaggagtttgacagggcaggattgaatgccttcctccccaccagagagccacatggcatggcttccatgatacagataagaatgtctcaaaccaaaggcatgcctgtgttaaagtcataagaagagaacagaaactcggcatttggaattagatgtgggggccccgcccagccatttctgctttctgggtctgtttcctcctctgtaaaatgggaataacacctccctgtgttatgctagccatcccgttctcctctgctctccttttctacgtgccattcccaaagcagctcattttccagatgaggaagccggaagccagcaggcacacagcgtgctgagaccacggcggcgttaacccgtttgcagcatcctgtggtgttttccatttgtgctcttctctctgtgtctaaaggacaagtcactctgtccctttcccccatcagagagctccctgaccgtctcctgatgggagagggtcctaacgtgggtccactgccgccctccccccacagacccgttctttggccagcgctatatccacatcctgggccggcagaagctctaccacgtggtcaagtacaccggcggttctgcggagttgctgttcttcgtggagggcctctgtttccccgatgagagtttctcaggcctggtttctatccacgtcagtctgctggagtatatggccgaggtgagagccacaggcctcccatgtgcagtcaagtatgtccctcgctcagacctgggaactttggacagggcaagtcgggctgaaaatgggatctaacgaagcctaaccatgtgactgactttacagttctgcgacttagtttccctatctgaaaaggaaggatgggggcatctatcccctggggatggattggtacacgcagagacatgtggtgtatggagccagaaaggaggctcggcagttaagagtgcttgctgctcttctgggagagcagagttcatttgcccagcccagacctgatagacacctcacatctgcatgtaacactagccccaggggatctgaagccctcttctggatatcacgggcacttgcacacacatctacataaacaagcactaacacaaacccacacatgcatataacgataacacttggcacagtcccagcgcacagcgcatgcacccagtgtgactctgtggtgtccctctcctctcccatgcccagggcatcccgttgacccccatcttcacagacactgtgatgttccggattgcaccctggattatgacccccaacatcttgcctcctgtgtcagtgttcgtgtgctggtaagggccaggcgtaccccacacaggcagggtggccaagagctggggtcagactcacctaaacccaactcccgtctctgccacttagcggctatatgacccggtggcctctctgtgcctcagagtctctgaaatgcacataaatcttaccttgacaaaagctatataagtgggtggggttatgtggcccgaggtctcagtgacctttacaaagtacctcaatctagagtgctagcagctctgaccacccaaaatgggtggtgctcaccccccccccatgcttcctcctggcctctttcccaatgccctatgccctcccccagcatgaaggataattacctgttcctgaaagaggtgaagaacttggtggagaaaaccaactgcgaactgaaagtttgtttccagtacatgaaccgcggtgaccgctggatccaggtgaggggcgaggggggaggggccagaaggggctctctgaacaccctggtactcagctgcccacatctgtgtggatcgttctgtctgctcaagagcacagagacccgagagagcaagtgtggcttccagcagcaggctacactgaaaccatctctatgcatccacggggagtcgacgggctcatggggagcattctgtggaggttacaaagaaaaagcccagtctgtgacaaagacacagaatatcggttccttgaaagaactatatttaggatatggttatttatgtttttaaaatgaagctgggccatggtagcttatactacccaggaggcagaggttggtgaatctctaagctggaggccagcctggtctacagagtgagttccaggacagccagggctacacagagagaccctgtattggaaaatagaacaacagtaacaacaacaacaaaataaggtcattgtctccaaaagataattgtgtgatcttgtggcaggcagaggcggtctgttgagacgctctgccgtcagaggcaagcctgcctgggcactcgaggcaggctgaggatgagacacatctctcccgagccaggctcacttgtgttacttctgtgctaaatcttacattgattattgggggggtggtccatgcaccagaagccacacatggaggaggtcagaggacagcttggagcggttggttctctccttctgtatgtacgagtccaggggaccaaactcaggtccccagccttggcaggaagctcctttgcctgccatctccctctgtttgctttaatctttgagccagactcacgttgtagcccaggctggccttatactcctaagcttctggcctctcagtgatgagattacaggtgtatactgtcatgcctagtttatttgtgctttttgttttggtttgttttgattctgtcataaggtcttccacacccccaggctggccttgaactcactgtgcaagagggaatggccttaaacttttggtcctcctgcactcattcccccaagtgccaaggattccacaggcatgtgccaccatgctccatgtatgtggtactgggacttgaacccaggacttcatgtttgtgttagccaactctaccacctgggttacattcccagttccttgttttgggctgtgggtttttttttttaaccagtttctcaatatgtagccaaggctggcctctctaacctcctgcctctacttcctgagatctgagattaaatccctatctatcatgtcccagacacccctgggtgctgccgcagctgacaagctctccctattgtgtccccccccccaggatgaaatcgagtttggctacattgaggcaccccacaaaggcttcccagtagtgctggactcccctcgagatggaaacctgaaggacttccccattaagcaactcctggtaagatgctgaggccacctgggggaagacacaggggactcttagagggcagcatagtcacgagatggggagcatcccaagataactagtctcccactcagggcctctgttttctcatctgcaagatgggtccagtaggccctgaggtcggatgtattttctaaactgggagagttgccttgtgggaaataagaactgtgggaggtggagcaaagcccaggcccagaggtcttgactcctgctgctgccccaaccctccaacttgtagctaagtaagtttcaaagaggcaagacagaagtctgccgaagtcaatgttcactgggactttgtgatgtgaatctctgtgttgtggggtttatcaaggcagctcgactcctcaccgtcctgggaggccattatcacctccacaatgtggcctcaagccacgtggaagagtgaaatatgtctctctacatccccacccttcactttgagctggaaacccatgtggagcatattatagagacagctacagatctggctttcccacggtcacatgagggacaaactctagtatagatgccgggccattcagaggtgaccctgcccaaattccctctggagatgtggaagaagcagtgtgtgagccctgctctgggatgactgagggacaagtcttaaacagcacccccatatcagaaaggggacctcaggcagacttcatagcctcagaatatgcatctgtaaaacaggaaaatgtcaccccagatcattactccatcaaaggcatgccagagccatcaaatctgggcctgatcagtgactatcatggtctggtttcactgccccagcctggaagctgccctccacggccctccatgtggggctatccattttccctgacatggagaagagggccatcaaatcaaccacccaagggctaccccaggcagcaggaatgggaatcgagctcacagccttgtccattctcttccccgggcctccatgtcttcagtcctccaggctgacccggtgtcccaggcccagcctgcattgttctcagaggccaggccagacccggctttgtggtgcgtgcctgctggcctgtgtgatgctgtaaagccccagctgccacctgtggccagctcacacatggccaaagaggggccccaggcgagaacgtgctaagctgctaccatgtacctccccgggtgtgcctgtcccttagcctcttagctaaggcggcataggccacatctgtctgccacacaaagttctcttgtgggttggcttgggttttttagggcaggcaaattagttactccctgctctagttaaacaaacaaacaaacaaacaaacaagatccctatatttttgtcaaaaaagaatatatgtgtgtgtgtatatatacatatacatgtatatatgtatgcacacacacacacacacacacacacacacacacacacacacacactcctctctcacagaactgaaactgaggtttagagaaattctgagatggccagtaagatcaacagaacctatgaggccagatcttgatatcaagtaggatggctgtacctatggagctgggcccaggcagagacggggtgcacatacatcacccccacacttattctgtcagcactctcatagactccctgacagtaatgagcagcctcgggtcacagccatccttgaggctgagactccagggtgccagactgcaggtgacatcgggcttgtcccctgagaatgactgctgaggaagagggctcctggctgtagggggctaaaggcagatgtgtgccctctctccccccagggcccagatttcggctatgtgacccgggagcccctctttgagactgtcaccagcctcgactccttcgggaatctggaggtcagtcccccagtgaccgtgaatggcaaggagtacccgcttggccggatcctcatcggaagcagtttccccctgtaagatagcctggggggtgtgtctgggggtggggcagggcagggggcaggcataggagcggggcgggggggggggggtgttatgtacctggagtgaatctaagggagaaatagctccttctgcaatggcctgtaaatctatagacaaccgtggaaagaaagccaagttagcttttacatctcagtataaagtaaaatttgtataccctatctgtatgacccaataatcctcttccacaaatgggagggtggtggtgagatgtaagccgcgtggggaaggggtatgagactgcctggacttggctgcagagggtgaggtctagagcaaggagcgagcagctgaatggagggagtagctgaatggagggagtagctgaatggagggagtagctgaagttagtttcgtaatgttgtgcctatggcaggcaattttaaacccacaaattcaagagatcaataattccatgtataagcagtatgaaaaatatgttattttgtggaaggggtatgagactctagtgaaggtttgctggcagaggagaaggtgcaggggcgcctgtacatgaaaaaagaagagacaagacatggccctggctcacaggcgtgcgtccctggctaactttggctgcccacaataactgtactctcagcccagccaatgaaaaggcagagtctactttaatccaaacattgctgggagagagcgagcagcctggctccccactgcacaagagttgcctggaacctgaggtcacccaagatttgagtatcaagtccctctgacccacatagaatgttcttttatttgcggtacatgggtagtgaccattagcccaccctcccccaactccatggtcacatgcactcacctgctacttcctgtgcctcagtggagtgccaagtgagctcttgtcccacctccaagataatggaagtctcagatactcagtcccatgttaagcatggaagctggctatagcggcttgccatcaaatttctgggtcaaaggctgactgagctctaagccttccacattggccttaccgtcttctggcccggagctcctacatcttctgcttgccccagggtctcacgtctgcagctcaggctcctactatgcccttgctggcaccagccagatctggcctgggtttcagatgctgaatgtctcatcctggggtggcggggggcgatgctctggcacagaggcataagaataatctgctaaaagactcttctccaaccctgccctaggtctggaggcaggaggatgaccaaggtggtacgcgacttcctgcaggcccagcaggtgcaggcgcccgtggaactctactccgactggctgactgtaggccacgtcgatgagtttatgactttcatccccatcccaggcaaaaaggtgagctgatggcccacgactagagtgagctgcataaccaagaatctgtgccctgcccggacttggctgcagagggtggggtctagagcaaggagcgagcagctgaatggagggagtagctgaatggagggagtagctgaatggagcaagtagctgaatggagcaagtagctgaagttggttttgtaatgttgtgcctatggcaggcaattttaaacccacaaattcaagagatcaataattccatgtgtaagcagtatgaaaaatatgttattttgtgttgcacgtacacattcctgtaggtgtgtgtgtgtctctcactaatcctggagctcagcagttgactaggccaccagctggccaataactccagggagccgcttcttctgctccccccccccttagtcactcttctactgcggtgaagagacaccaggaccaaggccaatctttatgaaataaggaaacatttacttgcggccggcttagaggttcataggtttagttcgttatcatcatggcggggagcatggcagcacacagggtactggagggatatctaagagcaacatcctggtgtgcaaacagagagaggggatgggggggagagagagagagagcaagagagcgcaagagagcctgtgcaaaggcctggtcctggtgagggcttttgaaatgtcaaagccccccctcccccaccccagtgacacacctccttcaaccaggccacacccctatatccttctaatcctatcaaagagttcctctccctggcattcaaatataggagcctgtgggggacattcttatttaaacctctgcagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatccccatcccaggcaaaaaggtgagctgatggcccacgactagagtgagctgcataaccaagaatctgtgccctgcccggacttggctgcagagggtggggtctagagcaaggagcgagcagctgaatggagggagtagctgaatggagggagtagctgaatggagcaagtagctgaatggagcaagtagctgaagttggttttgtaatgttgtgcctatggcaggcaattttaaacccacaaattcaagagatcaataattccatgtgtaagcagtatgaaaaatatgttattttgtgttgcacgtacacattcctgtaggtgtgtgtgtgtctctcactaatcctggagctcagcagttgactaggccgccagctggccaataactccagggagccgcttcttctgctcccccccccccccccgccttagtcactcttctactgcggtgaagagacaccaggaccaaggccagtctttatgaaataaggaaacatttacttgcggccggcttagaggttcataggtttagttcgttatcatcatggcggggagcatggcagcacacagggtactggagggatatctaagagcaacatcctggtgtgcaaacagagagaggggatgggggggagagagagagagagagcaagagagcgcaagagagcctgtgcaaaggcctggtcctggtgagggcttttgaaatgtcaaagccccccctcccccaccccagtgacacacctccttcaaccaggccacacccctatatccttctaatcctatcaaagagttcctctccctggcattcaaatataggagcctgtgggggacattcttatttaaacctctgcagtttccattcccgatgagattacactatagtacctggctttttttcccccagagtgagtgctggggacccagataaattcaggtcctcacacttgtgcagtaagcacattgccagccatgccagcccccatgtaaaaattattagtttctattcttttttttcttttttaattgatttatttcatatatatgatgagtacactgtagctgtcttcagacacaccagaaaagggcatcagattctattacaggtgagataccaggtggttgctggggattgaactcaggacctctggaagagcagtctaggctggctcttaacctctgagcagtcacacccagataatggctgatcagttacaacagtccaggaaaaggctgaaggctctggggcagaatgtcccttttggaatgaaaggactgggcgcctctgtgtatctcagaaactctgcaaactgcccatccttttggagaaccccttccctgccaccatcccaggccactttggggcctgtacttggatctgatgatgttgcccaggatacaagaagagacacagtcagccagtcctaagacagacagacttcctaggaagccagtgactctcagcatgaaaggcaccaagtactgggcagccaggactcaggtccttctggcattctggctacctccctgtcccccagcgcctcccctgacaatgtgccacccacggtggcatctcttgcaggaatttcggctgctcatggccagcacctccgcctgctaccagctcttccgagaaaagcagaaggcaggccacggggaggccgttatgttcaagggtgagtgagcagaagcccttgacaggaagccccacagagctcaagagggccttgtcccagagcacccagctgcaccaccaaacccaaaccaaaggtcacgcctgcctggcgatgcagagttgatggagcgcttgcctagcatgcaccaaatgctgggttcgatccccagcactgcagaacccaagtgtggtggtgcctgcctgcggtcctagcactcacagacaaaggcagaagggtcctaactccagggtcatgtaaccctgtctcaaaatagagaagggcaaagtgtatcttcagaactgatatctgaaagagcaccagacctagagagggacggaaggacccaaatgactgccacatgatctgagcccagaagcttgggttttcaagacagcgggatggaagccaggaccttctgagatggtcatgcactcttctgctaagccacattccttctgccataccccatccacccccagaacagtaaaggggggagagaaacagtgtcgatgctggaggcccaggaagggaagtggtttcagctgacatcacgcctgccctgccgggtctggagtgaggctttgtctccctcctaagtggagcgacatagcatctgctgggtctggaatgaggctctgtctcctccagtgaggctctgtctccctcctaagtggggcagacccagggatgagctctgtacctgaattaatcatgagaaagagactctgctgagggaaaccctgccaggcggcatggtgagaaatgccacagcacatctgcactcttgctgtggtaaaatagacacaatgtatcagtcactgtgtcttaccacttcctgccacatggtagcttagtatcctgacactcatagtcactgggtaatgcttatgctattgtcctgtgtccaaggagtgggactggaatgctgcccatgtccaggacagatccacgtaagactgccatcctagccgggcagtggtggtgcacacctttaaccacagcactcgggaggcagaggcaggtggatctctgagttcaaggccagcctggtctacacagtgagttccaggacagccaaggctgtgataaaactaaaataacaaacatagatagatggatggatggatggatggatggatggatagatggatggacagacagatagatagataacactgctatcctgttctagcctcctggtggcaagtttttttttctgcgttggcaggtgtaaggcttggctttctagaagtttcctttctatcttaagcttgcctcaaatgctgcccccacacaccatggttagaaatattaatgccatagagtcacggagaggactgtggcgtggtggcagcacaggggcagggtcccacagccctggtctctttggtgttgtgacgctacaagtctgggccatgcagagagctgacaggctatatataaataaaatataacacttttagcacttgggaggtggaggctgaaggttgtaggttcaaagccaacccataagaaaaaaaaaaaactaaaaggaaaaaataatgttaatcaaatatacaaggctcacagccttgtggtccggctgcctgtgtggccacttgctgtgtagggaaacgcagcttcctcacctttaacagtagcagctacctcacaggaacatggggaagactgtctggggagcacggctagcatttaaaagattacttatctagtgtatacaaggtcctggcttcccaccaaagaacagactgcaggcacttggatgtcactaatctgacctaaagcctccaggctatggagctagagtcagaggcaggctctctccagggccagcactgagtaacaggaggggtgtttgaaccctggtcagctgctaacattcaaagggggcacccaggtgacttctcctcctgccagagagcacaaggtgcctgcacccccattcctggcttaggagacatggttggtctggagagggggacacacatgcctccctgggtagaagggagataccccctcttccccatccattccccccacctcactcccaccccattccccacccccctccactgccagcaaatagctcagatgggacacccaggcaggcacctgagatttactgtcaccctctgacccccacaggcctgggaggcatgagcagcaagcgcatcaccatcaacaagatcctgtccaatgagagcctcacgcaggagaaccagtacttccaggtacagcagtgggagggcaggaagggatggcagactgtgtgaggtcttggcagaggctggttctatgggaacggtcaggggctcgaggcttctggcccagagaggccagcaagcacctgctggatctacttgctgtgtttctgcgcagcggtgggctcaaggagcctcgagcccagcaggagatgggaaagcagttgtacttgtaggcccagagttctatcagacaagtgctcggagcggacacgccccttagagccacaccccttagagccacaccaaagcttcagacttgttgcctgaatagcggtggcctgagcccatccctcacactgaagcttcggcagctcacacaaccctgagggactgctgtgggtgtgacagtctgctccagtcttaaacgttgcaccagacattaaacccagcgcccaggagaagtagctccattgggagagctcttgtcttgacagaaagaaaaccttggatttcgttttatgatgatctaggttaagccaggggcaggtggatctgtgagttcaaggtcagcctggtcttcagttccagggcagccagagcaacacacagagaaaccctgtctcaaacaaacaaaaagaaaggaaggaaggaaggaaggaaggaagagagagagagagagagagagagagagagagaggagagagagagagagagagagagagcgcagagccagtgcaaagtaaatgcccacttggctcctaagcatgcaaggtgttaaatttctaagtcaatttgaagagtcaagaggcagaaaacagaccggaggctgacctcaacagactggactgtttacttaaaacagggaggggcagacacagcaagaaaggggtgtctgtggaagggggaggggttcttggggtttatatagaaggggaggggagggaaaagttaggtgcaacttaacttgggttgcgtgcaaaccccaagtttctctctcccggagttgtttgcctagacagggcggactttatctttagaatctgtcctgaccttgctgtcaggttgtgggtcacagtgggccactgagtcaggcagcggaagtgagggaagtgggcaggagtctcaacacagggccttggtcagggctgggcagaatttgttcaaagtcctatggttgtgtggacttcaggcacaggctgatcagggctccagctgtgctagctctgttggtcagtatgtgcaggtaccctcatggctgcgggaggttcaaagccttacataaatacctgcacagcaccctcgaatacagagctcttagatggcctgcatctcactctgccttggggggggggtgtcaacctgaactgatgaacatggtcagggagtttcccagtaccggtttgctcagtcatgagtcactataaacccgcatccccctccgccccccaccccccatcccactctaggcttaatcactgaggtaggaggaaatggtaagagacaactagttagctctcacctgaaggtcagagaagttggtacaacccagccactctctgaagcaggacccgctgaagctgagccaacgcctcactggggctgacctctgactatccctccatgatccctgcaagaaacaaagacacacacacacacacacacacacacacacacacacacacacacacacacacactgtagtaagtaagagctctggagaagcctagtatcaaaatcttacagctttgcaaagcccagacggcaggtgcggtaattgacagcggaggagagtttaagcactaaggccccacccctccctgctgtcctccttagctgagtgagcaggagagcaaaatcctccagggtcacctgggcctctgccacttaaagtttgtctggttttcagtgaagactgtgcagagttcaggctctggcttacggcctgtttcccgtggtcagggccatctgtgggttgcaggcgagctcacctgctgcagttttctactgcaaagtttaagttggaaggggttgtagctagactggcaagcattagcaggagagttttctgtccatttgtagctgtgcctcaagtcactttttgaaaatggtccattaagccaggcatagtgacatatgcctttaggcctagtacctttgaatctctgtgagttcaaggccagcttggtctatataaagttttaggacagccagagctacaaagagagactgtctcaaaaaatgaggaatggattgtctttttttttttttttttttcttatccctggggggagatgctggagaggtgacagggataccagctaagcaggtgtgtgtgtccccggacttcaacgcttcctctttccccctcccccagcgctgtctggactggaaccgcgacatccttaagagggagctagcgctgactgagaaggacattattgacctgcccgcgctcttcaagatggatgaaaatcaccaggccagggctttcttccctaacatggtgagatactccagccccaacccctcatgccacccccagcagggtgcaaacagccccagaagggcccagctgagttgctgggtaacctcacctctgacccttgccctctctgagcctctccattccctgctaggggtgacatgcttagccttgctttcttactaggtgtctatcccctggcccattactctagacaggagagtgcttggcaaaaactatcacagctcagaatctgtgcctgggtttccccacctctagaggaggatccctgataacacgccctacatagataggacttgacgccctcaggcaaacagtggctgctccctaaacactcgctcccctcccaggtgaacatgatcgtgctagacaaggacctgggcatccccaagcctttcgggccccaggtggaggaggagtgctgcctggagacgcacgttcgaggcctgctggagcccctgggcctcgcctgcacgttcatcgatgacatctccgcctaccacaagttcctgggagaggttcactgtggcaccaatgtccgcaggaagccgttcaccttcaagtggtggcacatggtgccctgactgccttttccttttcctcctccgctgcggtctctgggtccttcctgtacccccaagtccttcccctacaagaagcagatgggattgggggatatatgtgccttgctgtcccctggagaaggacctcagtgtccactgaagccccacccccaccccagtaagcccagccatcctccacctaaaactagtgggacatgtggttagtgtgcagagccctggccagggaaaggggacatcaacaaatcatgtagtcagattgtccccaggaattctcagcctctactccaggccagaatgagggaagggagaagggaggctctgaggtcattggctctcccagcatccatctgacattcaaggtagaccaggagagggtcctggagtaccttggatggtaccctcacttcaagctcacctccctcggggtctcctggtggctggctccctgcacctgttcattccttacagtttcccgtacacgttgcgtccccactccctgagggtccaatcattcagcacagaatcttccagaaataggtcttagcagaggagcgttcttcactttctgtggatgcaggctgcccaaatttaggagataggggaggtctcaaactagcatccacggtctaaaattcggtatatgaagatgctcctgcctgtcaatgctatttctgttctctcgcctggtcctcaattctctggccagttcttgggcccattgctcttcctattttggatattgaccttcctgttctggacatttgtccctccagcagctacacagccagatccaggcctcccgagagcctgagaagcagcctatctctcctcatggatgctggccccagtgtccaaggatgctggccacgttccagcctcagtgctccctttccagctagctgctgctccagaggaggaatttcccagcatgctttccaaaggctcccatccagatacaggcaaatttaccccttggcttccattagaaaggcccccaggagctgcagagatggctcagcaattaaaaatgctccctgctcttggagaggacccaagtgcagttcccaacacctgcaactgtctgtaatcccagatccagaggctccagtaccccgttctggcccctgagggcactgcacacatgtgtacaaacccatacacataaatacatttgttagggtctggagagatagggcccggtggtgcacaatctgctattgcagagtaccggggttcagttctcagcacccaggtggtggctcacaactacctataactctagttccagggggtccaatgctctcatctgacctccacgggcttctgcacatacatggttcacatacacacactcaagcacacatccaagtaaagtaaaataaatgatatttaaaaaataaaaaaaaattttaaataaaaaaggtcctttaaggccaagaagataggaaatattaattctactttgaaaggttaaacagctccattttataaccaaagaaagggttacagacctacattatttttttttattaaagatttatttatttattttatgtatatgagtacactgcagctgtcttcagacacaccagaagagggcgtcagatcccattacagatggttgtgagccaccatgtggttgctgggaattgaacttaggacctctgggcgagcagtcaatgctcttaaccactgagccatctctccagccccagacctacattcttaggggaacaagatttttaccttggattatttcctcagctatgcaatcaacgggttgtatgctactgagcagtgggcacagacttagactccgataacataagctaaccgtagactcgcttgtcccctgcagacaaagcgcacatctacgtggccgcacttgcccttgctgtggtaggctctttgggaacactacccagtatatccaataagcatacgctcaacagtcactgccttcgagagttagggtcgtgtcttcttctccatccagttgggccaacagccatgccaggtcgggcctcagagcctccaaagctgccatcatctgtctctggagacagtggtccctgctcttgagggcaaagccccaaatcctgtctcctgctccagagtagaaaacacgggcacctctctgagggagctgatgtggagaggtgggggcttgtggtgttcggttaaagtgactttactgcttttatttttatctggggtgggaggaagtgagcacctcccatatggcagccgcgtggctttgtagactgctacaatactccctggtggcattggttgtctcagaaatttctggaactccaggactcagacactgcctgtcccatctcacttactcacccagtgtgactcccccccaagtgtggatgcccccttgcctcccctgggtggactccttgctcttccccacccccactgtgttttgttttgttttgttttaacttaggcccagatgcttctgggctacaccagttcctgtttcgatgtgagttttgaaatgctccgtgaagggctgagggacggcaggaagatggcgggagccaggcagtaccaacttcctggcgaagaagccaagatggagactgagaagtgtttggggaagagccaaaataaagagcaataaaataagccgtccacgggaagctacgcggctctgggtgacattctttgcggcttctgagacatagacacaagtcagtcagatcacatgtggcccttgtggtcatgaagctcctattgttctgaacataaagtcttgatccttatcaaactcatctcgaggacccagcaccaccccatcttgccccccacacacacacacatacacacacatacactctcaggactgtgtgtcacacagcctctacccaaggtcgtgaccaatatccacagtaagtaagcagccatgttttaaaactgagtttccccagatgcacacagtgagataagcatttgggagccagtgagttgttagccaannnnnnnnnnnnnnnnnnnncagggcactaactctggcccctttggtccctgatggggagagccaccggtagtctacagcaacatctaaaagaaggttgtatctgctgcattatgaacagttagggagtggggcttggagagattgctcagtggttaaacacgcttgctactcttccagacagtggctaactcccacttttggcctctgtgggcacctgcacgcacacacgcacactcaggtacatacaaataaataacatagagccaagttaaacccgtgaggtagctcaccgggtaaaggggcttaccgtgagcctgcaggctgacttttgtttctgagactacctttaagacaggaggaaagagctgactatatgaagttgtcctctgacctccacatgtctgtcctggcacatggatctacatgcacaaaaaaaaaaaaaacaaaaaaaaaaaccttctagccaggcacgacggcacgtgcctttaatatcagcactcaggagacagagacaggtgaatcttgtgagttcaaggtctatgcagcaagttagttccagacaaaccaaggctaaacagggagccagagaggccagggattggtggcacatgcttttaatcccagtactctagaggcagaagcaggagagtctctgtgagtttgaggccagcctggtcaacagagagagttccaggacatccagggttacacaaagaaaccctgtctcaaaagagaaaaacaacaacaaaaacctagaatccagtcatctgactgtcatagttcatcaaagttgatttctgtaacacagaaagtagaaatgcaaagggaacatcagccttcttccttccagaaccttccagaaagtcctcttgcctaagctatggccatcttggggggcaggggggtggctttgctatgtcaccattgcccactgtcaggatgaaccccccacacccatcttgactctgtcctttattgttaaaggttgtcttgcagggaacaggaagtccttttctcagccctcctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttattacagcctgctcatgacccaaagttaaccccgacgattgaaggagaaaggctgaccatcaacccagatcatcaccaccgaagtaattaaagcaaggtctttatttccagacacaggatgcctcccaatacgtggggttcaagagatcaccgctgtagaataagttgatcataacaacctctttgagggggctggagagatggctcagcagttaagagcactgactgctcttctgtaggtcctgagttcaaatcctagcaaccacatggtggctcacaaccatctgtaatgagatttgatgctctcttctggtttgtctgaagacagctacagtgtacttacatataataaataaataaatgtcaacaaacaaacaaacaaaaaacaacctttttgaagcggaggcatgattgcaaggtggtcgttacaaggtagtcctaataactgtttaaacaaaggccaggttgcaagatgtctgttacaacttctgaaacaaaggtttagttgtcatttttctggaacaggtagttcagcactatctgtagttaaggttacaggcggggcatagcccagtccttgagaagcagacacagtcataaacagcaatgagtgtagtgtgtctttactacacaatggcttttaagtctaagatggaggcaggctggtttgtcacttattttctgtttttttttaaatttattatttatatattattaaattttgcagaccaaacacagatttattaaggaaaagtgagaaagaactccccagagtgggagaggttctaagtaagaaatattttattttcttcttctctgtttggctattgagaattgaaccaaaggtttcacacgttctagatacgtgttctaccactaagtgatatccctttcctccgacctctcgctcgctctctctctgtctctctctctctcgctcgctttctctctagataagtgttctaccactaagtgatatccctttcctccgacctctcgctctcttctcgctctctcactttctctctttcttttccaagacaggatttgtttctgtgtaaccctggctgccctgagctcactctgtagaccaggctagccttgaactaagagatcttcctgcctcctgagtgctaagattaaaggtgtgcatcatcactgctcagcttgctttcttctccctctctccctctctccctccccctccctctccctctctctttgcttctgagataggatctctagcccaggacagccttaagctccctatgcaaccaacagtgatcttgaacttctaattcttctacctccaccttccaagagctgaaatcacaggtatggacctccgtgcccagtttaggcaacgctgagaactgaagcgcagacttcatggctacttgccaccttcccagccccgggttcatagtgttgtggagccatcgctctgcttgtggctcttgagtccctcctaacctgtgaatcttatgaaaactctaagaagggtttctggcccctcggtgggcagtgtcactgacacagtaatagtgattgatcatcttttataaacattgctaccagagcagaataatgattcagccaccactcttggaaagaacttagagacgtgcattcttagcattgaccaccgccctgaggaagaacctggagttgaggattgttagtaaagttaggttaagatggttgggttttttgttttcttgttttttttttaagcggctttgacataaaaaatcttgagcaacaattcgaaattcagaaaaaaccctttgataattgagcaagggatttgttgaggtcagtggacaagaacagtggcagcctgaccagcaccagctgacctggctctcttgttaagagatcggctggtgatcaaggcgatgactaacttcttgaacccatttttgctctccactccctgatatgatttaataaaaaaaattgttaatgaatagatgtgcaccctgatatttaaagtagaaatggctgatcatttttttacataaaagtttagatttgtgattttttaaaatgtttttatgagcttactctttaagataaataataaaaataattgaatctctctttgtaactgcacgttgcagcctgccagtaagagaaactggctgagaaaattagctcgtctctttaactttgttagtctatcacaagttgcttagttacaaatgtgaatgggttcttaggaacaaccttttttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggagggatacactgagtcagctggaggtttggatgctggttggctgatcacactgaattgccttgctttttctccatccctgaccacccatatgtgcctacatatgtgtatgtgtactgcacacatgcctggtgcccttggagatcagaagaaggcatcagacccctagacttgaaactagagatggttgtgagccaccaggtaagtgctagaaactggacccaggtcctctgggggcagtggacagcaagtgttcttacccgctgagctgtcgctccagccccttcaatatgaacttttaaaaccactctctgccctgccgaggctcctcagtgcttcccatgtaaccctgagctactgagaccaacctggtatttgtctttgctcctggactgaacgtctagccctgggggggcgggggggggcagaaagagtctctcaagcagaattgccaccctaggttgcccagatttcccagcacgactggaatggggacagttattcaaactcatcagggttgttgggaggaccagaggagactgttgatgtaaacacatttgtgggcgatgaggtgagattctgcataaacacagggcttccagcagcatgtctgatgaaagcaatatatcactctctccgcggatgccagccaaccagccccaaaccctgcggtcttacggcaaggacagcttggcaacccaagtcaggaaggggccatgaagacctttaagccctatggcatctgtgcctttctggcaccccaaagctcagggcggaggtggagccacccaggaatttattatccttccataacattaagctccccaaatccccatgacgcccaggaatgatgtgactgcagggtgtgtgggcacactggcaccaagggcccctccaataaatcaaggtctcagttttgctggctgctcaatgctttttccaaggtgacctgggtggccattcatgtagcagtggtgtctgtctttgacatggtggctaaaaatggctaagggggccagttctctagaaatactgcctgttgacaccctggaggagttacaaagaaaatgacagccttcctacaaccttggccgatttgggtggccctgatggtggtcccttgggtagtctagaagaacctacccagtgctgagccagggcccctgagaagccaaggccaccttaccatctgttgcgcaagacaaccacaccagtcatagaatcttaactcagctgccacaacccctagtgattcaggcaaggacgctataagtcaaaaagtggcgaaggacttgtcaatggtcacatggccttgagggggcgatcaaggtaacccccaggggttcaggcctctccacaccccctttaatgaggctacctggcagagaagccagattcagggtgagttcccagaaacttggccccatctagccattcctcctgtcatggtaatttctccagtgtcttctaaaagagccagcgtgaggaaacccaagactataaacagtgccctcctctgccaaaggtgagcggaaagaaatcaaatccttcctctggtaacaaggaccagcaaagtcactgggtgccccaagagaccaagtgacttgggataccaagatcacgcctgcccaaggtggtcaaatccccagtcagagggtggggggctctgagagaacccataaaaggtgtcagaaaggctggacagtggtggcgcatgcctttaatcccagcacttggaaggcaaaggcaggcggatttctgagttcaagtccagtctggtctacaaagtgagttccaggacagtcagggctacacagagaaaccctgtctagaagtgccagaaaaaaaaagcagctcaggtgactaaggaaactgacgaaatctgaggacacaggtcggttagtagaaggcttgttcagcacacacaggcatggtggcacacagctgtaatcccagctctctgcagttctttacctgtaggaagatctgaagttggggacagtggacagcctgtgggtccttggtggacagcctataagctacatcacccatctttcctattgtcatcttccttggggttagagaggaattaggtgagcagctcgctcacttaccacagcattccagaggctggcaccagccacatactaggtaccttttctggctgctttggttttggttttgtgtgttttgaggcagggtctcaagtatcccagatggactcgacctcattaagtagtggagggtgagcttggttctcctactgtctccatatgccgggcatgcaacttctgtacctacgtgacgttcatcttttgatcacttcagtcacttaacaagtgtcccaatcaggtagggactgacaggttctctagatttagcacaaagctgaccagacaagagtcacaggtgattgacagacaccactgcaagtagagaagggttaaaaatcacagccaccagcagaataggaaagccccgccctcctggcctctgccccgcccctccacgctacccttccctatcccgcccctcagactccagaggtcaccttaggaacataggaagcccagtgggcatgcgccctacgggccgctgctgcacacacgcacttcctgtacattggctcggggaaaccggaagcggccttccactcgttggcgcttaggcggctagcggtcctcagggtgagaggccggcttcccaccgcggtgttcgacgggatgccggaggggaaggggtggggctgacgtcaggagccaaaatggcggcgacggtcggggtctccttgaagcgcggcttcccggctgccgttctcggcagagtcggcctgcaggtgagcccgggagccgtggttcagtggggagccgtgcccgtcaccgaggctgcctgggtagagaggccgcggagaggcggaaggagcccgggtccaggcctcgggggaggacttaacccggcatcctgctcttgagcatcctttcagacagccattccgcgcttctccatcaccggagagagaggcgcggccgggaggaggttggaagagagaacagaaagacagaggtctgggaggaggacagggagaggtcaaggtcataggatgagcgacctgtggtcgggacccagaatcaaatcctgctagttgtactccgccaggcttgtgtgaaagggaggcctgcggggtgtctggggtgggacccgggaggccaggtcgcacctccaggttaggctggtctggatcggtcaggtcggagggcggtggactctgcaaggcaatgcacttgacccgcagaggaagggagacatgaaagaaagcgaccccgaccccttgaaagatccgtactgtggaagtctgcaggcaagacccggttccctgaagcgtgcttattcaggggtgtgtagcggcactgatctcataccgctggcatgggatgacaggcagagcctagagctgcttttgttaataattctgtagtagctttgtcataggtctccccacacgccctgtatcctcgggagctgcacagtagaagcatttagaaaggcgagagaaactgcctctccttacttaaagctttacagataccattcagtcctcctctggactcctggatagtccttcacaggcggacaacaggaactcacattttgttttggggggttttgttggttttttttttttttttttttagatttgtgtgtgtgtgtgtatatgagtgtgtgctttcgtgtatatgcaccatgtgcccatggagaagagagagctgtatttcctgaactggagttacaggtggttatcagctgccatgtgcgtgc

SEQ ID NO: 1964 - DNA, 4387 bp, Mus musculus
caaggtcactgtcaactactatgaagaggagggcagcgcccccattgaccaggctgggctcttcctcacggccattgagatctcgctggatgtggacgcagatcgggatggagaggtggagaagaacaatcctaagaaggcatcctggacctggggtcctgagggccaaggggccatcctgctggtgaattgtgaccgagacacaccctggttgcccaaggaggactgtagtgacgaaaaggtctacagcaagcaagacctccaggacatgtctcagatgatcctgcgcaccaaaggccctgaccgcctgcccgccgggtatgaaatagtcctctacatctccatgtcggactcggacaaagtgggcgtcttctacgtggagaacccgttctttggccagcgctatatccacatcctgggccggcagaagctctaccacgtggtcaagtacaccggcggttctgcggagttgctgttcttcgtggagggcctctgtttccccgatgagagtttctcaggcctggtttctatccacgtcagtctgctggagtatatggccgagggcatcccgttgacccccatcttcacagacactgtgatgttccggattgcaccctggattatgacccccaacatcttgcctcctgtgtcagtgttcgtgtgctgcatgaaggataattacctgttcctgaaagaggtgaagaacttggtggagaaaaccaactgcgaactgaaagtttgtttccagtacatgaaccgcggtgaccgctggatccaggatgaaatcgagtttggctacattgaggcaccccacaaaggcttcccagtagtgctggactcccctcgagatggaaacctgaaggacttccccattaagcaactcctgggcccagatttcggctatgtgacccgggagcccctctttgagactgtcaccagcctcgactccttcgggaatctggaggtcagtcccccagtgaccgtgaatggcaaggagtacccgcttggccggatcctcatcggaagcagtttccccctgtctggaggcaggaggatgaccaaggtggtacgcgacttcctgcaggcccagcaggtgcaggcgcccgtggaactctactccgactggctgactgtaggccacgtcgatgagtttatgactttcatccccatcccaggcaaaaaggaatttcggctgctcatggccagcacctccgcctgctaccagctcttccgagaaaagcagaaggcaggccacggggaggccgttatgttcaagggcctgggaggcatgagcagcaagcgcatcaccatcaacaagatcctgtccaatgagagcctcacgcaggagaaccagtacttccagcgctgtctggactggaaccgcgacatccttaagagggagctagcgctgactgagaaggacattattgacctgcccgcgctcttcaagatggatgaaaatcaccaggccagggctttcttccctaacatggtgaacatgatcgtgctagacaaggacctgggcatccccaagcctttcgggccccaggtggaggaggagtgctgcctggagacgcacgttcgaggcctgctggagcccctgggcctcgcctgcacgttcatcgatgacatctccgcctaccacaagttcctgggagaggttcactgtggcaccaatgtccgcaggaagccgttcaccttcaagtggtggcacatggtgccctgactgccttttccttttcctcctccgctgcggtctctgggtccttcctgtacccccaagtccttcccctacaagaagcagatgggattgggggatatatgtgccttgctgtcccctggagaaggacctcagtgtccactgaagccccacccccaccccagtaagcccagccatcctccacctaaaactagtgggacatgtggttagtgtgcagagccctggccagggaaaggggacatcaacaaatcatgtagtcagattgtccccaggaattctcagcctctactccaggccagaatgagggaagggagaagggaggctctgaggtcattggctctcccagcatccatctgacattcaaggtagaccaggagagggtcctggagtaccttggatggtaccctcacttcaagctcacctccctcggggtctcctggtggctggctccctgcacctgttcattccttacagtttcccgtacacgttgcgtccccactccctgagggtccaatcattcagcacagaatcttccagaaataggtcttagcagaggagcgttcttcactttctgtggatgcaggctgcccaaatttaggagataggggaggtctcaaactagcatccacggtctaaaattcggtatatgaagatgctcctgcctgtcaatgctatttctgttctctcgcctggtcctcaattctctggccagttcttgggcccattgctcttcctattttggatattgaccttcctgttctggacatttgtccctccagcagctacacagccagatccaggcctcccgagagcctgagaagcagcctatctctcctcatggatgctggccccagtgtccaaggatgctggccacgttccagcctcagtgctccctttccagctagctgctgctccagaggaggaatttcccagcatgctttccaaaggctcccatccagatacaggcaaatttaccccttggcttccattagaaaggcccccaggagctgcagagatggctcagcaattaaaaatgctccctgctcttggagaggacccaagtgcagttcccaacacctgcaactgtctgtaatcccagatccagaggctccagtaccccgttctggcccctgagggcactgcacacatgtgtacaaacccatacacataaatacatttgttagggtctggagagatagggcccggtggtgcacaatctgctattgcagagtaccggggttcagttctcagcacccaggtggtggctcacaactacctataactctagttccagggggtccaatgctctcatctgacctccacgggcttctgcacatacatggttcacatacacacactcaagcacacatccaagtaaagtaaaataaatgatatttaaaaaataaaaaaaaattttaaataaaaaaggtcctttaaggccaagaagataggaaatattaattctactttgaaaggttaaacagctccattttataaccaaagaaagggttacagacctacattatttttttttattaaagatttatttatttattttatgtatatgagtacactgcagctgtcttcagacacaccagaagagggcgtcagatcccattacagatggttgtgagccaccatgtggttgctgggaattgaacttaggacctctgggcgagcagtcaatgctcttaaccactgagccatctctccagccccagacctacattcttaggggaacaagatttttaccttggattatttcctcagctatgcaatcaacgggttgtatgctactgagcagtgggcacagacttagactccgataacataagctaaccgtagactcgcttgtcccctgcagacaaagcgcacatctacgtggccgcacttgcccttgctgtggtaggctctttgggaacactacccagtatatccaataagcatacgctcaacagtcactgccttcgagagttagggtcgtgtcttcttctccatccagttgggccaacagccatgccaggtcgggcctcagagcctccaaagctgccatcatctgtctctggagacagtggtccctgctcttgagggcaaagccccaaatcctgtctcctgctccagagtagaaaacacgggcacctctctgagggagctgatgtggagaggtgggggcttgtggtgttcggttaaagtgactttactgcttttatttttatctggggtgggaggaagtgagcacctcccatatggcagccgcgtggctttgtagactgctacaatactccctggtggcattggttgtctcagaaatttctggaactccaggactcagacactgcctgtcccatctcacttactcacccagtgtgactcccccccaagtgtggatgcccccttgcctcccctgggtggactccttgctcttccccacccccactgtgttttgttttgttttgttttaacttaggcccagatgcttctgggctacaccagttcctgtttcgatgtgagttttgaaatgctccgtgaagggctgagggacggcaggaagatggcgggagccaggcagtaccaacttcctggcgaagaagccaagatggagactgagaagtgtttggggaagagccaaaataaagagcaataaaataagccgtccacgggaagcta

SEQ ID NO: 1965 - protein, 574 aa, Mus musculus
KVTVNYYEEEGSAPIDQAGLFLTAIEISLDVDADRDGEVEKNNPKKASWTWGPEGQGAILLVNCDRDTPWLPKEDCSDEKVYSKQDLQDMSQMILRTKGPDRLPAGYEIVLYISMSDSDKVGVFYVENPFFGQRYIHILGRQKLYHVVKYTGGSAELLFFVEGLCFPDESFSGLVSIHVSLLEYMAEGIPLTPIFTDTVMFRIAPWIMTPNILPPVSVFVCCMKDNYLFLKEVKNLVEKTNCELKVCFQYMNRGDRWIQDEIEFGYIEAPHKGFPVVLDSPRDGNLKDFPIKQLLGPDFGYVTREPLFETVTSLDSFGNLEVSPPVTVNGKEYPLGRILIGSSFPLSGGRRMTKVVRDFLQAQQVQAPVELYSDWLTVGHVDEFMTFIPIPGKKEFRLLMASTSACYQLFREKQKAGHGEAVMFKGLGGMSSKRITINKILSNESLTQENQYFQRCLDWNRDILKRELALTEKDIIDLPALFKMDENHQARAFFPNMVNMIVLDKDLGIPKPFGPQVEEECCLETHVRGLLEPLGLACTFIDDISAYHKFLGEVHCGTNVRRKPFTFKWWHMVP

SEQ ID NO: 1966 - DNA, 72705 bp, Homo sapiens
gacttgtgatattttaagttgaaattttactatgcttgacagaagtgttaaaaagttataaaaatttgaattcatgataagcataagttaccagatttctaagaataatttaagtgcttgagaaagttgtgtttgttattaaggcaactgaagtatttttaaaagaaattgaatatgttaaatctatacatgcagttaaaaatgtttaactgtgtgtcaacctgaaataaccaggagcgtcagagtctaatttaaaaagagtttaggccaggcacagtggctcacgccaataattccagcactttgggaagctgtgtggatcccttgagtccaggacttcgagaccagcctgggcaacgtagtgggacaccgtctctacaaaaaattttaaaaatcagccatgtgtggtggcccacacctgtagtcccagctactgaggctgaggtgggaggatcacttgagcccagaaggttgaggctgcagtgaactgtgattgtgccactgcactccagcctgggcaacagagcgagaccctgtctcaaaaaataataataaaaaaaatgtaaaatacaccaaagtaaaataaaatagagtttattcaagcacaagatttgagaacggccacccagaaacctcaactccaaagtaatgaactcagcattccgaagtagggaagtgaagttttcatttatagaggcagggacagaggaatttttagccagataacaacatttttcatactaggctggcgcatagttacagccatttgactggttatgggcagtgtttcttttggcggagggcatatttcacattttttgtgaagggtatgatagctatgcgtttcctgtcatctgttctacgcagagcaggacaacaaaggggaagtagatgagtcacagggtcattaattaagaaggcaggagggttttgtccctgctgttctttaattctctctggtcattgtacagaataagaaaaataagaaagtgagttaatctacaatctgaggaataaaaggcacatgactcagatcccagtcacagctctctcaaggctgaagtgtgtcgggggttctgacagattttaaattatattttcatgcatgtttaattagccaagattgtcaatggaaccaaatattcagttgtatcattttaataattttataataatttttaaagtttttttttctttttgagacagagtctcgctctgtcgcccaggctggagtgcagtggtgcaatctccgctcactgaaacctctgcctcccggattcaagtgactctcctgcctcagcctcccaagtagctgggattacagtcatgtgccaccatgcccagctaatttttgtatttttagtagagacagagtttcaccatattggccaggctggtcttgaactcctgacctcaggtgatccacctgcctcggcctcccaaactgctgggattacaggcatgagccaccatgcctggcccactaaagttgttatattttaaaagaatacttttcctaaattttttcttaaatttttaatcgtggtaaaatatacataccatacaatgtgccatgtaagctatttgtaagtgttcagttcagcagagtgttaggtacgttcacattgttaaatgcagccaatctccaagactcttttcatcttgcaaaactagaattctacgcccactaaacgacaatttgccattcccctctctcttcagcccccagggcaacctcctttctactttctgtccctgtgaatctgactattgtaggtacctcattgaagtggaatcatataggccaggcacagtggctcatgcctgtaatcccagcactttgggaggctgaggtgggaggattgcttgagcctaggagttcaagaccagcctgggcaacatagtgagaccccatctctagcaaataaaagaaaaaagtggaatttgtccttaagagaagatttttaacttgaactcaaagctaaagtgggattgttgaatttgaaatgacagtaagtggaataataatttttgaaaaccaaaggagatcctttttttttttttttttgagacagggtctcactctgtcacccaggctggagtgcagtggccgacctcggctcactgcaacctctacctcccaggctcaagcaatcttcccacctcagcctccggagtagctgggaccacaggcacacgccaacacgcctggctaatttttttgcatttttggtagagacggggtttcaccatattgcccacgctggcctccaactcctgagctcaagcgatctgcctgcctccgcctcgacctcccaaaatagtgagattacagacataagccaccgtacccagcctactatcttttttttttttttttttgagacagagtctcgctctgttgcccaggctggagtgcagtggcacgatcttggctcactgcaggctcccgggttcacaccattctcctgcctcagcctccctagtagctgggactaccggcgcccgccaccacgctcagctaatttttttttgtatttttagtagagacggggtttcaccgtgttagccaggatggtctcgatctcctgacctcatgatccgcccacctcggcctcccaaagtgctgggattacaggcgtgagccactgcgcccagcctattatcttgtttaaacctcacaaccacctgggaaggaggtgccatgattaacccccatttcacagatgagaaaactgagactcaagtgagatgacttgtccaaggtctcctaagccaggaagggctaggatgtcaatccaggtggactgattctcgagatggaaaatgtgaccacatcatggggtatggcagaaatgattatagcgccttcttccaatgtggttgtaaatgactgcgtgatgttcttcctacacaagggtgtgtgtgtgtgcatgtgtgtgcatgcgtgcgtgtgtgtgtgcacgtgtatgtgcgtgtgtgcatgttgtgtgtgtgcatgtgtttgtgagcatccgtgcatgttttttgctcctgctaggttgctcataaggatggacctgtgtccccactcccacccgcacagcacctgactctgtgatttgtttatcaagtgatttttaaaacgaatcaacgacccaggctcacaggacaaaggcactgaggtaacaggacaggcctgaaggatgagacacaaaagacctccctcttttaccaactggctctgcgcccttcggccggtcactgcccctctctgggcccctctcatccttctctgagcttcagtcgcccctttgtccagcgagaagttcccactctaagggacctgccactgacctcacacaaaggtggcccctgaattctgacccaaaccaccaggaaaaagagggtcccaaaagctaaaggaaggtgctgagcagggtgggacagaggcggaggcattctgatctctcgggctcaggccggccagcgccgcctccctgcttccaagatggggatctggcgccaccttgtggtctccgcctcttgcggccttcgcgtgttccctgttttaactcttgctattaaccccactgctgccctctgggaactctgaagcaattccactctcttcaccaaatatttatctactgtgcccagctgtacccaggctcgacccagaaaaatcatgaacaagtccctgcctaaccatttagaggcgtctggatctgcaccacccatagaaaaatgatgcaaaccagccgggcgtagtggctcacgcctgtaatcccagcactttggaaggccgaggtgggcagattacttgaggtcaggagttcgagaccagcctggccaacatggtgaaaccctgtctctactaaaaatacaaaaatcagccgggcatggtggcgcgtgcctgtggtcccagctactccagaggctgaggcatgagaatcacttaaacccaggaggcggaggttgcagtgagaaaagctcatgccactgcattccagcctgggtgacagggcaagactctgtctcaaaaaaaaaaaaaaaaaaaaggaagaaagaaaaataaaaatgatggcaaccacaaatgtgtgcctcacaggtaaccacattttctagtagccacatttttaaaagctgaaataaataggtacaattaactttaacaatacgtctttgggctttttgatgtttgtttgtttgagacagagtcttgctctgtcgccccagctggcatgcagtggcacggtcactgctcacttgcagcctcaacctcgtgggctcaagagattcccccaaccttggcctcccaagtagctgggagtacagggggtgcatcaccatgcctggctaatttttaaatttttttgtagagacagggtcttgctatgttgcccaggctcatctcaaactcctgaatgttagtgatcctccctcctcagcctcccaaagtgttgggattacaggcttgagccaccacatccagctaataatacatttgcatttaatgaaatacattcaccatattatcattccaacatggagtcaattatttttaaaattaccatctttttctccttgtaactccttgaaatctgtattttacaccaggggtccccaacccccaggctatggaccattaccagtctgtggtctgttgggaaccaggcacaccgcaggaggtgagcattgggctagcaagggaagttttgtctttagattcccataggagcacaaatgctattgtgaactgcgcaggtgagagatctaggctgtgagctcctgatgagaatctaatgcctgatgacctgtcactgtctcccatcacccccagatgggaccatctagttgcaggaaaacaagctcagggcccccactgattctacattacggtgaattgtaaaattgtttccttatgtattacaatgtgatgatagaaataaagtgcacaagaaatgtaatgcgcttgaatcatcccgaaaccatccccacccccatccatggaaagcctgtcttccacaaaacaggtccctggtgccaaaaaggttggggaccactgttttacacctacagcatgtgtcagttcagattagccacataaaccttgtctggcagtggctacatgttggaaagcatgggtctaggacctcccaggcttactctggccccctggcagcccctcagacaactggcttattacatcttctccagaattcacctttctagctttgcttcactgactaagggtagaaccctggcccggacaagtcatcttacccttggatgtataaaataagggtaagaaaaatacttacttctggggttgtagcaaggattcaatgggataacatacacacagtgcttagcgcaggtgcctggcagggaataaatgctccataaatggtgacctaatgaatgaaagccttagcccatctttcagcatggtgatggttaattttctgtgtcgatttggccaggctatggcaccccatcatccagtcaaacatcagtctggatgttgctgtgaagatatttttcagatgtgatcaacgtttaaatcagtagactttgagtaaagtagattgcactccaaaatgtgggtgggcctcatccaatcagttgaaggccttaacaacaaagactgaggtttcccaaagaggaggcaattcagcctccagaatgcaacatagaaaccgtgctgtttccaacctgtagatttcagactcaagaccgcaacatcaattcttctcccatttctgactggccagctctacaaatttcaggcttgtcagcccccacaaccatgtgagccaatttcttaaaataaatctctctctctgcatatataaatgtacccccgagtggggtacagccacagcagcacgcagaagagacatgacttcctcattctgaactcacgcagtattagaacaatggagcaccccagcccttccccgcctctgagcacgatgtctctcaggaccgagagctgaggcagaggctgaatcaacgcccccatcccagagactcttctcaagggagtgagaccaaagggtgggctttgccaggggaaagggaatgtgacggggccaggcagggccagggttatggggatctgctcttgagggtatgactgcaggtccccatggtgcagagtcaggggttggggcgatccctggccacagaaggattgctttggggatccatggcccagaccccgacctcttcctttctctggtctcctgccagaattcctgtcaaatttagctgcctacagcagccagagtgattttcctaaagtgtacatcgtgccgttgacaccttccaaagtccttcccaggcttcccccatgaccccataaagataaagccccaaagccttttccacgacttacaatgctctgtgtgacctggccacagccagcccagcctctcacattgtggaagctttgaagtatgttatcaaacagcatgtagtcagaagcccatgtttacaaaaacttaaaataactatatacgcataggaaataactaccgtctactggaacttgggtctgtgccaggccacgatgtgcagtaccttactggatatcatcttgttattccttgttccttataacaattcctagtatctcctttatagaagaagaaactgaggcccagagaggcccccagctagtgaggggcagagccagacttgaccccaggtccaccaagaccaaagtccatgctcttcactgcaggctggttggtgcctctgtgcagatggaagataataatagctctcacctcacagggctgtcgtgaggattaaacaggctgagatgtgtgtgtgaatgggctctgaacagctcctggcatggcgcaagggctcaggaagtatgctgccccacagcagcctgtgggcagcccggccagatcatactcatagattcagactgatctctggtactagggtcatgggtgatcatattttttttaacttttccacaatgaccaggtaatacttgtgcatttttttctttctttttaaattattgtatgtatagtgctctcagtaagctgtctgtttcctcaaagcaggcttgtcgaagtttgagtggcctccctggttcccccaaggcctggcccggagaccccacacccagtggaggaacctaacagaaaacagctcagaagagcccctcttagcccaggcaccctgcccacaggcttggcaggggcgcttgctggaggggtgggtgcgggtctgtgccaggaactggcctaagctaagtccccaaaagacaccgtgagatgctttgtggctcttccggatcccaggggagaggtgggagcagccgtgatgcatgcgacctccggccctgaatccaccaacagctgtgactacttcagctattttaaacctctgggcaccaggaaactcctgtctcatcaaccaggctctgggcccaacatgatggcctgagcccgggcaggagtcctgagtgtgggtggccaggtctgaattgggtttttaaggggagggggcttcatttcttgagccttgtgccaggctctgtgctagtattttctgcaccttgttgtctcgtttaataccgtccttacaccgtgctgagggatcagttacttcacagaggcagaaaatggggctccgaatggcagggtacctggcccaaggcggcacaaaagcagagctgggcctagaactgcgacttccttatctacaaagcatggacagcattctgcccctgccctcactcggccttgccccctgcctccaccccagtggccctgcaagctcctccctctgccactcttaggagctctgcaacccagagtcaattcccccacctcctcacagctcactttcttcatctgtaaagtggcggagttactgggagggttcagtgatctaactctaatacatgaaaagagccgcttggaacagtgcctgacccacagaaagaaagcagtaagtgcccgctcttactccagctcccctgggtattgcggtctgatgttatcactatcttgcccagtgtcctgttatgagctgcccggggtctccgtcagtggggggtacagtgtcctcccccactctggccccagtctccccatgagtcaaatgaaagttagagccccaggaaggtgagaaccctggtgggtgcccgttatctgtcacacagtaagggctccaaagtcactcgtggcagaggggtgcccagacacgagctcacctctgggggcgcctcgaagtctctccaagctacacaagttttgtcccagtttggcaggtggccacccgagagattcctcctgattggaggatgtgctcagccgggtgcctggagttcatcagaagttactggcctcggccgggcgctgtggctcacgcctgtaatcctagcactttgggaggccgaggcaggtagatcacctgagatcaggagttcaaaaccagcctggccaacatggagaaaccccgtctctactaaaaatacaaaattagctgggtgtggtggtgcctgcctgtaatcccagctacttgggaggctgaggcaggagaatcaattaaacctgggaggcggaggttgcaatgagctgagatggcgccattgtactccagcctgggtaacaagaggaaaactctgtctcaaaaaaaaaaaaaaaaaaacagttactggcctctccctgggtctgtgagctgtgcctttgggggacaaatgacctcctggctaaaactcgggccttccctcttccccactcacattcctcccaaatccctgccactcagaagcagctgggctcttcaccacctcctaatttgggccgcctcagggagaaggttggagtccaagggctgggtatatcagcactgggcacttgtgggcctcacccctcttgtctgggggcacccgttcctggagctccatcttccatcagctctaactccttcccaaacacacatcccctccgccccactccttccctcccacggcctctgcccaccccccctcagtttctgtcctcacctaccaaagaccacttcctcacacagggctgatgtatgtgtctgaacagcactcccactgggtcccaggggaagggctgggacatgggaggggctggccgaggcccacactgattgtcatcctacatctcagcctctgtgagacacacgatgacctctgggtggcaccccccttcccttggtggcccaggccagaaccggggccctaatccttacccctctcctctccctccacccacacatcctatcagtcaccaggtgccaccaaaatcccagtccctaagcagtggccgggtcagtccccacctctccagctctggccacagccaggggcttccttgcccctccccagcccagaatgacccatttcacgagcacacccgaccacggctcgcggagacaaccactccaggctcccatctcccaccctccaatgccttggcttggcgtcctggtctccctcagctgccgggttccccatccccaccgcttcccgttttctctatggtgaggttcatctgactgttgggggatgggggtaccgggctgcacccggctttgcacaggcagctccctctcctcgcctttaatttgcaaacgcctcctttaagaaggttccaggatcgtcttctctgggaaggcttcctggcccccaggctgggttagggcaccctctttgtgttcccacatttgcattttcagccccactgggctggggcgtccggaggggagctagggccctccaacacctgggcgcccaccgaaggtttgtcgaatgaaagaatgacaatccaaccatggaaagcacaaaactggtccctgatgacttcgccacgacctcagcggggcgggacgagttaggggcgggaccacgcttgacggacaggcccgcagcccactgcgagaggactggggcgggccgccccgcccaccggccgctggataaggctgcgcgcggggccgtggggcgcaggctgctggagaaggcgcacctgctgcaggtgctcccggccgccccggaccagcgagcgcgggcactgcggcggggaggatgctgcgcgagcggaccgtgcggctgcagtacgggagccgcgtggaggcggtgtacgtgctgggcacctacctctggaccgatgtctacaggtgagccggcccaccgtgatgcccgggccgagatctcgagcccagaaatcctgagacgcgctcagactcggggacgtggacagcctttgtccagcccgagttgtccctcatcccgagcccccgagcccagaaatcctaagaatctcatccagaaacctgacaacccccgaaccttgtgtccaccttccagaaaccctgagactctcccagaccccctaacacagcctcagccccagctccctcacagaccctccctttcacccgtaaccctccgtctggccctctccagttctcctcccgggggacctcacaccccttcagcttccctgccgtcctctcccctttcacttcccctccgcacctcacttcccctcggacccacctcaacccagcccctctcctgcttcccactcccagttcagcggagcttccgcggagacttgccggggactggggcaggacccgaagggagctgccctgaggctgaatccggccctggaggttactcaggctccgatttcgccctgtgggggctgctggtggttgcttgtccccaggcactggccctgagctccgtgtccccagataccttcccctgacttcattctgagaccacagagggacaatattctacccagctgacgacggggacttggggtgtatagcggggtactttgttggaaaaggatcctaattcagagttctgctccctccccttctctctgtccaagaacttggtagagtgcgggatgtccgagacagctgaaggtagggtagggccctaccactccccccgcaatcccagaaagcagccaagtccaatgatctgtctccctgagtaatgggacggggccttggaaaggtgtggctggtgtgaatgaaagggtggggttatgctggggtttgatctgccccctctattccaagcatttaaaacctccccattgctagggttggaggggtcagtgctgggggcagggagcatgcaggactctgaggtgggaccctgtgctgacaccggatgagtcccctatcctctctgcctcaagctgaactcacacggaggcaccatcgtggtttatggctctcaaatcatcctgacacctggagcaccctgcctctcccaggcccccaccaacccatcatgtgtctccccacacagccctggcagccctcccacctgcccaaccagtctcctgccaccgctgcagaggcactggccacgctgataccaacaagccccaggactagggacccactccatgcctctgtccctggcctcaacctctgcctttccctgggcctgggcttcagttgtcccccatgtaaacctcagaggtggactgggtggtctctgagaacaagaacacagcagtggagggtggtccaggctctggtggggtgcaagagctcccctgccttccccacccccagccctgaactgggcaccgctagggagtgggcgcggagccagagtgctcaggtctctaagcctcagctgtcaccatacccacctgtttatttgctggggcatggttggtgccgcctgaaaagctggcatgatcctcccagtcgggggtggggagcaaaggagggttcctgctcaggcgccctgctatcgctctatcctggcaaagagaggcccagctggggtaggggcacagagtggggcagatatggactcagcctccctctagcagggggcagcagtgtgacgattccccttgtcctgtctcaacgaccacaaagaccctaacccccaccggcacttaaggttctccaccaccacagagaggggcagtgcgctctagaccagtactgtccagaaaagtccagtttgaaccacaacaaaaccacaattgcattttaaatcttctagtagtccacacttttttaaagttaaaacaacaggcataattttaataatatattttgtttaacccaatattttagaatattatcatttcaacatgcaatcaatataaaaattattaaggaaatggtttaccttccttttttcatgctaagtctttgtaatccagtgcacattttacacttcagcacatctcagcgtagattgagtgcatctcaggtgctcactggccaccgtgagccagtgacaccgggacagaacaggtctagtgcagagtttctcaatctcgcactattgcattttgggctcgatatttctttgttgtagcgggatgtttagtggcatccctgacctctgtcccctagatgccagtagcaacccccaaattgtgacaaccaaaaatgttgccagacagtgccagcagtcccctggcagggggcaaaatcacagccagctgagactcactggtccagtggaaggaagcctcttccaggactaaggagcttgagttgttactgctattgtgactcgagttacctgtagtaatgagagcaactgccagtattgataacaggaggaggtattagtgggcacttaggaactgaacccaccacctcctttcttcctcaccatagaccctggagggttcattgatcatcccattttacagatgaggaaggtaaggctcagagagatgaagccatttgtccagagtcacacaggactcaggtccaggtctgtttgactcagaactcatgctcttataccccactctgtcctatgtgaccctaaaaccagcgggttgaactggacggccctctcagcctgtgtctcttccaccctggccacgagcccactgtccccagagacttcaccaactcccatttggccctccactcttccctgagtcctttgctgcccggacacaggtcctggctcaagaccccaagtgatgcccccagagcctccaagtagaccccaaggaacaaggcccgggggtgctgggcccagttaattacggagtggcatcctgaccctcactccttctgagtcgcaaaggtgagcgaaacggcctcagcacccactccctttcccaagggctctggactccctttcctgtgatgctggcacacaggatcccctccagacacatagcaggggcctccccagcctcattcctcaatagaccttgtggtcctggcaggcactgccctaccagcttccatccacgggctgtgtgaccttgagcaaatcgcttcacttctctgagtctccactgacccaaatgggggtcgatcagagaacaggaggaaggatcttgtattcaatagaagatgtacactcagggtcacagtgatgaacaattgaccactatgctgccctatgaggggtcatccaggccaccatgggcaggggtgctctgggccacccacgctctcccagcaaaactggcccccctggggatggatgccttgacctagcctcattctgactgctagtctccagcaagcaatgaatagatacatagaaagaaggaagtagggtgtttgttagaaattgtactttgtgattgttgttaaagatactcgctgtttccttctgctcttcccaaatatactcatcttagtcttggcacaggtacacctggcccacacaatctcctccggtggtccctttagccgacagtcacttcttcagtggggctggcctgggtccccatctgatttgggcttgaagttggaaagagagcacagagggagtccctaggttggttccatcctggccacccacctcttgtgagccctggaggcatggacactcccagagtctggaaggattattagggacagggcagcctcggagtaaagtaggtagcagggtggtcactctctgcccacaagctgggccttgggaatggcttcttctgttcctccctcggcttatgcctctgtcagtgagagttctcgagaaggcagggctcttcttttcctccctggtgtacaggagccaggatccagatcctgaggtctgcaggagcttcaggacactggaatgatcttaacattgtccctttgcctgtgcagaggttccagctgcgtctgtgaggtggaggtgggaggattcccttccctgggattccccaaggcagaggctgaccagccattgtcccagtagaagacagaaagaagataaatgtcagctagtaatatcaagtaaatagtaataatttgcccataactcgctggcagaagataggaagaaggtatcaggcaggcgctcctagactttggcacaaactcactcccagactttctgtctcttggttggtgtgaaggctagagatgtatttgcttttttaaaaagtgtcattaggacaaaggccaggagggtctgagatccagttttccatgatgggggcctggggtgctatgggctcccctccccatagtgtgccaggccctacctcactgatctcctcttctagcaattcctcagcacacactccattccggccacgctggctttgtggatgctgttagcccttggctgtgccaagctcattcccacctcagggcctttgcagttgctgttccctctgcctggaacaccatcccccagatccccacaagcctgactttcatcagtcaagtctcagctccaatgtcacctcctccaggaagctttctttgactaccccatgtcgtggtgccctaccctgagtcccgagaactctgtttcatcacatttttttctttgcacaacttctcatcgtttcttaatgttactagttgacatttattgaacacttattttgtgcaggcttctcaacactttgcatgctcatctcacggacatgtaataatttacgtatttaaaccttgcaacaactttatgagttaggtacaattattgtccccttttcgcagctggggaaactgaaggaaggagtgtttgtccaggatggcacagccagtaaactgtggggtgcagagcccaggcccctgcctgctctgccaggctgccctcctggtacttatgtttcaggcttgcctcctccttgtttgtgatcctccctggagtcaatgaagggctccctgaatgaatgaatgaatgaacgaatgaatgaatgaatgtggcctgtgatgcctgtggactggcctgtcatggggctgagctccccacccccagcctcaagggacaggcaccgttggatgggcctgtggaaggtcaagggcatgtggccaagcttggcccgagcagcgcttgctcctgagagaatgacggtgggaggaattcaggccaggtcaggtggcccataaattagaacagcacccagagccctcaaccccaaacgggatgccttgccaggaattgctccagggctctggtttcaggctagtttcctggggttgggagtgttctaaggagaaccaggctcacagtccctgcatagttggggtccctgagaccttccctcattgactgcagggccctgagttgggatgggagcacagtggcaggggctcaccccagtgcccacccctagctggccagacatacctgctgcactttggaggaggcagcttttgaaggcagctctttcctgcccagccacgccagaccttgcacccagaggctttgatgggcccaggcttgcttctctctgtcattgacccaagagcccaggacaggaagccagtctttagtgtcccttctctgtgtctcagactcccacctgtgaaataagtaaggggctctcatttggtcctcttcagagccaggcctgatcctcccctctgccccacaccaggcacacctacctgggggatctcaggaaagactccagactttgaattctctcccagggaggggacagccaggcccaggtctcagagagcctgagttcccctcacactcggccatgactgtccctgagacttgaagcgggtgcttgccctctaggggcctcaatgtgctcatctgtaaaatgaaatcacagtggtatgggcctcatggggttatcgaaagaatgggctgaggtcatgtgggccatgggcttggtacagtgcctgagacataatgaatactcagttccctggtggtctagtggttagaaaaataataataataataataataataatagtaaatactcagtaagttgttatgtattagtattgagtttattttgaaaacaagtaataatgagacctgatccctctcctcaaagacttcatagcacttatgggaaagaaatctagaactgaatttattaagtgttgtttgagacaccaataaatggagggagagatatattctggctgatgagatcagggatgacttcctggaagaggtggcaactgagctgggtcttgaaggatggactggggttcagagtgagaccaagaacatgccactcaggggcagagataactggcagggaagttggggcacacagagacagaaagggcacagcttcagaggcctggagtataaggctggagggtcaatgagctctaaccaggctttgaatgcattgttcagacattggactttgttctgtaagtagcagggagtcactgaaggtttctgaggagaggagtagctatagatcagattgtttcttccctaaggagaggcccgggacagctggatgcaccaggtggtgagggaagctggctgaaggcagacgtcatggtttgcctccactgatccctgttcagggcagctgcccacccacagggccccagccaccaccatgccgagcaccaggtgtgaggtctggactgaggtcattctccccgctggtccttgcctgcctcttgctcgccatggggttgcatgacaggctggcacccacgactccccccccagactcctctaaagccccaagagcaggatgtcacacccaggctgccaggagctggggtcactctggggatgagccccagctggtgttaatgaggcccaggccaggcgggcaagctaagaaagccagatgccagcaaggagcaggcgcttcatgccctcaagtctggggctggtgagccaccccagccctgcaaggccaagccagtgaccctccccactgaccgagccaagaccagagaggaccatggctcctagagaccacaaagcatttgtgggactgggcaagtgtcgtttgtttgacaccaacctagtggccatttctctccatttccacagccactatctggtcccaagacaccataatcgctcacgtgggcagctgcagccacctcctccccacttcctctgttgctttcctgaaatccatcccccaccctgcattctgggcaaccctgcaccctggatgatctatctacagtgcaaaactgatcatgccacccctgcttagaaaccttcagtgacttccctctacaatcagaggaaggccagctcctcaccattatctaaaatccctgctcccaccactctccctcccccttgctcacaaactccagacacactcccctctttccagcttctcgaacatgcaggactaacccccacctcaggccatcacgcaagctgtcctgttgcttggaaatctctgctcctcttcctctccttccttgtccaactcagtggttgtcaaactgtgggggaccagcagcatcaacattacctgggagcttgttagaaatgcagtttctcaggtcccaccccacagtcgatagatcagaaactcaggggctgggcccatttacctgtattttagtaggccctgtaggtagtggtaatgcacactcaaatttaagaatctctggtttaattttttttttttacagtcagcactgcaatggtgtaattaattcctgcctgtcctttagattataaagtttaaaccttagttcaaatgccacttcctcagggaatccctccttgaaccccagactggggcctcatggcaccctctcctcctttatagtaattatcacagctgtaatcatgtaatccattgaaagtctgtcttttctggccaggcacagtagctcacacctgtaatcccagcactttgggaggctgaggcgggcagatcacttgaagtcaggagtcccaaaccagcctggacaacatggtgaaaccccgtctctactaaaaaatacaaaaattaaaaatagccaggcgtggtggtgggctcctataatcccggctactcaggaggctgaggcaggagaatcgcttgaacccaggaggtagagattgcagtgagccaagatcatgccactgcactccagcctgggcaacagaggaagactccgtcccaaaaaaaaaaaaaaaaaaaaaaaggtctgtcttttccatgggcccagggaatgtgtttgctttttcactaatctacccctcaatgcctagaactgtgcctggcacattgtaagtgctcagtaaatacatgttgagtgaatgaacgaccatataagtaagcccgcctcctccagccctcctgcagcaaacatttatacttacggtgtgcccatactaggccaggtgctgaaacaaacaaacaaacaaacaagaagatccaatccctaccttgaaggagtgaactgccaaaagggccagtaactgtgggggcaaatggatggagttaggtcttcaaggagagatggacatttgccaggcagagaagtcaggggaaagtcttgctggtaaaaggaacaacatatgtcaaaatgcacagtagatggaacaatgcagggagctgaagtggtggaaggaaccgcagaaaatgaaaccagagagtcaagctgagttgcaatggccaaatgtgcctagttcaacaccaggatgaagagtttggatattcttgtatgggtaggcactgaggagccagtgaatattttcaagaaagcccatgacctgatttctgggttttttttgtttgttcgtttgttttttaaatcacttgtgtaatacagcttggaaagccaagaagggcaggtgcattcattcatgtattgccaaagactacactgagcatatccatgtcctgggttctgggattccatggtaggcaggagacatggccacagtgattggcagcctgtccctccatccatgctctccttagcctctctctaataagcaagaaggtcataaccacccccaagccccctccctttccctcaatactgtcctgggcccctccctgcagcctccagggacaatccaggtgcctgaagcccctggctctcgggtttctgcgagagagattctaaagggttcttcctgaggaggaaggcagccaacaggatctgcaggggcacaatgggcccctttattgctttgcccagggccactccaagaatagctgtttgctcagctcagaacagggctggtgctggggaataggagggtgtggggccctggagctgcgatgtgggctgggcgttaaccctctggagcctctgaggcctcctttggtttctctctggtccagaggaatgaaggtgggcaggaagcatcacttacagtaactgagtcagggtcctaaaagatcatcttgtaaaacattttttcctaaatagaattgtgtgcagaagctcaatatataaaaccagatgaaataatagtggctctgggtcaggcatggtggctcactcctgtaatcccagcactttgggaggccaaggcgaacggatcacttgaggtcagaaattcaagaccagccaggccaacacagtgcaaccccatctctactaaaaatacaaaatttagccaggcatggtggtgcatgcctgtagtcccaactacttgggaggctgaggcaggagaatcacttgaacctaggatgcggaggttgcagtgagcagagatagcaccactgcactccagcctggatgacagagcacgactctcagtttaagaaaataaataaataaacaatagtagtagtagtggctctggttaaggtggggaggggagtggcaggaatccagtggagatatcccaagctttttttttttttttttttttttttttaatagacagagtctcgctctgtcacccaggctggagttcagtggcacaatctcaactcactgcaacctccacctcccaggttcaagtgattctcctgcctcagcctcccgagtagctgggactacaggcacacgccactacgctcggctaatttttgtattttttttagtagagatagggttttgccatgttggccaggctggtcttgaacttctgacctcaagtgatccacccacctcagcctcccaaagtgctggggttacaggtgtgagccaccgcacccagccatccccagctttccagagccttcctcctcacccctttgcccagggcctctcctctgcactctctggactcagccacctctgctctggttccatcctctcacctaacactggatgaaactgagagagggaaagtccctggcccaaggccacccagcatgttgatgggcaaagctgagacttgcaggagaggaatgcttcccagacctgaggccatagtttcccagactctcatggctttggccaaaaccatcttcaacctgtctcactataacacttttctttaacccagctcacatttttcttaataactttattttaaacagagattttatagcattaccataaatggcaagactttatcagtcaccataaaaagatactgtgtttgataaacacataagtcttcttgtagattgttcctccctgtgccacctaaagcatccagggtgtgtactcacacctctccttgggaacggcttaccttccgtccgactcacctctgccctctttgcttgggtgtatgatgggccaagccctgtgctaggctctgaagaatgaagatgggagaggccggaccatgccctcaggggacttataacccaaaggagggcaggtaccacgtggcaacaccactcagcaaaacgtggccccagccctagggggagtgagagacgagagctatgggcaggagggtggcagtcctcctgaggcgtagggactaacagatggacattcagaaggtgcagaccccctcaagtcaggggcaaaactagactcaaacccaggtcctctgcacgtgcacccttagtccagggcttttgtccagactctgtgcccctcttaatgatggatgtggccaggcacggtggctcacgcctgtaatcccaacactttgggaggccgaggcgggtggatcacctgaggtcaggagttcgagaccagcctggccaacatggtgaaaccccaactctactaaaaatacaaaaattagccgggcatggtggcgggcacctgtaatcccagctactccagaggctgaggcaggagaatctcttgaaccaaggagacagagtttgcaataagctgagatcacgccactacactctagcctgagtgacagagagagactcctcctcaaaaaaaaaaaaaaaaagtgatggatgcggagaggggacagcaagccatgaccaagaagtgtccagtctcacatcatcccaggacaggctgtggagtttggaagggggcaggacaagaaccagagtgaccttggggtgtcttcattgagctcctctcccagcactggccacaggctgccgagtccttcccaattctcctgccagagcccaagaccagtagtctttgcccatagcccctgaagtctgtggcccaggtcagacagacactgcccggcagcctctacagattcacgctcacggccttggccagcccagggctctcagcagtggaccacagtgctgattgtctggaccagtggttctcaaagtgtggtactgggaccggcagcatcaacagttcctggaagcatgttagaaatgcagattcttgggccccatgccagacctcctgaattggatgctctgagatggggccccgcagtctgttttgacaagacctccaggtgccgccgccccagacactgctgctgcactttgacagccgctggcctacacttgtcattcaaccctggccactgtttccatcttcagctgccccagcaccctcagcctctgccatgccagccagcctctccagagactggatctacaaatctacagccttcaaagaaaaacaccctatagatttaaacagcacccctgatgattctgatgcctgccatagttgagaactcctggaacccaagagcaccaggcccccaaaatagcagctgtgcctttgagacaggcttacacctatgtcttagtcacaaatcccacgagaatcccacctaagtccctctgagccctcttgggcctccagaccagtggctggatttagcaaagccgccagccctaggcaccttcctcccttagtcccctgtccttcctgtcacctctccttaagccaacaccaaaacaccatggacagggtggcttaaaaacaaattcatcttctcacaattctggaggctggaagtccgagatcagggtggtggcatggtcggggttctggtgacggctttcttcctggcctgcaaatggccaccttgtcactgcgtcctcacaagatctttcctcagtccatggagagagatctctatctacctatcccctccctctcttgctgctcctcctcctcctcctcctcctctctcatctttcttctcctatttgattagaagcctgcccttggccagggtggctcacgcctgtaatcccagcactttgggaggctgaggtgggtggatcacctgaggtcaggagttcgagcccagcctggccaacatggcgaaaccccgtctctactaaaaatacaaaaattagctgggtgtggtggtgtgcacctgtaatcccagctactcagaaggctgaggtaggagaacagcttgaacccgggaggcagaggttgcaatgagctgagattgcaccactgcactccagcctgggagacagtgagactccatctcaaaaaaaaaaaaaagaagaagaaaaagaagcctgcccctatgacctcacctaaccttaattacctcctaaaagctctatctccaaataccatgacactgagggtgaaggcttcagcatgctaatttggggagagacaaacattcagtacacagcagccagatcacatccatttgttctcctgctctgaaatactttcggagttcttgaattttggaattcaagaattccaaaagtatttgctttgcaatggaaaaccacttttgaaccccaagaaatgactcagaaggtgggggatgtcaggtggcaagaaagctgtggcaggaaggaagggatctttgtaacaagagacaccccacctctgccctgttaggacccaggcactgggctccatccctgtgaggactcagcactttactcagcgaccctgggcagggagacagggttccaggcccagctctgctagtggagcaaattcattcctgcctgggtctccatcttccaccttcacaggaccctgtggctcccaaaactggcctcccatcagaggcactaggaagcttgttaagaattcagatccccaggcccgaccctcatacattcacactcaggaggtgcaagattggcccaagagatttcatgttcaacagatgtcctcttcacagccaggtgactgcaatgcagctggcccctttggggtctcccagatcagattacctgtgggggcccttgcagacttgcccctccagaagtcttcttttttgaaaaaagagccgggcgtggtggctcacacctgtaatcccagcactttgggaggccgaggcaggcggatcacctgaggtcgggagttcaaaaccaacctgaccaacatggagaaaccccatctctactaaaaacacaaaattagccagctgtggtggtgcatgcctgtatcccagctattcagaaggctgaggcaggagaatcgcttgaacctgggaggcagaggttgcagtgagccgagattgtgccattgcactccagcctgggcaacaagagtgaaactctgcctcacacacacacacacaaaaaagaagagacagggtcttgctctgttgctcaggctggagtgcagtggcacaatcatagctcactgcagcctcaacctcccaggcttaagcaattctcccacctcagtctcctaagtagttgggaccacaggtgtgcaccagcatgcccagctaattttttaatgtatataaagacaaggtctcactgttgtccaggctggtctcaaactcctgggctcaagtgattctcgggctttgacctcccaaagtgctggaagcaggagtctcctctcgaagcccctcatcccacctaccccagggctctccctaaccctctctcatctctccccacagcgcggccccagccggggcccaaaccttcagcctgaagcactcggaacacgtgtgggtggaggtggtgcgtgatggggaggctgaggaggtggccaccaatggcaagcagcgctggcttctctcgcccagcaccaccctgcgggtcaccatgagccaggcgagcaccgaggccagcagtgacaaggtaccacggcgggaagtccagcctctgcgggcccgggaccatgccaggatagaggcagggtggaccagccctgtcccatagaaactgcacgtgggacatgtgtcattttcagttctgcagtaaccacattgaaaaggcaaaaagaggccgggcgcagtagctcaagcctgtaatcccagcactttgggaggccgaggcgggtggatcacaaggtcaggagatcgagaccatcctggctaacacggtgaaaccccgtctctactaaaaatacaaaagattagccaggcatggggcgggtgcctgtagacccagctacttgggaggctgaggcaggagaatggcgtgaacccgggaggcggagcttgcagtgagccgagatcacaccactgcactccagcctgggcgacagagcgagactccgtctcaaaaaaaaaaaaaaaaaaaaagaaaaggcaaaaagaaacaggtgaaattaattgtcttaatatctattacttaaccctatctatcaaaatattatcattttgacatgctatcaatataaaaaatattaacaaaattgtttgttttttgtttgtttgtttgtttgagacggagtctccctctgtcacccaggctggagtgcagtgatgcgatctcggctcactgcaagctccacctcccaggttcacaccattctcctgcctcagcctccagagtagctgggactacagacgcctgccctatgcctagctaatttttttttttttttgtatttttagtagagatggggtttcaccgtgttagccaggatgctgtcgatctcctgaccttgtgatccgcccaccttggcctcccaaagtgctgggattacaggcgtgagccaccgcggccggcctgtttgtttgtttttaagagacaggatctcactctgactcccaggctggagtgcagtggtgcgatcatagctcactgcaacctcaagctactgggttcaagcagtcctcctgccccagcctcccgagtagctgggactccaggcacctgccatcgtgcccagctaatttttttttttttttttttttagagacaggtcttactatattgcccaggctggtagtttatattctttttccataccaaatttaaaattagtgtgagttttacaccttataacacacctccgttcagaatagccgcatttccagtgctcggtagccatgtggatgttgtggggttagaccatggaacgatggcttcgtaaaggatgaaaattatagacagctgagtgatagaaagtttagaggctcagaaccatagaatcattggagcttacagtcacaagtgtccttggtctatctgtaaaatggggtgctgaacatccatgggtgatttgcctaagtggtgaggctgagaccagaactgtctcctttctgggttccgtaattatgaactttaccatgtgccccatcacagtgatggcattgaacatggtccaaagaaaatagcctcagccctgtcccctcagtgggcactagacgtgcaacatggcagatatgggggaccccaggcagcagaatgcacacagtggcacaggaaggcagacagcatcctaactgccctctcagccagcaggaggggagtccacagtctagttcagttacctgagggaaaccgcccaccaacccaggagttcttcctggaggagagggttctgatgtttggagagggttggcttgacaagctgtgagggacagcagttgcttcaggttttcctgcttgtgatctgtgatctctgctctcttttctctctactccaatgtgccccctccccaccaaggtcaccgtcaactactatgacgaggaagggagcattcccatcgaccaggcggggctcttcctcacagccattggtgagttggcatggttgccgtctcagtgccttcatcacccagggcctggcactgttgtccttctctggggcacttaggcggttctcagtgcggctgacctggcacttggagcttcttctgaatggcacaggcctggggagggatgtcacatgtgccccaccccggtccttccatactggggtgggggcttatctgcaggaagaggcactccctgatccatcagcaaccccccccccccaagtgtcaaggtccccttcccaggctctgtggccctaaaagagaaaaaggtgaagtgtgttcccccctgcctctcccctgcagcctggagaagagtgtccctctcatggtgaggggaatggccacagtctataaaactagcagctgttcttgacaatcccagctgccccctggttctccccagattcagccccgagggtgcagagatgcagcctccaggtccttaactcacctagtccaagtccttcatttgatccacaggatggtgaggcccagagaggttagggaatttattcaacatcacacagcaactgggtggcaagttgagtccagaacccagaattatccctgtctcaggttctctccattgcatcacactgccctgcgctgggtgccaggcctgcatgccagggagatggagcctagcctggctctacaggacccttggctgtgatcatctgaattttccatcactccaccccctgaaactgaggcattacttttatgctattttatttcattttttaatcatagaatgttaaagccaagaggacatttcagagggtcattttgttcatccaaccttggtttaacattgacagagttgccgcatggcagaggaagggaactaccagttattgagagtcaactgcatgctgagtgctttcaaaataatgatgcggcctgcttattgcaggcctactgtgtgtctagagctgcactgggcactttgatgaggaggaggagggggagaatggtaaacacctgatattaattgagcacctatggtgtgccaggctccagtactcaatgttttaccgtcacgatttcaatctcttcttccaactattccaaggatagatattattattatcatcctcattttatagatgagaaaatcaaggctcagaaaaggtaaaacaaatacttgcctgcagccacatctccagaaaatggttggtgagatgccaatcattccagttatcccacattctcagggggggtctcagaatctccccaagatacaaccaactcccgagccagccccttcctctctagccctgtgctctcagctgcttaaacaggcttagcagcagggcccttctcattcttggctaattcccaaatgggcttggttgctggtccccctgtccctctttctgtcccaaggaggtgcccagccctggggtagggaacctcgggatgaccttggtgagggtggcagatgatcaacaaagactcctgggttgtactgagccctggcacgtgtgtgaaccttgcatgcacacagcatccaggcagtctcagatgacagtccctgaggaaacctaatcccaccaagatagggacacctgaggacgggggcaggaagggcaggggcctgacacctgtcaaatgaggatgatcccagaaggctgactgcaccattaacaagacttccaccaaagcaagacagacttaggatagatggcaaaataagcgtctataaggaggcaggactggacttttcctcctcactaggagatgacaaagctgtgcttagaggaagcccgctcagagttggcggcatggctgagtcccaaaagatgccacatgtgcccacgacaagtgaccaagttcatccttccgaggtctgttaataattatttatttaactgccacaagttccagatatttagattccatgggccaatcaaatgtcccctgcccccaccccccaaaaaatgagaacactaacaactttgatgcttggcaaaaaaaagaaaaaaaaatacatcaataaaacaatttgtggccaggcgcggtgtctcacgcctgtaatcccaacactttgggaggccaaggtgggcagatcatgaggtcaggagtttgagaccagcctggccaatgtggcgaaaccacatctctactaaaaatacaaaaattaactgggcgtggtggcacgcacctgtagtcccagctactcaggaggctgaggcaggagaattgcttgaacccaagaggtggaggttgcagtgagccaagatggtgccactgccctccagcctgggcgacagagcgagactttgtctcaaaaaaaaaaaaaaaaaaatttgctatcaactatcactatcattttaactcttaaaaaataggcaaggcataatctcagaataaaagacagtcatggccgggcacagtggctcacgcctgtaatcccagcactttgggaggccgaggtgggcggatcacctgaggtcaggagttcaagaccagcctggccaacatggtgaaaccctgtctctactaaaaatataaaaactagccgggcatggtggtggacgcctgtaatcccagctactcaggaggctgaggcaggagaattgcttgaaaccaggagacagaggttgcagtgagctgacacagtgccactgcactccagcctcggcgacagaatgagactctgtctcaaaaataacacaaaacaaaacaaaaaacagaataaaagacagtcattcaattgcaaaaagaaactaacaccattgaacttctgtttcctgttccaacagagaccctggtgaaaatctggtttcccttggggaccactgttctctctgtcccttctaggttttctcttttctcgagcatctgccccaggagcccttgagcccgtcatcctgagtaatcaatcactcaggggcagcgcctcagaggcaagccccccccccaaccccaatatcttgagaggctgggactgtcccctgggcacaaaaatgtatctgaatctctctcaccctggtcctatcctgagtccacattgagcagaaagagccttggcttctgggtagacagaagtaagcctaagatctttctctgtcccctccagccagcttgtgacaagtcacatcatccccctgagccttggcttcctcatctataaaatgcgcttcacagagcagccttgcatggtgtttacaaggattcagtgggatgttgtgtgcgaagggcccggcacagagtgggtgcttagtcaatgctccgcctgcttttctctcttgctcttgaggtggccgcattttctctctgcctgggtgaagttaaagaaatgtatggtctctccttcttccttctgggatttgggagcaaattcatgattcctttggccagatcaggctctgggtctttgtcccaatcccgccaaggacttgctgtgtgaccttaacaagtaaccacccccactaggactcactttttacaaactataaaataaggggtttgagctaattaatccctaaggaccttcaagaccctggttagggttgatttgcaaagacttccattttttgggagggatgggggagagcaagaggtgaggtgtggggagggaggaagaatcccaccctatttgaggtcctggcagtggaaggagtacacatatgagggccccagaaaattttaacatcaacctaaggggcttgatcctatgccttctccccagaggctgggatacttgccctgattggctgtgggggagggtgtccttccttcccataacatctcaagctgcttagtaaggcaagaaggccaggcaccctgccactctctggcgaccctccaaaatgcttgtgcctctcggtcagagctgaggcctcagtgtcttcattctcagggcagactgccttgaacccaatcctagggacatttcccgtcaatctgccccacacccaggagccacctgacgccttggggctattctggggaactgaggtgggatccagagcctctgggaaatgtcctctggagcctggaggccctgaagcagagctcctctccctcctccccctcgggaaggcagagccatcccaagaggcaatgctctgggcaggtcacaccagccctgttctctgcccctacccgcagcatcccactggaatctagttaaatcagacattgggggaagccttgcaggggcgaagtcccatgggcatgactacagggtgggcggtctctgagggtgaaggggccagaaggtcatttcagtggattatggggacaggtcatgggtcatcagagaggagttatgaagccctgtgagaggctgggaggacgataagggagccacactgtgaaatgcccacatttcgtaacaggaaggtaacgaaacctgtctgaattcagtaaatcaggaaattgcaataagcatgagagaggttgccttaggcagctgagaagaagggctggacaaggaactgctgtctttctttagaaacagtgtgttactattttatttgattttgtttgtactatgtccaaatattacatgaataaaatgtttccatttaagaattcataatgaaatgaagcagtatagactgcaccataatttctctcctagcccacggccccactgctttaatggactcaccacaaggagtcccaatgtaatgtcaccttacggcctagagacgaaggccgcagggctaccaaggtggggaaatgggcacttcctctgggaatgaccttcaagggagcaagtcttgtgtctttgactttgggctgggcttttggaaacagcttgcagggaggtcagcctgggttcattgcagggaacagcagagagcaggcagctggagtctgaggccctgctgagagcctggctctgcgttctgggaacttcggtggtcacttccctgctgcgggcctgggtttcctcatctgtatcgttagggggtgggggtggtcacgcctccccaggagtggccgagagaacacaccttggaaaacgctgtgcagctgcagagcaggatgcccgcaggggagaaatttttaccttgaaaaggacagagtggctccctaaagaggctggacctgcagctccttccgagggaggagtttcaggaagccagctccctgaaaggcagcattcagtgggcgtgactggctggaaagttcacaaaggtccaggagccaaaaccagtattattcctgcccctgcaccccaggctctttaacagcccctggtggtaccgccttcccttctttcccctggggtccttatcctgcaccagcctcccagattaccagcccgatttgctgacaagtggcttctctgaacctgggtttgctgccctgtgaaacgggagcaatgctattcatctcatgggactgtggacgccttgagagcaggtgctgtgcctccattgcccgttgcctggtacagctcccggagcagtagctcctcagcagtgaaatgtggagtgaatgcgatcggagggaggaggttacaaattatgccttacagcacctaactcaccgcacagctgcagaggctgggacacacaagactggctctctcaagggccaggcgcccttgcagcctccttctagactggaaaagtcacatgcaggtctagggtatgcaggctataggcaaagggaggacctgaatgtgatctctggactctgggcttggttggcccagagaagggtgacatcagtgcacttcgtgtgccaggaccctcctttccatgccctccaggcagagggtgtgcctgccacggggactaaccaggaatgcattcattaccacccagcgcccaccaggtccaagtcatgctcagcgtgagatgagcccactcgggcagctctggggacctggaacgggcacatgtcatgtgtgtgacactcccaacaccttcccaaccacatccctactcgacctcgtccgtctccaactcaaggcaatttcgcctcccaagggacatttgacaatatctggagacatttttggctgtcacaactgggagggatgttactggcatctggtaggtagaagccaggagtgctgttaaacatcctacaatgcacaggctgcccccacacgaagagttatttggctcaaaaatgtcagtagtgccttccattgcagctaatgcatctgctgtaaccaggaagggccccattttacaggtgaggaaactggggctcagagaggtcctctaacctgcccaaagtcacacagcttataagcagagaaccagggtctaaaccccaccttgtctgatactaaaccttttcacttccctacagtctccacaaagcctgtctccatggcaggcctagggatgctgagggtcccttcaccaagagaagggataagtgggggcctggccctggatcctccatctagactcacaggtgccctcagaccaagaggggttagagacagcttcccacccacagtaaaaccctcagtccttgaaggtgggatctagaccactggaagttctgggagagaaagagacacgcacacccaggtgcacatgtgcacacctatgcgcatgcccgggtagactgagaaaggcagtttgggaatgctatccctgttaagttttcagaatatgaactatgaatcagaccaaccgcactgtgtaccccagttctgctagcgtccctatgtgatcttgggcatgcgacttcacctctgaactgaggcatccagatctgtgcagcgaggatcattccccaacccccagccagaacaatgaagtggtaggaggtcccagacctccccgatggcagctcttgcagccgtaagctacgaggtccacacagtgtctgctgacggtctccagtgggtagtgggatgttgaggcagggggtcgcataagatgacttcagcgaggtcctctctttcccgtgaccaaatgaatggctgagacgcacccaaatcccacaggtcttcctcttgcccctgccctgccctgcctggcaggctcagcaactcacccatgtctcttctccccagagatctccctggatgtggacgcagaccgggatggtgtggtggagaagaacaacccaaagaaggtacctagctttcagggcaggcaccaccctgaacccagggcttccgagggcacagccccagatcccgcaggcaattcccatttcacagctcaggagactaaggcccaagacaggctcccagacacacagcataccaatgatggaacccacagaggagctcaggcatctcctagagacagcaacagagcaggctcctgagtctcagtttctctatcccatgatggggacgcccaattcatggaactgctgggaaggataaatgtgcccgctacagaggaagcactgtgaaggcatttgctcttattattttgcctgttcttttaagactagggaggtgggggagacagaccctcaggacagagggtcgcattcatcattctcagttccaggcgcggtattatctctgctggtgcatgcacggcccctctcctctttctatttattctttcattcattcaccattcattcatttgttccctcattcatttacttattttcttttatcttgcattccccactcccattctgctcccccacagaggaccattttgctgggtttaatgtgtctctttctgctctggtgactctcaggaggcatgtggtgtggttggtgtgcatgtatttttaatttgtgcagacagcatggtgttctccacctcattctgttttgtacttttccctcaacctagtttttaggctccatcagtcttgctctgtgtacattcaggctgttgcttctaactgctttccattttctgcccttctgtattatctcaatttttgccatgggcatatgtgacttttataataacactctgaagcctagagtaaagtatacatagaggggtacttacgaagtaaaataaacacagcctgatgagaagcctgggtcctagcagcctgctaccctgactctctgcaggtcaggagagggttctcagccatgtggggaagtcccttcttctaggatcgtgagcaaggcttgcctgagaccagggccagccctgcacactcattctctgagtctatggccaagccatatgagaatgaactccacagaggcctctgaaacccagcagccccagggcgacagcttccaacctcccccaaggggctgggcagtcttgggaaagtcacacgatccccatgagcctgaacttggccagaatttttaaatctgggccggtgaagttttcacattttcttcactcatcccataaatatttgctgagcatcttttatgttccaggagcgggtcaggcccaggggacacagaaagaacaagagaaacacagccctggccttaaggagcccatggtccacattaaatatggagtgtttcggatagctgtgtcatcacagttgtcctaagtcctcccaaaaaggatgtgtacagggccaggtgtggacccggggaagctgctctgtcctagagaatcagaaaggcctccaggaagaagagacagtcatgctgtaaccgaggaagggtagagtgggccaggtggaaaggggcaggacaggagcagagggactggcataggcaaaggcctgggagcttgagtcttttgggagcagaaaggcgccgggatgggtggggcagagtgagcgaggggcaaggcggaggagatgagacagagaggaaggcaagtttcaccaggccttccaagccacagcaaggaatcagggcttcatgccaactcaactgggagcccctgacctggcttaaagcagggaagcaacacaatctggcccgagtttgttctagtagtgctatggctgcagtgtagaaagtggagcaccatgcaggtcccattcggagcactaggagcgtgtctggaaacagctgggtggcatccatccaggcgtctcctcctgagctcccctagggacctagggacccatggtagaatgtctgtctgctcatttctctggccagcctccacctccctgcctccacccacaccagacaccagctgcaccagacaggaggcccataaatgcctcagtcagccttcctgtctctgtgcctctattgaacttgcctttgatgcccacattcatcctctgtggacatcagtcttgagattcacatttgccaggtcacagctgccccagtgggtggcggctactctttaccctcatcctggggctatctctccagtgtcccatggggtctatacaagcatagagaagagggcactgacctttcttcctgccactgtaggcatcctggacctggggccccgagggccagggggccatcctgctggtgaactgtgaccgagagacaccctggttgcccaaggaggactgccgtgatgagaaggtctacagcaaggaaggtgccagcaggccctgcacttggggggcaggatgagaggagtgaaaagattcatgcccagtcctgggctgggctgagggtgaggcaggtgtggactcaggcctcctggggatggtggacacaaattcccactcttgcttaaagccaaaggcaaaaccataggaaatagacaagggccgggcgtggtggctcacacctgtaatcctagcattttgggaggccaaggcaggcagatcatgaggtgaggagttcaagaccagcctaaccaatatggtgaaaccccatctctactaaaaatacaaaaattggctgagcgtggtggcatgcacctgtaatcccaactactcaggaggctgaggcaggagaatcgcttgaacccaggaggcagagattgcagtgagccaagatcatgccactgcactccagcctgggcaacagagcaagactctgtctcaagaaaaaaaaagaagaagaagaagaagaagaataaaaagaaaatagaccagaaggaaattcccaaaaggttaatcatctctagtgttggaaatgacaactggtttttattctgttttatgctttgcttttttctttttctttttttttctttttttttttttttgagacaaggccttgttctattgcccaagctggagtgcagtggcatgatcatagctcactacagcctcaaccccctgggttcaagccatcctcctgcctcagcctcctgagtagccaggattacaggcacatgccaccatgcgtggctaattttttttatttttgtaaagatggggtcttgctatgttgctcaggctggtgtttgtctcctggccttaagtgatccacccacctcaacctcccaaagcactgggattacaggtgtgagccacagcacccagcctctttatgcttttctatagtttccataatacacatccatggggattttttcctgattatcaaagtaaaaggcattgggaagctgaggctccagcaacagatagatctcttcattctcaccttctgtccctcagatctcaaggacatgtcccagatgatcctgcggaccaaaggccccgaccgcctccccgccggatacgagatagttctgtacatttccatgtcagactcagacaaagtgggcgtgttctacgtggagagtgagtgatcccagcccagcccagcctagacctttctagccacctaccctcctccccttagcagttgtggccttcacaggtgcaggtgcctggggaagacctggattggtctctgagtgattgtaacatggcaatgctgttgtcccgtgaagttgaaagactccatggggacacatcgctcctcctctcaaaggagtctggagtgacatgggtctatgtagaacccagaggcccttcctccctacgaatcaggggaggaagggcatttgggcacttcttttctggagtcatgtcaccttcaggatacctgaggcagggcaggcaccacctccaggtattttctgccatctctgactttcaaagaccccctaaagatgcagtgggcacccttgaagagttgaccccttgctcctctcgatggcaacagatgtcctgggcccccactgtgtagggcacgggctcctgccctggagctagtcctcgtagctgccggctctgcctcaccctgtctgtggatatgtgttgagccctttggtgccaggccctgttctcagctttgagatctctgcagtaaacacaacaatcacaccctgccctcaaggagccgccagtctagcaagagagacataatcagtaccacaattggaggaaatgaaatagaataagtgaggagaatggcagggcagaggcaccactagatgggtgcctctgaaaaggcctctctgaggaggtgacatctgagctgagactcagatgaacaataagaaggaaccagccactcgtgagctgagggaagagtgttctaagcagaggcaacagcatctgcaaagcctggaggaggagaccagtttagagtgtgggaagagcagatggaagcccagagcagggctgggagtcaaggtcagtcagctcggccaggggccagagcatgcagactgggtttgaattttcttctgagtgcaatggaatgccattagagggttttatgcaagggactgtcataataatgatgtatgtgttttaaaaactccctcagcaaaatagtcggcattgcaatttgccatggtacaaggcgggtcgtggggtggcgggaggaggcttctgcatgcccagctgcctaggggggccaggatctctggcccagccccgaacccacctctagacaggcctactagatccagggcattcaccatgaggtgagtagggaccctggaccctcacatcagggagatatttagccaggatggcagtggccagcagccacccaataccagtcttccttctgatccaccctgggctccaagcagtgacctcacacaggttggaatgtgcccagagtcaggctggctccgctgccgcagggggccggagatgttgatgttgacaccatccaggccagggttgtcatggaggatgggatcaccagtgggagcaggagggatgcaagcaggacctcaacctcggcctcttgaccttggtgtcgtgacacgagacctgttgcaaataatgatgtctggacattatctagaagtttcttctttttgctaaagggagtggactggtctggttccataatctcatccctccccgtcacttgccatctgagatgggtcctgagcagacaagaaaaaagaggaactactaccacaggggctttgagaacgtcccttggagcctcttatttgggctgcccatcctgtggggagcagccacgactgagacagtggggacccagaagagacagtttcccaataatgctgacactgggtcactgggtgaaaactcttagacacacacacacacacacacacacacacacacacacacacacacacaagcaaaggacgacagataattgaccaggagcacagtctctttttcttccaggcaaacactttggagttatgtcaaattccaggcacccctgtggatgagcgaatgtcaggtgtcctggtagggtcagaccagctctccccaaggccagggggctgggttggagactgaaggacccctatagggagtgctggagtcagggagctacaattctgggtccaggcaagtcttctcaccagccccagccttggggtgctcatctctgacgtggcatgggagtagtaagagttccgactgtcccgggtgtcccggatcgtggtggggatctaatgaggaaggtgtgtcaggcactgagtgcagtagctggcctttggaaagctctccataaatggcaattatggcttttgttgagattatgatgatgactgttagttacaatgattggagtggacagaaggcttcagtgctcctaggaagacctggtgatggccttagcctcaaattctgcccaaaacaccaagcactggggccttacctctttatacaaggaaatggtaatccagtttgcccaggactttccttattttagcactgagggctcctcatgccaggaaacctctcagtcctagggaaaccaaatcagctggtcacactatcaaggagtctcgctgggaagtggaatcattccaaagtagctagaaaggttaaggcaaaccacgtgccagccaatgcctggggcagagaggtcacggtggtcagtgggcccagcccaaggcacgaggaccactcaatagagcggcattgttggttcctgcagagaaagctggccacgctcagtgtggggtttgcaccgagccagggatggaggacggggtaaggaggctcctggggacaatggctgaattgttcccaccaagaaatcagtccgcccggagctggccccaactgtcagaaagcagcccagaatagaggtacattgtgaatcacaggccacgggccacatcgggagggagaaagctgccggcagacggactagaacgtgtcctccacctgccccaccacccctggccagatccctgttcctaccccagaccttggtggagccccccaggtgctctgagccctgggaaagctttggctgtgtggcttctgccaggacaagttggcttctaagcctgactgtcccctgagcatcagttcaagtgcagcctggggcctgtgggcatgggagggcccgagtgcctggaggaaaatgttttcatgatgccagtctatctgaatctactgactgacagggctgcagggtgcacactattgtttctgggtgagcaggacctcactttctattctttgggactttcagtatctgaatttttccacctcatttcttggactcctccctcccaagggaggatgaggtgggacgtggtttccctgccttctgtttggaaactattcaatgaaaactccttcacatcctcgtaatacaggtccaagcagtgttactgatggttacccatggttactgaggttactgaagttactgagcctgtgtcatttacattgaacctgtggcgtgggtatcattatctcccacttaacagatgagtaaactgaggctcagggaggttaagtgaattctctgaggcttggttttttgttttttttttttttttttttttgagatggagtctcgctctgtcgcccaggctggagtgcagtggtgcaatcttggctcaccacaatctctgcctcctgggttcaagtgatattcctgcctcagcctcccgagtagctaggattacaggcacgcaccaccatgtccggctaatttttgtatttttagtagagacggggtttcactgtgttggccagtcttgtctcaaactcctgacctcgtgattcgcccgcctcagcatcccaaagtgctgggattacaggcgtgagctactgcacccggctccctgaggttttatagcttgtaaagccagagaagtatttaaaccaaggtccctctgacattggaagtcataaccactaagggaagcacccttagtgagatttataaccagggtctatttcggcacattgtcccacaggaggagccatcccaagccctggcttcgcggttcatccacttatttctcacgttttaatcaagcacctagtttgtgccaggctattcggcttatgtgttctaacccttgagcatctggtcattaaccattatcattgtcgttgaaagcactaagctgaggctgattctgcccttccagctctacagggcataaagaaattccttctggaactgcatagggtcctacctccatgcctttaccaatgcaagtatctcctctccccaacacacccatttctgccaacccgcaagggcatctcaaaggctgccttcctctgctcaaatgcttcccaccgtgcctcttctgccctccccaccctaccccaagtaaccagactggatctcacccatagccgccgttatgacgcttcccacatctgctccatcttatcatcagctgagcactgctgttacagaggctgcatttggaccacctctgtctccccgaaggtccttgcctgattcatgtgctctcaatctgcctgaaaattcccccttggtctctcccacagggaatgttgtgggagtcattggttcgttcagtagacatttgttaaacatgaccatgtgccgggcaggccctgggccccactgggcctgtctctaccctcgcacaggtcacccacatttaaaaaggctgtgatgaggccgggtgtggtggctcacacctgtaatcccagcactttgggggtctgaaggcaggcaaatcactaaaggcaaggagttcgagaccagcctgaccaagatggcgatgaaaccctgtctctgctaaaaaatacaaaaattaaccatatgtggtggtgggcgcctgtaatcccagctacttgggaggctgaggcaggagaatcgcttgaacccaggaggcagaggttgcagtgagccaggatcatgccactgcactccagcctaggttacagagcaagaatctgtctcaaaaaataaataaataaataaataaataaacaaacaaacaaacataaaaagactgtgatggagatggcaggtggctgtgggagctccaaacagagcccctggctttgtctctggggaaactgggctggattgttgcaagtgacacaaaccaaggcctgaaggaagaagggacacaattgtttcaggcagaggggagagcacaagtcaaactgggagctttcaggagggcaggagccctggaggaacctatctttccgcccagccacaaaaatgaacagcccatgcactggcctttacaccaacacggcttccatgatatggagggaatttttggtataatgggcacatttatggtttgtttatacagaggggatgagagctcgggattcagaattcgacttgaatctgagtcccagctcagctatttactggctgtctgactttggacaagccactcctcctttctgagattggtttcctcatctgtgaaatggaaacaattacatcctcccctggaaccactaactgctcagctggcaatttcctatcagccgttcacgagagagcttgcttattttatagatggggaagccaaaagccagagagggtgactgtctggcaaagcgccacacagccagcacacagcagtgctgagacaatgacaatgacctagccatggccattctggtggcattttctgcttgtgcttttctctctgtctagaggacaagttactttgcccttttgtccccatcggtgatcccaccccaccgacctctttctgatgcgggtgggagtctgacgttggtccttttccctccagacccgttcttcggccaacgctatatccacatcctgggccggcggaagctctaccatgtggtcaagtacacgggtggctccgcggagctgctgttcttcgtggaaggcctctgtttccccgacgagggcttctcaggcctggtctccatccatgtcagcctgctggagtacatggcccaggtgagggctccaggcctccaccacagggggctaaccccaggggccagggtgggtctcctactagtgggccattcctatgctatgctccaccctgctcaaagcgccaaaggggtgggtccaggctaggagacctcgatgccccccagcaaagcctgcacgtgtctgccagggtcctctgagccatgctcctgggatcagtctccttgctgcttctgctccccacggattccctgtgggcaatgttttctgacacactccacgcctgtgtcctggcctgccctgctccctgcctaggtctaaggcccagagtcctgctgattagcgcgaggctctaagcagccacccaggtggggtttgctgaccacctactgcgcgctctgtacttcctgccccactctgacccctcccccaactgtgggttataccaactctgactgcaggctgaaccccaaatcccagtttcaggttgtgccctaccctggggccaggcatctcagccagccttgctcttgctttggggagaaactggatgaggagaagaggtcctgtccctctagagaagcccccatcactgagggcgtgctgtgctcacaagaatctctatcacaaagacctttcatccccagaccctagcctctcaggcccaccctgtttcgctcagaaaaaaagggagggacctggctgctctcgcaaacacaagagcccctcatttttatccccaggccactttgggaaaggatacaatgggtgctatagaaaggtgaggctggatctagctgagatgtatgagaatgagccctggcagccgactgcccaggttcaactcctggtttaaccaccacgagacactaggcaaatgaattaaacttcctgttaatttccttagttaagggtagtttgccatagtttctccatctgtaagacagaacgtccaaaagtttctgctgccgggggtggttgtgagcatccaaacttgtgaagttctacttacaaagcaccctcaagctccctgggaagtggaaaaggcaaagctaacaggataggggacggggatggggcttcttatggcacccatgcccagggcagcctgacccccaggatctctcaggcacccgcagagactcaaaaggcagaccacggcaagcaaggcaagccgtgcaacagtcccaccacccccgcacctccccaccaaggatggggtccatttcctatatcttttgaaagccagccccacaaaggaaccctggaatcagacctcactttcccttgggttccaggcaagctgcttgaccattccttaaaacaaaacagtctggacatagcaaaactgacccaaaacaacgcgaaaatgcccacatacagaaaacggcaaggtgccaagggcaaaaacagaggaaggtggggggctggctcagctgttgcgtggggcgatttcaggaagagaagtttgatgggacaagataggacagtggttaagagtgtgacctcagcagctgactgcctgggtgtaaagcctaccatgtggtcaagcacacgggtggctctaccacttaccaaccatgtgaccttgggcggttaacagccctgtgactcggtttccccatctgaaaagtgaggatcatagcagtatctacctcctgcggtggtcggaaggcagaaaagaattggcacatgtgaaagtacttagcacaggcttggtgcatagcaagtcctgaggaaatgtattcactgtcatcagtttcacccgctttgaaaggcaggcaaagaaagcacctgacaaaaccttttgatcccccacgccttgtctcccacacccaggacattcccctgactcccatcttcacggacaccgtgatattccggattgctccgtggatcatgacccccaacatcctgcctcccgtgtcggtgtttgtgtgctggtaaggggtgaccccagcctggagaggcagcgtggcagagtggccaagggccgagtcagatggacatgagtctagttcctggccccgtcacttaccactgtgttaccttgagcaactctcttggcctctctgaaatgcccacatcgtagagtcactgtgagaattaaatgagatgaagcaggcaaagcatttatccaaggcccagcacacagggtatgctctaaaaataatagctgccattctgttctcttgcttaaccctctaccaggcagttagcaacctcctatgcagtggaaatgcagctcatctgactcattcattaaacagacttttattgaccacctattatgagctaggtccacaacagcaagatgagaaccaagggaaaaagtgcctgtgattagatggctagcaacccaaaagggacccttggggtcctcacgtccatcccatcttcatgccaggcagagctcttctttgaaaatctgtggagtcagaggtgtaaggcattgggacaggtgggggtgagagttccccccctcattttatttgttcatgaccttgacaaacgccacatgagtgggtgggtttacttggcctttgattccagcggcctttataaaggtggccgtgagcacaggtgtagactgatctgcccggcacagcccagagataccagctgctgtcaccatctcagggagatgactctggcccctcctcaccctttctcctggcctctccttcttcccccaacttctcagcatgaaggataattacctgttcctgaaagaggtgaagaaccttgtggagaaaaccaactgtgagctgaaggtctgcttccagtacctaaaccgaggcgatcgctggatccaggtaaggagcccaggtccaggctgggaaggacatggcccccgggtcaagcaaagaagagttggcttcatgtgaactgcctggcacccagcagctctgcagatggggattcttctgtcagctcatatctgcacatgtgcacaaagacataaacatacaagtgcactacagtgctgcttcttgtagtagcaaaagattgcaaagcaacctaaatgtccatctgtggaggactgagtaacggccttcccggaagttctgtgcaaccgctaaaaaggatgaagccagtctctcaatatggatacaggatgtgcttcaagttaagttgttactcaacggaaaacatattcaggatgctgcttgctatttgtgtgttttgttttgtttgagacgaggtctcgctctgtcacccaggctggagtgcagtggcatgatctcagctcactgcaacctccgccttgcgggcttaagcaatcctcccacctcagcctcccaagtagctgggactacaggcatgcaccaccacgcctggttattgtgttttttaaaatgaggtctaggccacgcgtggtggataatacctgtaatcccagcactttgggaggctgaggtgggaggattgcctgagaacaggaattcaagacatgcttgggcaacatagcaagaccctgactccacaaaaaaaatttaaaaattagcctggcatggtagtgcacacctgtagtcgtagctactcagaggctgaggcaggaggaccgcttgagcccaggagtttgaggctgcagtgggccataatcatggcactgcactccagcctgggcaacagagtgagaccctgtctcaaaaaaaaaaaaatggggctgatatcggtaagaaacctgcctgtgatgtgcagagactgcctatggacacctgtgctgccatcatcagtgtgaggggaggaggatgggggaccagggaatggggaacaagacagacgttcttcttcctttgtgctcttgtgtttctcgagttttctgcccatgtgcacaaattgtcccctggattcgtctaacagttctccttggtgtccctgcaggatgaaattgagtttggctacatcgaggccccccataaaggcttccccgtggtgctggactctccccgagatggaaacctaaaggacttccctgtgaaggagctcctggtaagatgctgagggccacttgcgggtggagcatgatcctggagattctcataagacagagtggtcaggagaccctgggccgccttgacacattcatctgctgcccagagcctctgtttctcctctgcaaaatgagtccacttgggatagctgcctctgaggtcctttcctgctctgataactgatgtttttccaaaacatagagagttttctagtgggaaatgggaactaagggaaatagagttaagacctagttccagaggccctggcccctgctgctgcccttcccctccaaattgcagcaaaatgagttaagtttcaaagaggaaaaaaacatagttatgcaattgtcaaaagtcatggttccaacttccaagttcatcagcactttgaggctatggtttttggtgcgtgtgtgtgtgtgtgtttgtttttgttttctgagacaagagtcttgctctgtcgcccaggctgaaatgcagtggctcactgcaacttccatctcccaggttcaagcaattctcctgcctcagcctcccaagtagctgggattacaggcatgcaccatcatgcctggctaatttttgtatttgtagtagagatggggtttcaccatgttggccaggctggtctcgaactcctgaccccagatgatccacttaccttggcctcccaaagtgctgggattacaggtgtgagccactgtactcagccatgttttttgtttctttgtttgtttgtttgtttgtttgtttttaagtcatctgactcctcccattctggaagccattctcagtccccttttaggcccttgacaacctagtgtgtgaagttagaaccgaaaccaatctttcttttgtctgcactcttctgccctgaacaggctgggggaggtttgaacagggcatgaaacaagagactggaatagatcaggggacttttcccaaggtcacatgcaggacagcattcctgtcagacgccagggctgcccagagctgaccctgtgccaggttcacacctgttctgccccacattccttacccagtgccctgttcacaaggagatgctagagccaatggtgtcagcacagagctttggaatgtcaggtggacccggtcttgagtcctaattgcacctcttagcagccatgtgaccttgggcaagcaattaccttccacgagcctcagtttcctcatctaaaatggggatagaaatgatatcagtctcacagaatgttgtgaagattgaaggcgttgtataaggcatcagtgccatgtctgatataatgaccattattagctgttgttatggttatcattccccgggccctgtccttagtgagcttattgtccactttccctaacactatgatgagtagagtcaaaccaaccaccagcaccagttgccacaggcatgagaagcgaggcctttccaggtcaccacctgccttcagtattccaggctggcctggttccaaggccccaggctgcgttgttccttgaggcccaggccaggcccggctttgtgctgcatacctgcccacctgtatggtgctgcagagccccagcaccccagccttggcaagctcccatgttgccagctggggccccaagatgagaaagcactaggctgctgccatctaccccatgggctcagctgtccctggagcctctcagctgagccaggataagccacatcctccgactccactggattttgtaaggcaagcttcatcccaaccccagtgcaagctcccaaacaagattcctatatttgtaccccaaaagccatgagaggaatgttaaaattcaggggccaatggggttatgtcttgcgggctaactccaattttttggagctctgtgtgaagaagggttctgaggcttcctctgggctcagtggcaagtctggcaggttgagactgggttgagatgtcatgtatattcatagctgccacttttgcatgtattggtcagcttcaccaagtaacaaaccaacccgaaatctccatgaccgacaacagcaaaggcctgtgtcttgctggcattccatgttgattgctgctggtggtctgccactctgcttctttatgccttccttactctagcgctcaaggtgccagagcagccccagtctgggaaatgccattctcctagcacagggagaattcaaagagttggcagacacacgtgggggctcctgtggcttctgctgttcactggcatgcatcccttctgctcacatttcattggccaaagcaagtcacgtgaccaagtctgacactgggcagggaagtatattccttttgcaggaagatgccagaagtcacatggcaatgggtcaggatgcaaaattctcttactgcgcagagggtagcaaatctctggaaataataatactagctgctccccttcctcaggttacctaatctggtaactctcttatagatggggaaacgggctgggcgcagtggctcacccctgtaatcccagcactttgggaggccaaggtgggtggatcacttgaggtcaggagttcgagaccagcctgggcaacccagtgaaaccccatctctactaaaaatacaaaaattagccaggggtggtgcttgcctataatcctagccactggggaggctgaggcaggagaatcacttgaaccaagaggcacaggttgcaatgagctgagatcatgccaccgcactccagcctgggcgacagagcaagactccatctcagaaaaaaaaaaaacaacaacagatggggaaactgaaagtgcatagcataaaatgcggactaattctgaaatcaccaatatgtatctgtgcttgggaaatagaggcatacacaggaatgcagatgcccacacactcacattcacactcacactcactctcacactcactctcacactcactctcactcgcactctcacactacaccgagatgctcacacactcagcctccccatgcccaggcccctgctctttgttaatcataggaagatcgtggacaacccacctggaaactgggtgcccacagacccagactgaaggtgataaaagagggtggctggcttgggggctgaggaccctggctgcagaagactaacgcaggtgtgtgccctctgcctagggcccagattttggctacgtgacccgggagcccctctttgagtctgtcaccagccttgactcatttggaaacctggaggtcagtcccccagtgaccgtgaacggcaagacatacccgcttggccgcatcctcatcgggagcagctttcctctgtaagagaagccaggctggggctaggggctgtgggagtggggaagtcactgtttctcttttggggtggcctgggttgctcacacatggagcaagtggctgggggaattattccctcccacgacttcctgttaagaggccgacactcttggaaagaaaatcaagctagcctttatatctttgtgtgatttaggatctaatatataactaaataaacaactcttttccccaagtggaaaggtgtataatgagattataaatcagctggttggtggggcacggtggctctcacctgtaatcccaacactttgggaggccaaggtgggcagatcgcttgagtccaggggtttgagaccagcttgggcaacatggcaaaaccctttctctacaaaaaatacaaaaattagccaggcatggtggcatgcatctgtagtcccagctactcaggaagctgagatgagaggatcgcttgagcctgggaggtggaggttgcagtgagctgagatcacaccactgcactccagcctggcaacagagtgagacctcatctcaaaaataaataaatagataaataaataggctgggcacagtggcccatgcctatagtcccagcactttgggaggccgaggcaagcagattgcttgagaccagaagttcgagaccagcctggacaacatggcaaaactttgtctttactaaaaatacaagtattagcaggcatggtggtaatcccagcttcttgggaggctgaggcatgagaattgcttgaacctgggagccagaggttgcagtgagctgagatcatgccctgcactccagcctgggtgagagagagactttggcaaaaaaaatcaggcctggtgcggtggctcacgcctgtaatcccagtactttgggaggccgaggcgggtggatcacctgaggtcgggagtttgagacctgcctgaccaacatggaaaaatctcgtctctactaaaaatacaaaattagccgggcgtggtggcacatgcctgtaatcccagctactcaagaggctgaggcagaagaatcgcttgaactcaggaggcagaggttgcagtgagccgagatcgcgccattgcactccagcctgggcaacaagagtgaaactgcgtctcaaaaaacaaaataaaataaaataaaatattaaataaatcagctggggaagggatggaggagtccagagaaggaaaactgacaggtatgagtgggagcgtaccaatgaatcctcagggctaccatacttaaaagaggtatgagcagacgtggtcctgccccagaaatgtgagtccctggctccctggcctgtccatgattctcctcactccctgcccagttgacccaccagccagtgaaaagacagattcttccttgtcagggcagtcgctggggaaagagtgaataccttaggttctcacgtcacaaaagggctgccaggagcctgcacagatggggtcagccaggatttggccgccagtttcctccgagccacatgggatgctcagccttctgcggggaggccactggcacagccagcgactgtttgcccacttttgcctccttctccctccactcagtggccactcattcactcagcaaccatttcctgagcaccagccaagtgccaggccctgtgtcaggcacagggtcccaaacaggaagcccagcccctgccttcaaggagatagcagaggtctcaggcatgcaaatagaccctgatgaaatggagggacttacaacgatagaaagaatgacagggagtcaggtcagcccagggagtggccctgaaccccctcgaggagctcagggggggcccttaaagacaaatatttactgagaagctactctgtgccaggcactattctaggctctggggatacagcggtgaccagaacagatgaagtcccagctctccgggagtttatagttgggtaagggcagtacagaaaataaacatggaatcaagtaaatcaattagataattctgaatgctgatacatgcaatggagaagataaaacagggtgacatgataaaacattcctggggacaggggtgccttagctgttgtttttttgaagatgtgactagagttgaggcttggatgttaagaagtaggcagccatcaggagattgtaaaggaagcgcattccatacagaaggaacagcaaagggaaaagccccaagggatagcaagtgtagcaggtggctggagcagacagaaccgggggaagggagggaagcgagggaggaggtccggccaggagccagatcagaaaggaatttgttggccaccctaaggagctagggttatcttcggaggataatggagagattgaagaccttggggggtctagaaatgaggaagggctggccgggagcggtggctcacacctgtaatcccagcactttgggaagctgaggtgggcagatcacgaagtcaagagatcgagaccatcctggccaacatggtaaaaccccatctctactaaaaatgcaaaaaaattagctgggcagggtggtgggcacctgtagtcccagctacttgggaggctgaggaaggaggatcgcttgaaccagggagggagatattgcagtgagctgagatcatgccactgcactggtgacagagttagactccgtctcaaaatacaaaaaacaaacacacaaaaaaaaagaaatgaggaagggcttcctggaggaggtttctcttgaactgattaaagattaaagtaagtccaggcacagtggctcacacctgtaatcccagcagtttgggaggccaaggagggcggatcatgaggtcaggagttcaagaccagcttggccaacatggtgaaaccctgtctctactaaaaatacaaaaattagccgggcgtggtggcacacgcctgtagtcccagctactcaggatgctgaggcaggagaattgcttgaacccaagaggtggaggttgcagtgaaccaagatcatgccactgcactccagcctgggcaacatagcaagactccatctcgggggaaaaaaaaaagattaaagtaagtagaagttaatgtagcaaagaggcacatggatgagggcagattttggagccctcctgcgccctagccccgtccggcaggccaggtgggactcccgcacacaaaaggtagcctctgcacactcactggcaccctcgagggctgaagcctgggctccctgcccttcacacaggccgcagctgcaactcacacctactctttcccctgggactcaaacgccttactgcctgcgccagggtctcttaacccaacctagtctccttcctgggacttctctgctgatgccactctgggtccgaggtgggtcccagagaccaaactcctcttgcaggccctctggtgcggtgggtaatttactgaaactcctcttcctcccttctccaggtctggtggtcggaggatgaccaaggtggtgcgtgacttcctgaaggcccagcaggtgcaggcacccgtggagctctactcagactggctgactgtgggccacgtggatgagttcatgtcctttgtccccatccccggcacaaaggtaagctagcctcctgaggctggagtgaatggggtagcggcaaaccaatatattaccagcccctgccagcagagggcaagagctagaggaactcgacagcataaaggaaggaggaagtaggctgaagctggtttgcatgttgttgctgtggcaggtaaaattttaaccccataaatccaaaatgttagcattgcaacacataatcagcctaaaaattattaacgagagatttaaattcttttctcatactaaatcttcaaaatctggcaaagattttactcacatgacacacctaaattcagactagccacagctcaagtgttcagtagtcacataaggctagtggctattgtgttggcggtaatgctttagagagaaatagggtatgcacctgtggcactggaaagaggttctttcattttcttatgggtacgacttcataccctggaaattctctgcaaattgtgtggctgcttggcaacttggagatgtcctgtccaagtccacctttgactctgagccttgatctggtgacattgctgaggtagaggaaaggtgagaaatattcctctgaagcagagaacaccctccccgtcagcctttgccactcggcatgggaggcctgaggcaatgagcaggcaaggcactgggtcctcagcgcagggcctccccgtgctccttgggtgccttcccactgctgactctgtccctctggactgtctcttgcagaaattcctgctactcatggccagcacctcggcctgctacaagctcttccgagagaagcagaaggacggccatggagaggccatcatgttcaaaggtgagtggccacagggccttgacaggaagtggcgagctggaggccccagagagaccctcgggagggtagggcagataagcactttgtccctgagcacccagctccacttccctgggtgtctggcccgatcgggggtttgtgaggtcgccatgctgggaagcacctctggcctcctgtgacccttgctgtggctgggtggactgtgagctgcccgcagctccttagtgtcaccagcagtgcacagcgcatcttcaagtcctagcgtatactttaaatggcaccagacccagtggagggttaaatggttgaaaactgacatgcagctgggtctggtggctcatgcctacaattccaacacctttggaggctgaagaaggaggatcatttgagtccaggagttcgagaccaatctgggcaacatagtgagagccccatttttataatactttttttttttttttgagacagattttcgctcttattgcccaggctggagtgcaatggtgaaatcttggctcactacaacctccgcctcccaggttcaagcgattctcctgcctcagcctcccaagtagctgggattacaggcaggcaccactatgcccagctaatttttttttatttagtagaaactgggcttcaccatgttggtcaggctggtcttgaactcctgtcctcaggtgatccacccgcctcagcctcccaaagtgctgggattacaggcatgagccaccacacccagcctctctataataaaaattttgaaaaagaaaaggaaactgatgtgcaatctgcattcaaggagcttgtattttagaaagagagatagaaaatagatgcaatacaatttagggacaggaagaaaagtggactttagtgggcaaaaggcatggtcagacatcgtggttgtcagtccagaagtgagacattatcttctacgtttagacattcacataattgggacagacatagtcgggatgaggtttgcatttgaattaatcacggaaagagggaaagatgatcaggtggagacaaccagccaggttagagacaccatgccaattcctcatacttcttttttttctttttcaacttctattttagatttagggggtacatgtgcaggtttgttacctgggtgtattgtgtgatttggggtatgaatgatcccatcacgcaggtactgagcatagtagacaacagttagtcattcaactctttccctcctctctccctccccactctaatagtccccagtgtttgccattgccatccttatgtccaacacgttttttattgtgataaaatatacctaatctaacacatttgttattttaaccacttgtaaggacacagttccgggacattaaatacatctacaatgctgactaaccatcagcactctctatatccgttatacttttttttttttttttgagacacagtctcactctgtcgtccaggctggagtgcagtggtgccatctcggctcactgcaagctccgcctcccaggttcaagccattctcctgcctcagcctcccgagtagctgggattacaggcgcccgccaccacgcccggctaattttttgtatttttagtagaggtggggtttcaccatgttagccgggatggtctcaatctcctgacctcatgaaccacccgcctcggcctcccaaagtgctgggattacaggcgtgagccaccatgctcggcctatttttttcttaaattacttttgtcacttttcaggttggtatccataatatatctcatgcctgaaagcctgagttcccgcagctggctgatacttacatgactgcccctcagatccaaagacagtgttcctgactgtcactggtgtctaggacagacaagaccaatttaacaccaccaccctttttaaattccccaccgatgggaagtttgttcttggattggcaagcttgagtcctgacttcctggaggcttcctctctaatattaaacataccctcaaaaactacccataggatatagggaccattatttttgtacaaataggggcaagcagtgccccagatttctctttgtattttagaaagagagatagggagaaaatagatagaatacagtttggggacaggaagaaaactggactttgatggacagaaggcatggtcaggcatcgtcgttgtcagttcaggagtgaaacattatctcctggacttagacattcatgtaattgggacagacagagagaggatgcgcggatgtgcagtcagcagagagtagaagcacataggagacctggggaggaaggtgaaccaggcaatgccaaagagccaagatctccgctggaccagagcccacaatgtttggggaaaacacatccctttaaaagatgataaaaactacagacttgccctccagaaaaatgcttatatcaatctatctcctgaacttggatcagttttagaaaatcacagatccctaaagttttctgtttctacctggaccctcccttctgagtccctaagcctcaaagattacatccggcttgtagctgggcatctttgctgctgtccagttataaacctgggaagtgcaatggaccagcaggctcttcccagatgaggccaaaataaataaacaaataataggttaagagcataggctctggaatcagactgcctgatctgcacaccaactctgccgcttgctagatgtaagtcctgagacaagtcacataacttctctgtgcctcagtttcctcatttttcagggtagtgactaccccatagaaatgtggggaggatccatgagttaattcaatgtaaagcgtttagaagagcttcggccacatagtaggtgctcattgagcattaggcattactaatcaagctggaagccacataagccatcgtgtggtacaggaggcagacgcaggccactccagagcagcagccaagatgaggcagctctggaaaacaggaagggtgtcccctttggccatgctgcttctgccacattcatgctggtcagctgctcatccttaggagcaggctctaggtgggagaaccagggggctacttgtagcacccctgatcccactggccaaagcaagagcaaggcagctgccaccactgtcctggctcagatgtcatggtcaactctggagaaaagagtgtgtgctgccctccccagacagaggggggcctgattttgcctgggagtgccctcctgtgatccagcctctccccagtcccatctccccagtcccagtccagcagttagcccggggctggaggatcttggcaaaaggggaacactcagcctgggtatctaaagcttgaccatcccctgtcctttgaaccccacaggcttgggtgggatgagcagcaagcgaatcaccatcaacaagattctgtccaacgagagccttgtgcaggagaacctgtacttccaggtgagggcagggcaggggtgcagggccagagggcccctgggagggatgaggctcaggcccttacatccttggggcttccgtagagaatggccaagggctcaggagctcctgaccccgagcacagcagcacagggaagagcctccaccagcatccagccagcctccttgctttgctcctgggctaaagtcccagggtgaaagaagtgccaaattgtgccgccccctcacttggggaggtaggaccatgggcaactcactaaggctgtctttgggtctctcatctctaaaaaggggataatgggggccagacacagtgtctcatgcctgtaatctcagaactttgggaagccaaggcgggaggattgcttcaggccaggggtttgagaccagcctgggcaacatagtgagacacttgtctctacaaaaaaaataaataaaaactttggccgggcctggtggctcatgcctgtaatcccaactctttgggagactgaggtgggcagatcacctgaggtcaggagttcaaggccaacatgcccaacatgttgaaaccccatctctaccaaaaatacaaaaattagcctggcgtggtggcaggcgcctataatcccagctacttgggaggctgaggcagaagaatcacttgaacccaggaagtggaggttgcagtgaaccgagatcgtgccactgcactccggcgtgggcaacagagtgagactcagtcttaaaaaaaaaattaaaagggaataataatagcatctatattacagggctggagcttaaataggcaatctatgtaatgcgcttagaacagtactaagcacatgtacgcattagcttttgttattaccaaaatcatcagtgttatcctcagctcatggggtggcccgaggggtcactgaggtgctgtgtgggaagcacttagcacagggaccggctctagtgagtgctcaggaaatggcagctgctgttctggcatctgtgaccttcctctgtcctattacgactgctgttcatgaaccccggtggacagggccagggagaggctgcagaggcgcccgctgactgctagaagtctctctggagtgccggggcccctggcctggtgctgcagacagggatggggttgacaaggtggccggtgtgtgtccccctcacctgcatgccctccatcctttctcctacccagcgctgcctagactggaaccgtgacatcctcaagaaggagctgggactgacagagcaggacatcattgacctgcccgctctgttcaagatggacgaggaccaccgtgccagagccttcttcccaaacatggtgaggccctgcagaccccaaccctcgccccatgccagtacagggcagccagatccagaaggacccctcagctgaagctgtccaatggggaggcccaggtcccaatcctggctgagctgctgtgtgacctcacctcaggcacttgccctctctgggcctccatttcctcctaggggtgatatgctcatcctagctgcttcactgggatactgggaacccttttccttaacagataggaaagtgctgtgcaaaagattagaagtcctttatgtacaggagggatttctgttacatagaggggagtcttctataacataaaaagaggttagaacaatacatatgcacacatggacacatatatacacacatgagcacacataaacacatgtgcatgcatggacacatatatacacacacatgcacacagaaacacacatgcacgcatgaacatatatacacacatgcacacacagaaatacacatgcacacataaatgcatacatacccatacgtgtgtgcacattcatacacatgtacatgtacacactgatgcatgcatatatagccacatatacatacatgtacagacatatgtgaatgcttttgcacacacatacatacagaggcagattgcctggttttccacttcagctctgccatttgtgagtgacttagccccactccgtccctatccaatcacagttactacttcacagggttgccgtgagggttccatgagcttaggataggcatgtgtgtactaggtgctcactaaatggaagctgttgccatcgcaatcccccgtcacaggtgaacatgatcgtgctggacaaggacctgggcatccccaagccattcgggccacaggttgaggaggaatgctgcctggagatgcacgtgcgtggcctcctggagcccctgggcctcgaatgcaccttcatcgacgacatttctgcctaccacaaatttctgggggaagtccactgtggcaccaacgtccgcaggaagcccttcaccttcaagtggtggcacatggtgccctgacctgccaggggccctggcgtttgcctccttcgcttagttctccagaccctccctcacacgcccagagccttctgctgacatggactggacagccccgctgggagacctttgggacgtggggtggaatttggggtatctgtgccttgccctccctgagaggggcctcagtgtcctctgaagccatccccagtgagcctcgactctgtccctgctgaaaatagctgggccagtgtctctgtagccctgacataaggaacagaacacaacaaaacacagcaaaccatgtgcccaaactgctccccaaagaattttgagtctctaatctgacactgaatgaggggagaagggaaggagattctgggattgccagttcttccagcagccatgctctgaaaatcaaggtagaatccatggaaagggaccccaggaccccgggaccctagacgtatcttgaactgccatcgtcatttcaaatacatctccctcagggtttccaggtggccacccccaattattcattccttaccaacctctcaaatcctcttggctttctctctgcagtgtggacactgttggctagtcctccccactccctgagggtccagtaagttagcttagaaccttcctggaaacatttcatctgagcaggtttccccacgtgtgggatgctccttttgcctcatctgtctcagggatgcaggctcccccgcatgcatggggatttctccccagaccagcatacttgtgacctgagagttcaatgcgtaaagatgcccctggtcagccatatccatcttctcttgcctggtccttgattctctggccgctccctgaccttcctccttccactgccttgactttcttcctttttattcctggtgccatctgtccaggcagctagacaagaacttgttcgccagcagccagattcaggccttcccaggggcataataagtgaccagcccctcctctccggacatcagatccaacacataaggaccctggcctaccctccagcccaacagccagttctgggtcagctgccaacttaggggtggtttgattatcccattgaaattcaccagtgcctttgccaaagaccctctcatttggacatacccagattcattccctggctccaactgaaaagactcagtttcaatcgttaaaagttcctttagggccagaagaataaatgaattataatcccattttgaagaaccgatttataaccaatgaaaaggttataatgtaatttatattcttggaggaacaagattttcatttgggattatttccttcaaccattcaacaaacatttgttgtatgccactaagcgccaggcacggcgttgggctctgcaaacacagtggttagtagcagtctggacctggtccctactggcatggaacccatcactccccaacatgcaaagcccacatttaaaggccagcctctgccccttcagtgatgcgctctttagaaatgccagtccactatattcagaaatccgcagggcacaaaacttccagcaagtcactgttgtggtgaaatgggcagtgggggtggggggtcttctttaaacaggcccccttcccatctacctagccagtacccatccaatgagtccccagagcctccagaagctgttgtctcctctctggggacagcagctcctgcctttggaggccaaagccccagatctctccagccccagagctgaaaacaccaagtgcctatttgagggtgtctgtctggagacttagagtttgtcatgtgtgtgtgtgtgtttggttaatgtgggtttatgggttttctttcttttttttttttttttttttagtctacattagggggaagtgagcgcctcccatgtgcagacagtgtgtctttatagatttttctaaggctttccccaatgatgtcggtaatttctgatgtttctgaagttcccaggactcacacacccgttcccatctcacttgcccacccagtgtgacaaccctcggtgtggatatacccccgtggactcatggctcttccccacccccactttctataaatgtaggcctagaatacgcttctctgttgcaaaactcagctaagttcctgcttccaccttgatgttgaaatatcttatgtaagagggcaggggatgtcgtgaagatggcaagaagaacacagtttcaaatttctggaaaagagcctgtggtggagatctaaagatgtttagggaagagctcgactaaagaacaatgaaataaatggtccaaggggaagtcatatggctgttggtgtgatgttctttgctgcttcatagacacggcctggagtgaggcaagccacacactgggccctcctggtcctgcagcccttgctgttctgggcacagggtctgggctctcagcataggtatcttgagggttcggaatccccaacacactcagcaactgcatattacatggccaccaccgaaggtcaagaccagtacccgcaataaagtctgactatgttgttctgatggggttccccaggagcagagcctgagatgagcattcaggaacaagtgatttattgagaagtggccggcgcagtggctcatgcctgtaacctcagcactttgggaggccaaggcaggaggatcccttgagcccaagagttccataccagcttaggcaacatagtgagacccccatctctataaaaaatttaaaaaattagctgggcatggtggcacatgcctgtagtcccagctacttggggggaggctgaggcaagaggatcaactgagcctaggacatggagtctgcagggagccacgatcgtcccactgcactacattccaacccacatgatagagcaagaccctgtctcaaaaaaaaaaaaaaaaaaggagcctccggggaaaccaagatggtaactgggggagcaggccaaggaaagggaagaaaccatacaagagtgtgaggtgaagcctcagaccgatccctggagagctctggagcataaatggcacctctgagctgtcctgtctggaggctgagtctttgtccgcctgcaccagtcattggctctggggactctggccctctgaatgggcgagggggcaccaggagctcataggcaaccatctaaagatcacagctgggattaggaacaaagtcacaagcttgtgacaagttctgccgcaaccagaagagggaaccgcaaccacggcagggaatcagccttgtccattgctctgggtgatgttgtgtccttttaatcaacagctactacacacaagtatttgtgatttgacccatggtatgaaaatccatacaacataaccatgatctaacagggtctttgtgaacaaactcctgaggccctaaaatggagtcacctgattggttgctgagtctagaagctgcttccaagttctttgggagacacctggggcccttctcactccttagtcccatcttgagcttctggaccaatgtcttggtgccactattttaaaggggccactgcaaaatgagaatcactggttcactcactcccaggcttaacccaggggcccaggcctctgaaatcccctttttttggttttgttttgttgtttttttgagacggagtcttgctctgtcaccagactggagagtgcagtagcatgatcttggctcactgccacctccggctccctggttcaagtgattctcctgcctcagcctccagagtagctgggattataggcaagcaccaccatgcccagctaatttttgtatttttagtagaaacggggtttcatcatgttggccaggatggtctcgatctcctgaccttgtgatccacccacctcggcctcccaaaatgctgggattataggcgtgagccagcaccctaccaaaatcctcttttatacccaactaatgtggtccaagccactgcaaggccaatctttcatagatttcctgacccatctagttctgcaattccccaagggatgctgggatgttcaacaagttcatcctggtgatgttttcacatcttggccaatcacccacctcagggtcgctgagtgttaccttgagacttttgaacagcactttccaatagaaatataatgcaaactacataatgtgattttgaattccctagtagccacatttaaaaagtaaaatgcaggtgaaattaattttaataatatattttctttagcccaatctatccaaatcattatcatttcaacatgtaatctaaagtgtaaaatttcaatgagatattttacattctcattttttggtagtaagtctttgaaatctaatgtgtattctatacttatatcacacatctattcagactagccacattttaagtgctcaatagctacaagtggctatcatattggaaggtattgttctagaaacttgtctgccaggctgagcgccaattgtggaaataggcacattccttaaacccccagagtccactagtttgactgcaatggttaataaaagtttattattattatattgaaaagagaaatgtaaaatagatacgagccatcactggccttggtatgcagacccttgcccttccagaaagtcttcttgtctgaaccatggctgctgccaagttaccaggacccccctctctctctgcaaggtgattgcctttggccaggtcccctctgcccactgtcaagatgggaacccccaccaggtcctctttttcccctcactcttcctgtggatacagcctggttctacatttaatctaaaatgtgtacttggagtcccaggtgagagcagctcgttatctcagattcctccagcattccagatgggatcagagccacaccttggcatagccaaaaccccacggaagtggttggggggaggtctctcctccgaaacaaaaagcagccaggaatgaatctgcctctccagtgagattcatgtaggatcctcaagcaagtggtatcaggtccaaggggctgatggaaaagttattagcaactaaatataggagtgacatcaaatggcagcatgtaggatcccttctccagctggacatgcagaaaaagaatgctcccaggcagaaagcccagctctgcagccttgtctcaagcctggctgatgtgaaagaccttcaccccatccccctggccagctgggctctttttcagccctgatctttgaaaaagcaaaggtcttctctgggtagtctctaagcaaactgctgggttcaggccacgccagcttggcctcaatccctcaccttccacaagcaaaggtctgctttctgacagccctggttatacccaaagatgactaacagtctctgaccagcatgctaaggccccatgcgcaggctactgtgttactgaagagctgaagagatacgttcaatctttaaaaggaatgttttccggccagctacagtgactcatgcctgtaatcccagcactttgggaggccaaggcgggcagatcacctaaggtcaggagttcgagaccagcctggccaatatggtgaaacccagtctctactaaaatacaaaaattagccaggcgtgatggcgagcacctgtaatcccagctactcagtaggctgaggcaggagaatcgcttgagctctggaggcagaggttgtagtgagccgagattgcaccactgcactccagcctgggggacagagcgagactccatcccaaaaaacaaaaaaaaaagggaatattttgttttcctactgatggcaattcctggcacatagttgatgctcagcaaatgtgttttgaataaaagaaggaaacatctgttcagctaggcaatggaagcagaaaagtcagcccaaacatttcttaaacattgattgcattcctaccaggtggaactatatggaatcccatttggaaggtcaaaatggtcaaatagaggcgatttttgttggttcaacctaatgctttgcattcgtcatctcatctaattctcaaaactaagctgtgaggttgttatccccaccttacagatgaggaaactgaagctcagagacaggaagtgacttgctcaagattactcagcaggaaatggcagagctgggattcatacctgggtggtctggctccggagcccacccactgagcgcctgctcttgactacatctcagaaacagctttctagccgggcgccatggctcatgcctataatcccagcactttgggaggccaaggtggacagatcacttgaggtcaggagttcaagaccagcctggccaacatgacaaaaccccgtctctactaaaaatacaaaaattagccaggcgcggtggcacacatctataatcccagctaatagagaggctaaagcaggagaatcacttgaacccaggaggcagaggttgcagtgagccaaggtcatgccactgcactgcagcctgggcaacagaacaagacactgtctcaaaagaaaaaaaaagaaaagaaaaaagaaacagctttctaacccaagtttagcattctttcattcacaaatgttaccttatctttgcaccagtttttagcatgtcaggtgtcctattagaagaatcttatcaacaagatatcccctctacctgcaagcaagatgtctggagattataggattcctacaaacccctctaaggcaataaggcccataatgaaatgacctctacgtagctcagtatgtgctctctctattcctcagctcggagtaagatggcatgtctaaatcgtgaaaagcaaattatattcattcatccatccgttcacttttctccattaacatttgccaagtgtctactgtgtgtaaaaccagtgatcccacaatttttcatctaaaccagggcacttctgagatctcagaggagccctgcaaataattccatcagggcaacagaagaatccggaactatgctcggcaaaccagggtgtttgttctccctggaaagccctgtgcatgagacattatctaatccctcaaggagctgacagctgagtcagggagacagacaggagagcagagaggcacactgatggaataggcacctgataaatacttgctgaatggaggaatgaataaggtacaaaaatctgtgtacacacacacacacctttcctgctgggagaatgaccaaggatggcctggtgttcatttgtcctaagatgaatgactgctgagtgaatgtagaaatgaatgattaggcaaagaggggaggaggggttgccaagctgagtagagacacaaagaggtccaggtgtgtaatatgtctgggaaattgtgattatagtgagtagctaaaatatagattgcagtaatgctggaaacactagggttggtgccctggaaaccgtctgaaggtttgaggtcactgcggtcacatgatcaatcctgtattttaggaagctgacagtaacatatttcttcactgatattaaactcatagggaaaacatttttaagaaatttcctgagggataagcaaaccatggtacagccctgcttttaaatattctgcagcatatatgatgagacggatctatgcatactaacatggaaagacctccaagacacagcacttgacgaaaaaatggcagcttgcagaacatgtatgttatcgtttgtattttctaaaaataaaaatggccgggtacagtgtctcacacctctaatcccagcattttgggaggctgaggcaggcagatcacaaggtcggcagatcacaaggtcagcagttcgagaccagcctggccaacatggtgaaaccccgtctctactaaaaatacaaaaattagccgggtgtggtggcacacacctgtaattccagctactcaggaggctgaggcaggggaatcgcttgaaccaggaggcggaggttgcagtgagccgagattgcaccactgcactccagcctggagacagagcaagactccatctaaaaataaaataaaataaaatagaaaaataacagcaagcaaagccatggatttctgtagaaacatacatatgtaaatacatacaaagaaaaaaatctggaagcaatcccatgaaactgacaatagcaatcacccctgggaaaggaagtgtgactgaggggatttaagctttatctatattgcttgaaatttttacatagtgagaatttaattacatatgtacagtattctaaaataattttttagagctgcctgaaatccttgacattgtatgtatgctgaagtcttcccattctgataagcataatctatttcccctaataaggcacagttatcttttacctctttcctttccccagctgggctctccactaccaatttaagattgatggctccctatagacactaactcatttaattctcctccctgcaaggcgactgtttctttttcaccgtcttacacaataggaaatgaatgcacaaagaggttaaggaacttgctcaagatcacagagcaaatggctgatataacagggtttcagacccctaaaggcctgcacacttaaccattctacctaccagcctccctaagaggtcaaattgcctttaacgttctgcagctctctgacttttgtttccagtcggctggcatctcgccgctacgcatgaatatttacccactattcgtatttgcatttcatttgcatggctgtgtctctgatagaaaacagtgctcaaaagccagattcggctggaaagggcgtttgatcatggcattatacggtgtttgcaaagtgctcacccacacacatccagaggaacaaactaactgctcatttgagagtatgctggtgacggcaggcatctgggaatgaggcagaagttagcagggtgggtgagctccaaatgtatgtgtgtgtgtgctgctatagggccagcagcatgacagtccccagaaggccttggaccacttgctaagtcccagcagctgagctgacttcagctgtgtgaaacgcagccccatctggagtgggggtggctcatgacttttttgctccgggagttccatagaggctgctcttgaaattggagaagcctgtagcctatgattgtccccatcccactcgaagagaatattttgagaagtctaattatatggtggggtttgcatgggatgagggaagagagtttagataaggcctttctaagggcaggttggcaaggtccagtagggagccctgggtagttctgtgaggcagcagcaccctctgtgggtagaccagaatggctgcaaccaccatgttcccacgagccttaggcgcacgcctgcagcccagcccatctacctaacagaagaggctgacctacttgctgggtgacctgcggtgagttgttgacactctctgaggctcagttgcatcaactgtaaatgaagaatagtaatccctactttgtgccgttgctgaaatgattacagagaggacatgtacccaaagtgttctgcataggacctggtacacagtaccaaatgtgtcctccaaatgtggcagttaccatcattagtcaccccaatatccccatgacccttagtatagatgaccaccgagtgccctagcataagggacaaggcttctctgagaaaaatcatagatgggactggggtgggggctagaaaggatctgtgccgctggctggttgacgttttgatttgccaattccgtctattccaattctgggagtccttgacatcggtcatgggaggctctgacaataaatacgttcataaagaattaaaaacagcccaggcgcagatgcacagtcctgtaatcccagcactttgggaggcaggaggattgcttgagcccaggaattcaagaccagtctgggtaacatagggagactccgtctctacaaaaaaaaaaaaaaaaaaaacttttttttttttcagacagagccttgctctgtcgcccaggctggagtgcagtggcacgatctcagctcattgcaacctcagcctcctacgttcaagcaattctcttgcctcagcctcccgagtagctgggattacaggctcccaccaccacacccggctaatttttgtatttttagtagagacgggtttcaccatgttggccaggctggtctcgaactcctgacctcaagtgatccacctgcctcggcctcccaaagtgctgggattacaggcacaagccactgagcccagcctacaaaattctttttaaaagtagctgggcatggtggtgcatgcctgtggtcccagctactagggaggctgaggtgggaggatcacttaagcactggagtgcgaggctgcagtgagccatgatcatgccacagcacttaaacctgggtgacagagcaagactctgtttcaaaaaaaaaaagaattaaaaacaaacttgcagatagcaataagttatatgaagaaaatcaaatagagtcaagtgggtcaagccctcaaattgcccatagtctggggaggcagacatattcatgggtcattgttaaaacaggtgttgcatgcatggatggcatatgcagaggatattttgatagggacaatcaaggagggacttcctaagggaggaaaaagttggagctgaatcttcaatgatgacaagtcaaccacatgaaggaggaggaaaggacactccagatccaagacacggacgtacgcaaaggcttggaggtgtgaaatgaggcggggaatagagcaggctgtattacagggacagaagtaactggaagggcccgcgggggagccggggagccttggagctatggtgggagttgatggttgattggatatggggtggggagaagaatcaagatgacatcgagtttctggcttggatatccggtagatggtggtgctaataagacaagtataaactcctcaggtgagatgtaccgtttgggataggttgggtttaaaggaccattgggacgcccagatggagatgctcaggagacagccagggagacggaaaggacgaagcccactggccaaaggcaaataaaatcctaaattttggctgggcgcagtggctcatgcctgtaatctcagcactttgggagtccgaggcgggtggatcacgaggtcaggagatcgagactgtcctggctaatacagtgaaaccccatctctactaaacaaaatacaaaaaattagccgtgcgtggtgacaggtgcctgtagtcccagctactcgggaggctgaggcaggagaatggcgtgaacccgggaggaagagcttgcagtgagccgagatcgtgccactgctctccagactgggcaacagagtgaggctccatctcaaaagaaaaaaaaaatcctaaattttagatgagaaggccccagagctccaccacagcaatctgttgctgtgggtttttcccagaggcaaatgaatctcccaggcaacatctgatatttcctcctaaatccaaccctccttcaccctctggctggcagaaatcatccaggttgccctaaattacaagacaccagactacaattgattgtacaaatgacagttgatacaacataatgcttttttattttgttattttcatttttttgagacaggttcttgctctgttgcccaggctggagttgcagtggtgtgatcacagctcactgcagcctcgacctcctgcactcaagcaatcctcccacttcagcctcccaagtagctgggactacaggtttgcaccaccatgcttggcggattttaaatttttttgtagagacagggtctcaccatgttgcccaggctggtctcgaactcctgggctcaagggatcgatcctcccacctcagcctcccaaagttctgggattacaggtatgagccactttgcccagctggttttaattttcaattctggacatgatttccagctcttaggggagaaagacctcctaaagcaaaacgctcacctaaggctgctcagttttcctgctgtccaaagactgagagagtctggaaaacaggagcagcttttccaacccaaaagtgtggttatgaggactaaatgagactgtttatgtaaacacctttgcaagtgataaagttcagtataaacatagtgtctagcagactgtctggtgaaaagcaatatgtcactctctagacgaatggaaataaaccaaaaaaacctagggtcttatcatgaggacatctttggaaaatatgtcaggatcaggccatgaaaatttctaagtccttctgcagctgtgactttctggcatcccaaagtccagggcggaggtacagccgcccaggaatttattcctccataactttgagctccccaaatcccc

SEQ ID NO: 1967 - DNA, 4353 bp, Homo sapiens
ggagaaggcgcacctgctgcaggtgctcccggccgccccggaccagcgagcgcgggcactgcggcggggaggatgctgcgcgagcggaccgtgcggctgcagtacgggagccgcgtggaggcggtgtacgtgctgggcacctacctctggaccgatgtctacagcgcggccccagccggggcccaaaccttcagcctgaagcactcggaacacgtgtgggtggaggtggtgcgtgatggggaggctgaggaggtggccaccaatggcaagcagcgctggcttctctcgcccagcaccaccctgcgggtcaccatgagccaggcgagcaccgaggccagcagtgacaaggtcaccgtcaactactatgacgaggaagggagcattcccatcgaccaggcggggctcttcctcacagccattgagatctccctggatgtggacgcagaccgggatggtgtggtggagaagaacaacccaaagaaggcatcctggacctggggccccgagggccagggggccatcctgctggtgaactgtgaccgagagacaccctggttgcccaaggaggactgccgtgatgagaaggtctacagcaaggaagatctcaaggacatgtcccagatgatcctgcggaccaaaggccccgaccgcctccccgccggatacgagatagttctgtacatttccatgtcagactcagacaaagtgggcgtgttctacgtggagaacccgttcttcggccaacgctatatccacatcctgggccggcggaagctctaccatgtggtcaagtacacgggtggctccgcggagctgctgttcttcgtggaaggcctctgtttccccgacgagggcttctcaggcctggtctccatccatgtcagcctgctggagtacatggcccaggacattcccctgactcccatcttcacggacaccgtgatattccggattgctccgtggatcatgacccccaacatcctgcctcccgtgtcggtgtttgtgtgctgcatgaaggataattacctgttcctgaaagaggtgaagaaccttgtggagaaaaccaactgtgagctgaaggtctgcttccagtacctaaaccgaggcgatcgctggatccaggatgaaattgagtttggctacatcgaggccccccataaaggcttccccgtggtgctggactctccccgagatggaaacctaaaggacttccctgtgaaggagctcctgggcccagattttggctacgtgacccgggagcccctctttgagtctgtcaccagccttgactcatttggaaacctggaggtcagtcccccagtgaccgtgaacggcaagacatacccgcttggccgcatcctcatcgggagcagctttcctctgtctggtggtcggaggatgaccaaggtggtgcgtgacttcctgaaggcccagcaggtgcaggcacccgtggagctctactcagactggctgactgtgggccacgtggatgagttcatgtcctttgtccccatccccggcacaaagaaattcctgctactcatggccagcacctcggcctgctacaagctcttccgagagaagcagaaggacggccatggagaggccatcatgttcaaaggcttgggtgggatgagcagcaagcgaatcaccatcaacaagattctgtccaacgagagccttgtgcaggagaacctgtacttccagcgctgcctagactggaaccgtgacatcctcaagaaggagctgggactgacagagcaggacatcattgacctgcccgctctgttcaagatggacgaggaccaccgtgccagagccttcttcccaaacatggtgaacatgatcgtgctggacaaggacctgggcatccccaagccattcgggccacaggttgaggaggaatgctgcctggagatgcacgtgcgtggcctcctggagcccctgggcctcgaatgcaccttcatcgacgacatttctgcctaccacaaatttctgggggaagtccactgtggcaccaacgtccgcaggaagcccttcaccttcaagtggtggcacatggtgccctgacctgccaggggccctggcgtttgcctccttcgcttagttctccagaccctccctcacacgcccagagccttctgctgacatggactggacagccccgctgggagacctttgggacgtggggtggaatttggggtatctgtgccttgccctccctgagaggggcctcagtgtcctctgaagccatccccagtgagcctcgactctgtccctgctgaaaatagctgggccagtgtctctgtagccctgacataaggaacagaacacaacaaaacacagcaaaccatgtgcccaaactgctccccaaagaattttgagtctctaatctgacactgaatgaggggagaagggaaggagattctgggattgccagttcttccagcagccatgctctgaaaatcaaggtagaatccatggaaagggaccccaggaccccgggaccctagacgtatcttgaactgccatcgtcatttcaaatacatctccctcagggtttccaggtggccacccccaattattcattccttaccaacctctcaaatcctcttggctttctctctgcagtgtggacactgttggctagtcctccccactccctgagggtccagtaagttagcttagaaccttcctggaaacatttcatctgagcaggtttccccacgtgtgggatgctccttttgcctcatctgtctcagggatgcaggctcccccgcatgcatggggatttctccccagaccagcatacttgtgacctgagagttcaatgcgtaaagatgcccctggtcagccatatccatcttctcttgcctggtccttgattctctggccgctccctgaccttcctccttccactgccttgactttcttcctttttattcctggtgccatctgtccaggcagctagacaagaacttgttcgccagcagccagattcaggccttcccaggggcataataagtgaccagcccctcctctccggacatcagatccaacacataaggaccctggcctaccctccagcccaacagccagttctgggtcagctgccaacttaggggtggtttgattatcccattgaaattcaccagtgcctttgccaaagaccctctcatttggacatacccagattcattccctggctccaactgaaaagactcagtttcaatcgttaaaagttcctttagggccagaagaataaatgaattataatcccattttgaagaaccgatttataaccaatgaaaaggttataatgtaatttatattcttggaggaacaagattttcatttgggattatttccttcaaccattcaacaaacatttgttgtatgccactaagcgccaggcacggcgttgggctctgcaaacacagtggttagtagcagtctggacctggtccctactggcatggaacccatcactccccaacatgcaaagcccacatttaaaggccagcctctgccccttcagtgatgcgctctttagaaatgccagtccactatattcagaaatccgcagggcacaaaacttccagcaagtcactgttgtggtgaaatgggcagtgggggtggggggtcttctttaaacaggcccccttcccatctacctagccagtacccatccaatgagtccccagagcctccagaagctgttgtctcctctctggggacagcagctcctgcctttggaggccaaagccccagatctctccagccccagagctgaaaacaccaagtgcctatttgagggtgtctgtctggagacttagagtttgtcatgtgtgtgtgtgtgtttggttaatgtgggtttatgggttttctttcttttttttttttttttttttagtctacattagggggaagtgagcgcctcccatgtgcagacagtgtgtctttatagatttttctaaggctttccccaatgatgtcggtaatttctgatgtttctgaagttcccaggactcacacacccgttcccatctcacttgcccacccagtgtgacaaccctcggtgtggatatacccccgtggactcatggctcttccccacccccactttctataaatgtaggcctagaatacgcttctctgttgcaaaactcagctaagttcctgcttccaccttgatgttgaaatatcttatgtaagagggcaggggatgtcgtgaagatggcaagaagaacacagtttcaaatttctggaaaagagcctgtggtggagatctaaagatgtttagggaagagctcgactaaagaacaatgaaataaatggtccaaggggaagtca

SEQ ID NO: 1968 - protein, 665 aa, Homo sapiens
MLRERTVRLQYGSRVEAVYVLGTYLWTDVYSAAPAGAQTFSLKHSEHVWVEVVRDGEAEEVATNGKQRWLLSPSTTLRVTMSQASTEASSDKVTVNYYDEEGSIPIDQAGLFLTAIEISLDVDADRDGVVEKNNPKKASWTWGPEGQGAILLVNCDRETPWLPKEDCRDEKVYSKEDLKDMSQMILRTKGPDRLPAGYEIVLYISMSDSDKVGVFYVENPFFGQRYIHILGRRKLYHVVKYTGGSAELLFFVEGLCFPDEGFSGLVSIHVSLLEYMAQDIPLTPIFTDTVIFRIAPWIMTPNILPPVSVFVCCMKDNYLFLKEVKNLVEKTNCELKVCFQYLNRGDRWIQDEIEFGYIEAPHKGFPVVLDSPRDGNLKDFPVKELLGPDFGYVTREPLFESVTSLDSFGNLEVSPPVTVNGKTYPLGRILIGSSFPLSGGRRMTKVVRDFLKAQQVQAPVELYSDWLTVGHVDEFMSFVPIPGTKKFLLLMASTSACYKLFREKQKDGHGEAIMFKGLGGMSSKRITINKILSNESLVQENLYFQRCLDWNRDILKKELGLTEQDIIDLPALFKMDEDHRARAFFPNMVNMIVLDKDLGIPKPFGPQVEEECCLEMHVRGLLEPLGLECTFIDDISAYHKFLGEVHCGTNVRRKPFTFKWWHMVP

SEQ ID NO: 1969 - DNA, 42179 bp, Mus musculus
  misc_feature (1)...(42179): n = A,T,C or G
cgccccccggtgacccgcactcccaggtcctagcgtccaccactgtaagctcggctctccgacttccggctctccgggctgctggtgggcggggcctagaccaggaagccgccccacactctgtgcttaacctttcctgtctgggagattcaggtctctcctgttaccggctccaagaaaccctcacactacatatgcactatataggacatcaagtggaagttctccaaacgcccgctctgttccagccatgcatacttcagtggcttaattaatcttttagaagatcctacctttcctgtgtttacctctaaaggtaaagtcccttagtctccaacttaaaaaaaaaaaaaaaaatcaacgtagaagcgatcagatacggtatgatttgacctggagtacacaagttctgcgtagaaacaaactggaatattgcttactaggaatgagaaagcagtgctgtagatggacagtctgtgtgtgtgtgtgtgtgtgtgtgtgtgtgtgtgtgttttgagagtgttgggggcagatgagtctcccctactaccgcatcccttattctagttttcagacagccttcttaccggcagcaagccaaagccgtagggccaaagaagccacagacagcccacagctgatgagctcttagtcggtcagcagccacataagaattgctgacagaaatccaccccaccccacggccaaaaaacagctgggagcagcactaggcctgcaaagattgccatagcaaccaggaaatgattttaaagatgtatgtgtacaggacctggaaaaagagctcagaagttaagagtactaactactggcgcaggggatccaagataggttgcaacacccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgtcagttagtgttgtggccatctaatgttgaaagcaatgtgccgtggggaagttgtgagctatgtgcttgtgggggagggaggggctccctctttggcagctggggagtcttctggaaggcagaaagctcttgcaagcagggttggtaacaatgtgatagggaataatcatacaaagttgtcctgtcctctcgtggggtctggggcagtcctcctgcatcagtctttaccatctgaggtcagagagatgatgaaggactgggtgggtgcacagccttcagtgccctcacccggagccaatgctgttgttgtgcccggcacaccttcatcccactgtgggaatgggttggtttaggatctcaacgatcgacaagctagcctccctaatgatggtgaaatgtttccctaatggtggtgacatgcttccccaatggtggtgacattctcctttgctttcctccggctccatgttcaaaaggtttaaagtttggttgttttttttttttgaaacaatcatactatatagccctggctgtcctggaactggctaagtagaccaggctagcctcaagctcacagaactccactggcctctcttccccaagtcctgggattttaaaagtttgtacctccacaccgagctatatttaggtttttaaattaatagtctggtaacacacgtgcacgtgcacacgccaagacgttttggcgtttttctgggagatgtgtgttcccaggctgttgttccctagccagaaagtcatggagactagtttatacgggtgtcaaaactgggtacggctgttgttactttgggtaccattacagcagtttcgatggtgacattgaaggcattctgtcctgggttaaccaatgggaacacatcccagggctgttcttcctgtcatccccaaggaagcaaacaggcttctctcagctctcctctctgattgcaaaatggtgttcctgccagtaggctatcctgtgacaatcaggcatggacttttcttttccaatccaaacccactctttaggaggagccaagtaagcctaccatctgctgttttgataaggggatgggaagtgtgtgcacccaggcgtggagaccaatcacctgggcatatggggcaactcacgttaggcacctgaatctcagcagatcattccatctgacgaataagccatgctagccctgccttagcttttaaatgagcgagtttaacaggtagcagaaaaatattagaacagcagataagcaactgggggccgtgatcggcaaaaagtatctgagacaactggaagaagatgctggacatgtgttgttctccgttctgttttcaaggtgtgatggtctgtatatgctctgcccagggagtggcactattagagggtgtggccctgttggattaggtgtgtcactgtgggcttgggctttaagactcttatcctccagcacttgggaggcagaggcaggcagatttctgagttcgaggccagcctggtctacaaagtgagttccaggacagcgagggctacacagaaaaaccctgtctcaaaaaaccaaaccaaaccaaaccaaaccaaaccaagacaaacaaacaaaaagactctcatcctaactgcctggaagggaatattctgccagcagccttcagatgaagatgtagaactctcagctcctccatgcctgcctggatgcggccatgctcccaccttgacaatactgaattgagtctttgagcctgtaagccagccccaattaaatgttggtttttataagagttgccttggtcatggtggctgttcacagcagtagaaccctaactaagacacatggacacagtatttttactcttgacttgttttggctgttctgcctcacctttcccacaaggttggagggacaatcctgcattcagagctagcttctcagggacttcaaacagcatggtcagcttgatctttgtatcacagttgaggagatatgaccaattcagatgatagtttgcaaaattgagttgaggagcaccgctttaaaggagcctgtggtggtttgaataaaaatgccccccatagactccacttcatagggagtagccctactgggaattgtggccttgataaaggaagtgtgtctcagtctcctgctgctgcctgctgtacagatgttgaactctctgcccccttttcagcaccacatctgcctaccctgtcaccatgcttctcgttttgtaatggtaatgagctaaacttctgaacctgtaagacatccctagtttaatgttttcttttataagagttgccttggtggaggtgtctcttctcagggtcagctctacttcgccccaatgtggcttcagtctgacatcagccgctgttctgttgaacgtgttctctgccaccagccacctgcttcctcctctgtttgtccctggtgtctcctctgaaaattggccgtttttggtctttatctgcctttcgctttccttgaagactctgaccagcatttttgttcttcaggctctccagaattctaaagccaagcccttagcataagcctgccttcgagagtggggccaaccaaggcttacgcaacagcaacatccagcttcaatgtacattttgaaggaatggcagggctgaggctacagtagctcagctcaagggttcctccaagaagcccaatctgttcccccattagcaccgccagacaccagcactggtagaaagagtgagggcataagcttagaaactatcagacttcatttgcgtctacactgggagagtctagctaagttacttaatgctttgacccattttcctcatttactacgatccatttgatagggattaaatgagcagcctgcaaagagggcggcacaggagtggggtggtgcacgggctctcggctttagtcccagctcttgggagacaggcagatggatggatctctgaattcgaggccagcctggtcttgtggattaagttccacgacagccagggctacacagagaaagcctgcgcaaacctggtaaaacaagttcaatccctggaatctatatagagatggagggagagttggacatgatggttcatgacagcctggtctacatatcaagtttcaagatagccagggctacaaagagaaactgtctcagagagcgagggagagggagagggagagggagagggagagggagaaggggagggggagggaaagagagaagatgggaggagaggacagacttcacaaagttgtcctcggacctgcacacgtgactgtagctgttgtgacatgcacacagtcacaaacctataaaaactgtcttttgacttaatagatctatatcccatctgctttggagatgcaaatttagaagggtgtggtatttattaccctttggggatagcgaaagacctggggttaaaatatgatactagattaaaatctccctgaagtgctgagctcttcttctccaccaggaggcgctccttctccttctaggtagaggcctgagccaggcctttcttcctggctgctttgtggtatgagagacagccctcacattactatcccagacctgcaagggtttctgcagtttgcagcccttcgaaattattatggtgtgaaagcaacacaaactcacccaaatctatctcagtacagatgacagcccacaaaggctgcgaacccggatcatgcagctgacgaagtgcaacaggctggaagtgtctctcccaagtgtttcagttgctctgaacgtcttccaggcagctcagatggtttctgcttcttctaggcagccggtctttgcagcttggcttgtggtgatgcagctgtctgtgagtcatttctgctcctgtaagtaacctcattaaaactcattggttcaccaagttggacttagatggtagtcataccttggtctcgcatgtatattagtgttctgtctgcatgtatatctgcatgccagaagaggacgctgggtacattatgatgagtgtgagccaccatgtgggtgctgggaattgaactcaggacctctagaagagcagtcagtcctcttaaactctgagttatctctctatccctgggagtttcttttttttcccttccttccttccttccttccttcctttctttttttaaagattaaattatttgtatttttatgtatacacatcttttgcctgcatgtatgtctgtgtatcacttgcatacctgatgtctgcagaggccggaagagtgcatcagatacactggaactggcattagagatggctctaagcttctttgtggtacgaggaatgtaaccccagccagtgctcttaatcactgaatctctagtcccctcatttaaatgtacagcaaccttttgcagataatttcagaatccacccaaaccatgagtggccgttggggaaacaataaagaaccactctcctttgagaagccacattcaaaaccagtacgacctgggtgactcttacacagccgaagcacaaagtacagaacaacctttgcatgtctctgggacacagcttctctgtgctctcagaaaacacttcccaggagatttcaccccagagctgctggtctcttctcaatcaccgctaacttcttagctccagctaaccagcatcccactagtcccgtctatttttcactcttaaaacgagagccacatggctaaagctgccaagctctgctgcttgctggggctggaacttggcctctgtagtagagttctctggagtcacagaacttgcggacagtctctatacaataaggaaatttgtcacgatgacttaacagtctgtagtccaactccccagcaatgctcaggtgtgaatagaaaactcagtagttgctcaatcccataaggccagtagattccaacagatctgctggcaagtaaatgcaagcaggcagagaagagcgaatcttcttgattccaatgtctgttgtatgtcttcaacagaaggtgtggctcagattagagatgtgtaccaccatacctggatctgggacttgtttttatgccaagatccaggtcagaaacttgtttccctcaagatctgggtcacaggtgagccttttgactctggattgtagttcattcaagatatagttgacaaccaggaatagccattgcagcccccttgtatatattacattatcatcagatttctgttttccaaccccttcactgcctaagcttagctgtcctcgaacttgctctgtaaactgactttgaattcagagatctgcatgcctgtctcgtgggattaaaagtatgtaccaccacacctggacttaacttttcttcatctagaacttgctgtcccaggcaggcttgaactctgcttggctttatctgctgggattaaaggtatcaatcaccatgcttggatctaaatttagctgggtaggatcttgcccccaaatcccttaatctgttatctcctaggacataggattcggttccatttcacatcctggtgcccctttaatactcaaactatatattttgtatttttcctttctaagcttgttatgcttattcaaaacactcttcatgagactcaatcaaagtacaacgtctatgatgggcatttctgagacttcctttgtcagtgcaagtaatctgagtctcttcaccttaacctcaggcagactcttcagacaagggcaaaaaagcagccatgttcttcacccaaatactacaaaaacagtctctaggccacagactgaagttcttctccactgaaacctcttggaccgggtctgcacagtcaaatcactcacaggaacaaagtcttccatattcctactaggatggcccattaagcctcacttaaaacattccatggctttccaaatccaaagtccccaaatccacattctttcaaacaaaacagtcaagcctatcacagcaataccccagtccctggtaccaacttctgtcttggttagggttttactgctgtgaacagacaccatgaccaagtcaactcttataaggactacatttaattgaggctgccttacaggttcagaggttcagtccagtatcatcaaggtgggagcatggcagcatccaggcaggcatggtgcagaagctgagagtactatgtctttatctgaaggctgttagcagaagactggcttccaggcagctagggccttaaagcccacgcccacagtgacacacctactccaaaaaagccacaccttctatagtgccaatccctaggccgagcatatgcaaaccatcacaatgatacagacatgattatcatagtcccgcaagagactggataggcaaactatttgcattatacaaagattttcattcaactaaaagatttattgactgcctttcatatgctaagtatagtacaagatgttgaatcaaagaaaatggggccgggcgtggtggcacacgcctttaatcccagcatttgggaggcagaggcaggtggatttctgagttcgaggtcagcttggactacagagtgagttccaggacagccagggctactcagagaaaccctgtcttgggaaagaaaaaaagaagaaggaggaggaggaggaagaggaggaggaagaggaggaggaagaagaaggaggaagaggagaaggaggaaggaggaggaggagtatcaatgtcagaggaactgggtttggtggtggtgattgaaaggtgatggcatggggttggtgagatggctcagcaggtaagagcaccctactgctcttccgaaggtcctgagttcaaatcccagcaaccacatggtggctcacaaccatccctaacgagatctgactccctcttctggtgtgtctgaagacagctacagtgtacttatgtataataaataaataaatctttaaaaaaaaaaaaggctcacaaccatgctgaagatgctgacgccctcttactggagtgtctgaagacagctacagtgtacttacatataataaataaataaatgctttaaaaaaataataaaaaannnnnnnnnnnnnnnnnnnnnnnnnnnnnnnnnnnnnnnnnnnnnnnnnnnnnnnnnnnnnnnnnnnnnnnnnnnnnnnnnctccttgaacccgtgtatctgccaatgttctgaccgttccttgaacccaggtgtgtgcccactgctgcacctcactgtttgtgatattggttgctgggatagagtcggaaaatctccccagcaaccacagctgggccaatcctgagttactgtaccttcattaaactctttccttgtttccctcccatacccatttcttgagaaatcaatccttttacattgtttagatctggaaatcccctactcccccacttctcctttcccccctgagggcctataaaaactgggacccccttttcccttggggtcgactcctctacccctgcatgggatatgagtcgtcccaagagctctggctttcccagaataaagcctcatgtggtttacatcaagcttggtctcttgtgagttcttggggatccgctattatcccaagacttgagtgagggtcttttagcttcacctatagcgagtttgggaccaggttgggcaacatgagactctgaaaaggccaaagtattacagctgctaatgatggtgacaatatgtttgggtgcacacaataaaacaaatcagtaatgggacccggattattttttctttttcagtatcttttcattccctcagagaagtactgaagcaaatttattagtggtaaactaatactggagataatgcaataggaactaaagaatttagtatcattggttagaaacactatttcttgagtcgaataataatttttttttttttttttttggtttttcgggacagggttcctctgtgtagccctggctgtcctggaactcactctgtagaccaggctggcctcgaactcagaaatctgcctgcctctgcctccagagtgctgggattaaaggcgtgcaccaccacgcccggctgagtctaataatttgtagaatatgattcacacaggttgcaatggattatcttgggtggttttttttgttgttttttgtttttttaaaaaaacaaactcatgacgaataacctttcagaatcttcattctgttgtcaaaattacggaaactattcacaactttattatagcaaaaagaaaggggtggatagagaagacacacacaaaacgacagtcagaagaagagtcaagaataagttaaaagcccaaggtggcagtatgcgcctgtctgaaggttgaggatcactcaaaacctgtgtaaaataccgacagctggaaacagcacgatgcgtactaaagctgctaggagtttcctgagatcaaacaaaaatcaagaagacagtaggttcctccctccaccagttttatcatggaaaatgtctagagcatacacaagcacaaagaatatttgttcgtctaccgcgcagcatcaacagtcatcatttctacctcccactcactggcatcccgaagtcaattccagtttagcctgtcgttttacagactctaacgcaaaggcttgggagccaaggcacttgctgtccaagtccactaggtggcagccctttaaatacgatcgtatgtaagaaaagactcaaccaaacgaattttgaaagaaataactgcaataccagaggaggtgtttgacagaacaaacacaagatcccccagaaggtacgcctcgtcctcaacaaacacaagagcctcgagaaggcgagcctcgtcctcagggcggggactcagctggcccaaccgggccggccttttagggactgggctgtttcgggcccgcccaccggtcccagcagccctcgcgcgccgctgcgtcaggaacggcgtaccgttcgggacgcccaggccagggctcgtgagcgcgcgcgcgccgtgcgtcctgggcgcggggccgcgcgcgccgggcctccgggctcgttcgttcccagtcagcctagagcggccggggtcggagcatcgcgtaccccgccatgttctccttggcgctgcgggccagggcgaccggcctcgctgctcagtgggtaagaggctcggggtgaaccccgggcactgtcgccacagtctcccgctcttcgtgcctcccttagcttttagtcctcggagacccctaggcgctggacaggtcagctggcggcggcggggacgccgcggccttcgtcctcagtgcctccgggatgctccgcagctgcggtggcggcgggtggcgggccgcccgcaccgggccggggaaagtcacccctaacttagtcaaggtcaggaaggcgattgtcatttatcctggtgcggaagctagtggggggccctggcggcccgctgcttccaggatcctagcagcgaagctttgggctgcttgtctgtcaggcatagcggctgcgctgcatcggatttaaaagcatgctggagaaaacgctgataggcttggtaaaggcttgccgagttccttcaggactagataaaggtgaccagcgtttcatttactgaagttgttcattcattttaggaaatgctcggcagagaatcgtaggaattaaccgtgagagaatagtagtagcacgagtaaccgcactgaccaaagagtcgtagttctatggccatttgagtgtcaggtgcatctcagataggccaaggaattgaactgaagttgaaacactgaagcgaagctaaaatgcagattccagggcctgcgaggtagctcagggtggaaaggtgctggcctccaggtgtgaggactagttgtggtctgaccttcacaagctgagcttgtgtccggagagtgcatgggcacacagaaagtaatggctattgaaattaactacatggcaactacagggaagaaagaagccttatttgtttggttggattttattttcctaacagtaaaacaaaaactaagttctcaacaaaagactatatatatatatatatatatatatatagtgtgtgtgtgtgtgtaaacaaaccatttggggctttagacttaggcatcccaggtgaccttttgtagttatgtgacatgacctagagaattagtctttgtttctttagctgtgaaatgggaatgttgagtctgtccctagttatttgaagccttaatgtacttctaggtccaggtaacagtgtgaattggattatagtactttttttttttccttttgaaattagatctcaccatgcagccctggctggcctggagcctgctaagtgtggcatgtaggccttgaatgtttgctggtcttcttgccttgactcttgagtgctgagattacaggtgtgagcttccatgccctgctggagtagagtaatgatgggtgatgtttgatggccccttgctgtgtatttgataggtgaatttatatcttattttagagggtggtgcagtgttttcatcactacaaattagaaacagaattcccaatttttgtggggaacatgtaagaacactaataaggttcatacgtgtatggttggtcacatctgatatcctagcatttaggagttagagccaggaaaatcagaatgtttgctatcattaactatatagtgagtttgaggttagtctggcctatataaattcctgtttgtaaaatatccccaactcaaatcccagcctcctacaacaaacaaagaggtgtccctggtagtgtagactagtaaagagtcagtgaaaggttttatatacagtaagggttctgctctgagtagatgactggtgtaggagtggaggtggactaggtctgattggagtcagaaactggaaggttacataggtaagagaggctctgagaatcattcagttgaggaggagactaagaagtaggggcaaaaaagctcccatagacatcttctgtttcttttgtttttgaggcaaagggtaacaagaggtgtagttgaaaagcagggttttgttttgtgggtggtgttttgagacagagtttatgtagtttatgtagccttgactggccttccaggaagactagcctggccataaactcagggatccacctgcactcccaggcctctgctttcagttttgaaatgtttttcccctatgatagtgggttttgtgctgtcaccccaacatgctctccacaatgaataattttgaattgtatcctggactttgtaaatgcataataacttacactaataacattacataacataataataacataattaacactacactctaacttatttctttaaagaatgaccacccccattgtcatgagtggtagaccaatattggttctaatttagcaaggctgcttagactctgtcactacacaggggttagccagagatctgagtagtttctgtacccatttcgatacttcctttcctgggattcccacttgcccatgccagagattatccacctccttggctaagtcaagccatttaagactgcgttttaatttttttatgtttattttggtttctttgtttgtataacagggtcttagctgtatagcccaggctggctttaaactctggcagtcctcttagcatacctcctaagtggtggtgttgcaggtgtgagccactgtgcctggcttacaggaaagacttctggtgtgcttgtttgaggcagggcttctctgtgcagtcctagttgcaggcctgttagacactggagaaactcaaaacctagctttgtaaagtcccagctttgtaaaacccaaagcaacctcaccttcagaacaggcgtgccggctctcgcctttaatcccaaggcaggggggtactcggtgagacctgaggccagcctagtctgtatagcaggttctaggacaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactgatggttgtgagccatcatgtggttgctgggaattgaactcaggcaccttcggaagagcactcagtgctcttacccactgagccatctcaccaagctactcttttattcttttttctgtgtgtatgtgtgtgtgtgtacatatggacagagtgtgtgtgtatgtaagtattcctttttaaagctgcccaggaaaatcgttgtatatgatgaacaactaagttgaacaagtgctataattatggaagcatggctggttcctttctctagtgctgtccaggctaagaggagggagttacgtgatcacgatgggtaagtgggaggcataaagtgctgtaagttgaagaagctgcatgcacaggagtgagatgcatggcaggctggaaggaaataagagggtggaagctgggactgaaaggggcaaaaggccttttctatgacgtaagaggatttagattttgtccagtaagacgtgaacagtttcggcagatttgtagcatgctcaggttgagtccagagctaccaccttcagtcctctgctcattagaatttttgtgagcatctatagagatgtggaaaagcataagactgtcatggaaccatattattagtagtaacctggggtagaggaagaactgggatagaagcagggctggggaatgcaatagcaagaataacaaaaattactcagtagaatgtctaaaacctagtgattagtaagtcaggaaaagtgtattgagatatcttcttaagttgtgcatggcattaaggtattgtctataaagactgttaactgcatgtgatggtctataattacagtcttagcactcgggagactgacacaggagcatagaaaggttaggctagcctgggctatctaatgagactattatctcaaaacaacaaaagtaagcctggcagtggtggctcacgcctttaatcccaacttgagaagcaggcagatgcttatatgtgcaagagagacatcccactggaagggttatattaggctgattctccaaactggcactagtgaacaagagtgtagtggcttgtgtaaagtgatggcttggtttgctgtgctctactttgtgtgagtcttgaatgaaagggttgtttgtgtcctgttgtgttggataagctcgtaggtggcagtacattattagcatgaataactcaagaacaaaacgtcccttatgggaacaccagtgcatctcccaccccttctacttcctctaagtaaaagggaatttatatattaatttcagtagagaggaagtagatatttttcaaatatctaaaaatatgattgtatcagaagtcacagcctaattacaatataaaaaactgcatactaacactcagtaatctgtcttgagaatgactttgttaaagtttttataaacaaaagataatatatctgtcatgctttaaaattatctttaaatctgtctttcagttattgttttatcttgtgtctgctaagtgaacaacaatgctttaacatattaggaagttctttcagagtaatttcattatcttaaaacagcccattaaaaagacacccatgctgggtgtggtggcgcacgcctttaatcccagcactcgggaggcagaggcaggctaatttctgagttcgaggccagcctggtctacaaagtgagttccaggacagccagggctacacagagaaaccctgccttgaaaaaccaaaaaaaaaaaaaaaaaagacacccattttaaaacaaacaagagctcatgccttttatccctgtacccaggatatacagtcaggaggatctctgtgagtttgaggccagcctggtctacagagctagttccaggactgccagggctacacaaagaaaccctgtctcaacaaatcaaaacaaaacccaaaaccaaaaaaacccaataagctttaaaaatattaagtgaggggctggcgagggagctcagtgatgagcactggctgctcgtccacaggctggggctacattcccagcacccacagggcggcttataactgtctgatgcttcagttctaggaaatccaacactagtcttgtcttttagaggcaccagtcttgtcttggacttagtgcccctttatatggcctgggggacacttacacacataaaatttaaataattctaaatctccttaaagtagtagatgaagagatgatgaatcagcagttaagaaccccttactgctcgaagggccagagtttgcttcccagcactcactggacagctcatagctccctgtaatctggctccaaaggatcttattttccacttctgatattcacagacattgtacataatgtgcacttgcatgcacacgatgcacaccaagcttttaaataaagatattaagtacaaggttgcatattaggaagtagtgaagtattaatataaactctttaccttggaaaaaataaaaaccagaaagtcctaagtttatgcctcttagctttttctccccatggttgtgagctaccatgtggttgctgagaattgaactcaggacctctggaagagtagccagcagcactctaacctctaagccatctctccagccccctccccactcttctcaatcatctgtcatcagtgatttgcaattaaaacattaattttttggatgcaaatgtgtgtaaactcatgtgaatatgcagaattactggtcagcaagattatgcctcaaaatatttttccagggattggtagagtggttcagtggttggagtgcttgctaccaaaactgccatcttgagttctgtccctggggccaatttctgtgagttgttcacagggaaaaaaaagcaataggtaaatagctgttaaagggattgtccaatttgtagcagtgtagatttaatgaacaactctcttttaaaatacaaaatatgtttattggaatagttcctacttaccctgaatcatgtgctttcagtgctgctgcctccttctgttagccttgcctttcccctgtaggccgacaggacagtggagcagccaacacacaagcctaccgtttgtgcatgggtaaagactggtcattttacagcagcctgggcatttcatatccaggcagtaggtagggttggggctctgcaccaggcactttttcctgcgcttcctcttctcatctggaaggggatggaggagctcctttgccagaggcctgttcttgtagggagggcttagctaacggacagcttctgcaaaattagttctgtgtttattttaaagatttattttaattttatgtgttttagtattttgtctacatatgtgtatatgcactgcatgtgtgtatggtacccacagaggcctaagagggcactggatcccctggaactggaggtatagacaattacaattcaccatgtgggtgttgagaaccaaacccgagtcctctgcaaaagcaggtctcttaactgctaagcatctctccagctcctctttatttattttaaatgaaaatatatgcatgaaacatcccgaataaacaaaaaaggattcaaatattgaccagaaaaagttcaatgcatttcatttgtgaatgttttatcaatcttttttcagtttgtgtatcagtgttaagtaggaattggaaaatagaaaaaaataaatgagcctttacaatattttgttgttgttgttgttgttttgtttttcgagacagggtttctctgtatagctccagctgtcctggaactcactctgtagaccaggcggccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctttaaagtaactttccgccggcagtggtggtgctcgcctttgatcctggcacttgggaggcagcaggcaggcggatttctgaattcgaggccagcctggtctacagagtgagttccaggacagccagggctacacagagaaaccctgtcttgaaaacaacaacaataacaaaaaattaaaaaaataactttccgaaagcattactgtgttaaataaatttacatcaggcatggtggctcatacctttaatcccagcacttaggaggcagaggcaggtagatttacaaattaagttccaggacagccaaagctctgttgcatagagaaaccatgtcttcaaccatcccccatcaacccccaaaagatataaattctttgaagttttccataattcatactagtttgcttccctaaaaggcttgtatgagtgtttgcctaatgcactagcaaggccatttctcccatgccctcaataaaatggaatgctatcttaaaacaaaatcccaaaccaaaagttttcctaatttaagctggcagtattattttaaatttcatgcttttaattgctaatacgtttttaaatgttcatgatcgttactaattttcctcattaactttatgcacttaaggtcttttctgggtgttaatccctttatcactagaagtgtgtaagactcaatagtcttcagcatagacggtagacgatgccgcagagagagaatgtaagggacaaacagagcagaggagtcagagctgagtccagaaggaaggtggtgactctcaagctgtggttgatcgtcaagaaatgagtatgtaaggctcagaaggtgaaaagagggattacttcccctgacttaaaattaaccattattatgaaatagttttctcagtgtttacttaagtaattctatgttattgagaagttttctatattttcttgtgttctcagctaaagtgactgcagtgtgtgttttctaaagtttagtgtcatgtttcacagacttgaatgtgttgaattgtttttaaaagttacatatttaaaacaaaagaagcataaagtcatgcatgtttatctactagctgcctaagggctgccggtggtggcagtaagggagaacacagttgaggcaaagcccctccaggaccctttctctggttgtgtacataaaactgatagtttcgaccactgtatgctatacctatgtctgtcactaggttttctagttaaggccacgtgaagaactgtggtctgtggtaaaagttaagtatgttgttgggtcatgtcacttgcacttagtctctctggtagccagtcccatgcttggtttaactcagtgtcccaccatttgtggttcacagaattaagaaatggtaggatttagaatactacttcctttgtttagagtgggaggttggcagtacaggagaggaaccggagaacaaaatgattccttccagagcagttgcacccggtaagtctgcagagcattccgagtagtacagtgtgtggctggagctgctgaagtatttagaaaagaactgaaaaggctggcagctctggtaacgcgtcctataatcagtccagcaccaggaaggcagagacaaaaagaaaaaattaaaagtccagcttgggctacatatagagactctatcaaaaaattttagaagagtataatgtgactatttgtgcatagctgtgacacaagtgtagaataaaaaccttaccatattagtgccaggtgtggtggagcaaacctttaatcttgagaggtagaggcaggtggctcagtagaaagtcagcttggtctacaggacaatccagtaaagcagggccacaaaactttaccgtattaaaaagctggcatcaactcagacaaaagtaaagacagccacttaattctctgatggttcatgccagcgaaagtgctcatggcacctgtgtttattcatggcacctgggcacctgtgctcaactctggtttgggtttggatcaggtcctccactgactcccacagatgagttaataatgtgcctttatgcatctatttcctgatacttctgagagagaagggcataggatataggccagctcctaagatcatacttgattcccttgttttaaattatgactctgaaagtatttcttcatgaaatttttcttaaattttgtgactgttttcttaaaaatttaaactttagggaagacatgcaaggaatttgcataagacagcagtgcacaatggtgctggaggagccttatttgtggtaagtaattgggattcctcataatggaaagacttgggaatgtgagtgaatccactgtaatatcataaattgtgggatgttgccgtaactctgtggcagaatacttgcctagagtatgcaggatctggttctgggctcaatccctagtacaaagaagcaactttaaacattttttttagttttatgtgtgagtgtaactgagaacatgtatgtacactatgtatatgtgggagccagagaaggtcaggtgctgttagatccttatgaactgcagttgtagtcagctgtgcgctgcatgtgggtgttgggaaccaagcccaattgctttgtaagagcagtaagtgctcttaacctctgagccacttctcctgccccccaccccccaaaacaaaaccttaatgcctgtgtctttgacatatattgatcaccatggggatttaaatatagcttgctaaatttgttataattcaaatgatgtttggtttcagctgaacctctcaaatataaactaaacctaggaatttaggagactctaggattatgaatgttggttactgtgagcagggcatgatggagcatgcctttgtcccagcacttgggaagcaaatctctgagagtttaaggccagcctcgtctgcatagtgagttttaggacagtcagagctctgttacacagagaaacactgtggggggctggtggggggtggatttaggttactgtttggtaaaattgctatgagagctaatctgatggtcagattatatgactgtaatttgagaaatccttaaagggcatttgtttgaaactcgaaagagtttataataatacagttagtgcattactacataataaatatattattttacaaagcagttggtctccataattttggcttcacagttttaacactaggtggtatttaaaaactagctttagatgctgcatctgtttttagtaattaatttagtatttgatgacaatggtagtaaacttgtatgatgatttaaagtatatacttcaaattattgtccaaagcttccattttcttccctcttttgcttgatacctttttaaaaagcaaaactctgagaacatgaagatgttctgttaatattaagcgtattctgctctttagaaagtaattatgtacttatttatgttgactattgctggctggcctagaactttcgatataaaccaggctgaccttgaactcacagagatctgctttcccagtgctgggattaaagatacttttaatgtttggcttactccactgggtttttgtttatttgtttttcttggtggtggtgatttttttttttgaatatagttgtggttttagttttttgcttctgatgtttatttttatatagggtttcacattgtaacccagatgtctttgaattcttggcaatcctcctgcctgggattcttgacaaactaaacctcctaaatgttagcttgatggtttctctgtagaacacttgtttgggggaagatgtccttttatacctcttgaaagagtacagatatgttgtcccagacatcttggacaatcaaattcctttgctttggggtactgtgcttgttaggaattcacatttagcatttttatttaaaatttttgttggtatgtatgtctacctggatatgtgcgtgtggtacaggtacccttagaggctggaagggaccactgggaccctggaactggagttacgggagttatgtttcctgatgtggatgctgggaactgaactctggttctctgcattagcagcaagcatggcccaccccacgcccccaaacccaagatagggttacttggtataatagaaccctggctgtcccggaactttctctgtagatcaagttatcctcagactcagagatccacatgcctttgactctaaaatgctgggattaaaggcatgcatcaccatgtccagcaacagcaagcatttttaacctctaagccatctctccagcccatatttacattttgtttcttaattacatactgctgtcaatttgtatttgatatttgaattagaatatcccattcttagtgaagctggttaaatattttttgttttgaaaccaaaatgtacgccttaatattttaagtgtttgttttgaaactattctaaaaagtttagttctgctaactttactttggtaaacagtcaacaaataagtatttttagtcattgatgctacaaagatagactgatggggttaaagtagagattaaatgagtagcaaccataaaatgtagtgtatggtagtatttcagttttagagaaaatgttgataattttggaaaaattttttctctttttaaattttttttttttttttttgtatagcatagagatactcctgagaataacccagatactccatttgatttcacaccagaaaactataaggtatgtttaataaacagcatggttgacttatcaagtattcagtgcttccatgcatataaagcaggcacttttccttctacagaggatagaggcaatagtaaaaaactacccagaagggcatcaagccgctgctgtgcttccagtcctggatctcgcccaaaggcagaatggatggctacctatctccgctatgaacaaggtattgaattcaatttgtctcaggaaaaaggaaagattgtatatgatatcttcttttttttttttttttggctttttttttggctttttgagacagggtttctctgtgtacccctggctgtcctggaactcactctgtagaccagcctagtagcctcgaactcagaaattcgcctgcctctgcctcccaagtgctgggatcaatggcgtgcatcaccacgcctggcttgcatgtgataacatagagatcatcatgataaacattagtatcagagtttacttatatagtcatataatagatcgattgattgatctctttagtgtgtttttgtaatacagcttccattcttgcaggaaataggtacctaatatgaaagaggtgtttttctcccccccccccccccaacgccttttgagggaaatgctcactaatggaaatatctcaaatatgtataatttagtatcaaggtgttttggaaattaatgcagtagtgtttcaacattaaaattacagggggaaaaaaatcccttaccaaatgtaatcctattacagcttaggttctagtctagaacagaaatttgtatctaatatgtggcatgttatggcattcagaaccagcacgtgacccacttcagcctccttataaaccctgttaagactcaccagttacaaagtgtgtatgagaacagttccttgctttctgcttgaccagctgtcatggatactcactccactgtagtatgctccgctcatcattctctaaacttgatttggttataaatgaagtccactgttaaggtggattatcacaaaacagaaacaaaagacaaacaatgggagaacaatggactatctaaaaactacaaatgcaaattttacgttgtgttgattgttttatttgcaaatatacttccctaatactgatacatgttacaaagctttatttaataattaaatgcttagttaactaggttgacacaggtggttaatttttctagaaaccttgatgagaactgggtatgtagctaagtggaagagcatttgcccaacaactccaaagccctgggtttaatcctcaggactaagaaagaaaaaacaaaaatagtatgctatatagtgcttgtgaaaattttttcatttgaaattataccttcatttttaatcaatcaatctctctctctctctctctctgttttttgagacagggtttctctgtgtagccctggctgtcctggaactcactttgtagaccaggctagcctggaactcagaaatctgcctgcctctgcctcttgagtgctgggattaaaggcgtgggccaccactgcccagccgtttttaaactcttaaaaaatatttttaagagttaaccttagtgtgtgatgtgcctgtggaggtcagaggacttctctggttagcaaggtcttttacttacatgaaccattttgccagcccatacttattattatttttttttaaggaaaatgtttttagtaatgaaaatatttaggtctcttgttgaatagtaagagtatagagaaaaataaaacaagtaagagtgtaagagcatttaggatactgtactgtttagagttggatacattagcttcaggtgatgtgaacactgcatgtaatcattcttaatgttctaatatttcaggtggctgaagttttacaagtacctccaatgagagtatatgaagtagcaactttttatacaatgtataatcgaaagccagttgggaagtaccatatccaggtctgcactactacaccttgcatgctgcgagattctgacagcatattggagacccttcagagaaagcttggtatggaatacttcatttctttcattaatcccaacgatagccagggtgccttgggacacaaccttaatcccccagcacttgggaggtagagacaggaggatctataaagttccaggacagccagggctacacagagaaagaaaccctgtcttgagataccttttcccaccctcaacccccaaacaaacaaacaaagcaagcttcatctccatacatttcccaacttccaaacaaacaaaattattttatagatctgatattttccacttcaatttttctcacttggtttatacttactcagtacttaaaaagatattatttgcttgcttttatttctttctgcctcaagtctgagcctttaatttatgttaatcattaagaatgttagcatatatcacataaaaatgactatatatgggctagactctgagatggctcaggcaaagagcatgcattggcttcccagaggacctgagttcccttcctacccaacatctatttagcagaaagttcacaaccaccgataattccagcaccaggtgaagcagacagttcttgaggcacctgcacttatgtgcacaaatacacaattaaaaataatttttagagtgtccatgtacttttttttaaagatatttaggtgaattgtattcgacatctgcaattgctctttcatttctttttcttttttaaatgtaaaacttttttattagatattttcttcatttacatttcaaatgctaccctataccctccccctgctccccaacccacccactcccgcatcctggccctggcgttgccctgtactggggcatataatcttcacaagaccaaggggcctctcctcccatttatgctccactaggccatcctctgctacatatgcagctagagacacgagctcttggggtactggttagttcataatgttgttcctcctatagggttgcagaccccttcagctccttagatgctttctctagctcccccattgggggccctgtgctccatccaatagctgactgtgagcatccacttctgtattttccaggcactggcatagcctcaaaagagagagctatgtcagggtcctgtcagttaaatcttgctggcttttgcaatagtgtctgggtttggtggttgtttatgggatggatccccaggtggggcagtctctggatggtccttccttctgtctcaaaaatatggaacgcttcaagaatttgcgcgtcatccttgcacagggcccatgctaatcttctctgtatcgttccaatttttgtatatgtgctgccgaagcgagcacgtccatgtacttttctagaggagccatagaataagtaacaacatagtaggactatttcacaaggtaaacagatacagctatagcacatttataaaataaaataaatgagtactttcagtactttccataaaaaaatcgccattgttgcttctgcttctcctcttttatttttttttttggagacaagatttctctgtgtagccctgactgtcctagaactttctctgtagaccagacttcaaactcagagatctgcctgcctttcccttggagtactgggattaaacgtatatacccctgcctgcctgcatttatttttgactatgaagttaaaacatcttttaattttccttcttgtattgaagaagtacaggcttcattcatacttgaggcaagtacacttaatactgacttgcattctcagccccattctttacttactttgagatagggtcttactgagttgaccaagctgttcttgcttgcagtcctctgactctcaagtcgtagctggtcttcgtcatcagttggggatttaaaaaaaaaatatgtctttgcatgtcacaaatacatttgggcaacatcaaagtatataaggctgaaagatcagctggcttcctctaaggtagagattctggtaactacttggtatatagcatacaggctttatatcatttattatttagcatataaatgtaatatatgtgctcttatgtggtgtaactttggtcttcatgtgtagcacagagtgttcttgttttttgctgttaaagacaagagtactctagtaatttcatatattcatacctttgaatgtttttcatgttgtatattaaaatcatttataagaaattgctgactcatgcttgctgtattttgccaatctcttcccttaaggatatgagtattcattttccttacctccttaataatattttgaatctttgccaatctaatggtgtaactgtgttattagcagtccaattggttactttttaaaaaaaaatttggatattttgtttacatttcaaatgttatcccctttccgtttcccctctgcaaacccccatcccatccccccttaccctgcttctattagggagctcacccacccactcccacctcaccaccctagcattcctctacactggggcatcaagccttcacaagaccaaaggcctcccctcccattgatgccagataaggcctcttcagctccttcagtccttcccctaactcctctattggggtccctgtgctcagtccgatggttggctgtgagcatccacatctgtattgtcaggatctggcaaagcctctcaggagacagctgttatcaggttcctgtcagcatggttacttgttattttaatgattttttttgttgtgtactgtacccttggtggccagaagggggtgttggatcccctgggagtggacttacagatgtttgtgacccacaactgtttgggtgctgggaaccaaacccaatcctttacaaggacacccagtgaatcactgagaagcctccatcccaccccaccccaccccacctttttttttttttttttaagcttgagaactttttttttttttttttggtttttttcgagacagggtttctctgtatagccctggctgtcccggaactcactttgtagaccaggctggcctcgaactcagaaatctgcctgcctctgcctcctgagtgctgggattaaaggtgtgcaccaacacgcccagctttgagaacaattttattagtttaaaagaaaagcccaaatgcaggcaaactataaatatccactgctgcctgtaggagtgagacagagaaaaggtagagccatgatgtttgaggtaggctggaggtcagccatgtggcagacaagcagctaggtggtatgggcagcaagttcagtcttagcacagagtgaatgaaaactgtgagcactggcctctaggtttttattgattttaaaggaacaagcttactcaagaaatagcttgaagctaggcagttggcttttgcctgtaatctcagacttctggaacttaagccaggagggttgtcatgagttaagaggccaggactgagcttcagtgtgagaccctatctccaaacaaaacaacaaaacctaaaagacaaaaaatcaaaatgagtattatgttgttatcattatgtttattttttgagaccagatctctcaatatatagttcaggctagtgttgaacttgaatcctgtttctgctttctaagtgctgagattacacatgtataccattatgcttgggcctttacttttttttttttggtttttctctgtgtagtcctggctgtcctagaactggttctgtagaccaggctggccttgaactcagaaatccacctgcctctgtctcccaagtgctgggattaaaggcgtgtgccaccactgcctggaggctctttacatttttacagaaatttaatgcatgccaatactcctatatacctctataacatattgttgatattgtcatttttattaaacaatattgcttttatgctataatttatttcttttaatggctatttacatttttaggaataaaggttggagagactacacctgacaaacttttcactcttatagaagtggaatgtttaggggcctgtgtaaatgcaccgatggttcaaataaatgacaactactatgtgagtatccatcccacttgataataagctaaagttctgaagtatcctatttaatatattttatttcatgttcagatactagttcttgagatactcattagaagaaactactagtagtatacgtatctagatggttttaaaagaattatctttaaaaatttcttttttctaccggatataaatttgagttttaattatgacaaatttagtcattcacatatagtagaaacgaaatagcaacactttagagcaattagataatattgtcattatcattatttgcagaagaaattatacatataaacacctcatctttttctctctagacagtatcataaatttagtgtgtattctttttatagttttaaagttttttttagtctgtatctatagtaatatgtcattgtttgctttaagttttttatatagatgaaatatataacctacttctactgctttatctgtatcttgaaaggtttgttttgttttgtttatctttttatctttgacctgtaaattttctggaggtattcttaatatccaaatatgtggagttttagcattttaaattacttgctgcccctattgtatcatgattttctttcttttttttttttttttttttttttccgaaacagggtttctctgtatagccctggctgtcctggaactcactttgtaaaccaggctggcccggaacttaaaaatccacctgcctctgcctcccgagtgctgggatcaatggtgtgcgccaccatgcccagctcatatatcatggttttctttttttttttttttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttctagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcagcgtatatcatggttttcaattatgattttcttagaaaatagtttatggagattctttgaggtctttgctgaagatagcattttcaagaatggactttgttctgtcctactcctagagatactattcgcacccctaaaggctgacctctttataccttttacttaacccattccgcagtgacatgggttccagcctagacattttctttgcaggacagtttactttctagtttatctttgtatttaatgtgtagatttttttgattttaactgtggtttggttggtctcttatgaagacttcttttgtgctgatctggggtcctgctccagcccttcttggctattgaaaacttgaagagaagtttgtttggtgtttcttgctgaaatttctttgagggttttgttttgttttgtttttgcctctgttatgtacatctcaaacaggaattagtcagggctttataagaagcataaattttgatatagtagcccacaggccttggtgtctaagagattttttttccctttttttcaattagtagttagagcttgattcaggatagtaggtctgtacttatcaggcacaacagtggttatcaggtgacagataatcactctgacccacagtgccttttcaggttagcatttcttttattctttggtgttttcctattttatattttcttattgctgtgaagagacaccatgacatggcaactcttataaaaaagaaaacacagttggggccttccttatgttatggtttcagaggtttagttcattatcatcatgaaaggaagcatggcagtggcatggtgctggagaagtagttgaagctacatcctgatctataggtagtaacagagacactaagcttggcactgtcagtgacacacttcctttcgcaagcctacgcctcctaatcctttcagctagttccactcgaaggtcagtgagtgagcatttaaatagaggagcccaggggagccactcttactcaaacttcttcttcagaacaagttcaggttgagttaccagtaaaggactcggatgactcctctgaggtactagtgaggccagaattaaaacacagaaagacacttagtttctccctttccagctcagtcttaatatatatcgcattatatattggaattactcagttatagagatcttggtaagtaagaaatgaattcattgtaaggacttacagatttttttttttaacagcaattcgttaacgtcttcaatttttctccaggaggatctgacacccaaggatattgaagagattattgatgaactcaaagctggaaaagttcccaaaccagggccaaggtatgcgttcatttatatatataaactctgatggcataacctaccctgaactgcctttcacagcagcggggttttaagagttttgctcattcataggagacaactggaactttgcatatctaaagttctcatctaaagcaagattttttttttttggtaaaaaatccataaaatacggctggggaaatggttcagtgttctgtccatgcagggctagggtgagaccgggaatcctgtgagagaggtagctggccagcctaactaaaccagcaagtttacagttcagtgtgatgcagagcataaggtagagagtgatagagacagacatctaacgctgactttgttcccccatgtgcacatacatacaccacacaaaaacacatgtgcaaacatgcctacatacatctcacacatatatgggaaaaaactttgtaagataattatctgtgacctaccagaatatttattctgaaagagaatttccttcaaatagaaattgcttaaaagttcatgttactaagaagattgatctgaaattagccttcctcttattcccacctaaagatccattttccctttcaatcaatacaacattatttaaaacatgttttaaattttgatcatgtataatgtatatgtggaggccagaagacagctttgtggagttgcttctctccttaagcctgtataggtttcaggttttgaacttgggttgctgtccttatcaacaaccactttttcctacagacccatgtcattgaccccagacaagatgatctttaattattacttttcttgaaatagctatcttgtattctccctatctttttgtcctatttaatatcacagatctttagttttccttatgtgccatagtttggtctccatgggatttctagttggcttgtgaattcacagtgatacttaaaactaactgtagtacagtcagtcatatgtcacataaccagcaatagacaacagacacaatgaagtccataaagttacatcaaagctgaaagtgcctgttaatattatttcgagataaggtcttacgatagccctggctagtgtggaactcactatatagaccaggttagcaacttaaaaacgctctgcctgcctttgcctctggagtgctggctgggattaaaggtggccagttttttacagtaaaaatttacatatgctaatcactaataatcattacttgcttttcttttcaggagtggccgcttctgttgtgagccagctggaggccttacttctttgactgaaccacccaaaggacctggctttggtgtgcaagcaggcctttaacttgtattcaactgtaaaaaatgtcactggacaaataaaatatgaacttccctacataagctttattcggtttgcttattcccacctgtacatcctggcagtaatctagtaacttgcagctgctaaatattatgtcaaaacaacaggaccactatctcggtctacctgtgaagacctatcattataacagaatcaagttaagaattattttagtgttgcccattcatagagccatgtcatttttatcagtgaagtaaaagttttgcaaaacttaaaatacatttttcctttgtatctttagacacagccaaattgttaaattttttataagctttatgtcaatgttccctttaagcgttttaacatttaagagcatatagttgttactgaagtttctgactggtaagacctccctatcagtactaccggtaagagaattttctcaaagtattccatttatgtttgctatctcattctgtagccctgcttgtatgtttaccaggctggccttcaactttgggtagttttgcttctgcctctcaagttctgggattgtggtaaaagcattatttataaaaagaaaagttaaaataatttgatatttctttagctatatttatttattttgatacaggatctcactttgtagatcagactggactagaactcagagatttagtaaagatattcaaacccaccatacttgaactttagctatgtttttgtttttgtcgtttgaggcatggtttggccatctttggctatatttttaacactggaagcacctaagaactaactggtggagttggtaggctggacaatgtgtttgtatgaataaaacattaccttcaactcaagaaaggaggtaatagtgccgtgcttctgaaaatgcagaatagaaatagttttcattcctggaataatcagattgcttcaggatttatcaaagtcagtgaccctacagggacctcattatagaggtaggcactcaggaggcagaggcaggtgatctcttgagagtttgaagtcagccggttctatgtatggaagtccacaccagacagaactaattaatgagactgtctttttttttttttaagctagatttgatttatattatgtggattagtgttttgcctgtgctcgtggtgtgcaccaaatccagaagagagcagtggacacccaggaactgaagttacataaggttttgagtggtcttgtgggtgttgggaacaactgaatctaggtcttcaaacagtgcttttaaccccagagccatctctccagctctgcctatataaaaagactaactggttgtgagtgcttatgatttagggtctaaggtaggtctttaaagttaagttttcaccagaaatatagctctcactatacaccactgttgggtacttggttggcatgagcaagggcagagcttcagtccccagttcacacatacacagatttctctagaagactgttcatactgaaagttttttatagctgagaacaatggaagacaatctatcctgatttttttttttaatgaaggtttatgtccctgtcaagcccaaaactcacatcagaatttacagcttattattgataggactgtcttaaaatcattaagatactaacggatactgaaggaggccacagttaacgaagagggagaagatggtttcctgtggagtatgtaacttcttagggtggttaaagcacaacggttgcaggctaaccgctgtagattaaagtattcagaaggaagtctgaggacaagctgctgcgatggtaaaatttcctcacacgccctatgagacttagtaccacaggaacaaatttggtgaaatttctgctcagaaaggtcacaggatcgcatggctagaactgagcttaccgatgcgttctttgcaagcagtgcttagagccgtgctttgggaacagagtgcgtctggctgggacatccctcggcccgcgccgcacgaagcggctcagtcacgcaacccggacctgccccacagtgctgcggtgccctcccgcccgcacgaccaccgctaacaaaaccctcccggtttccggctggttttgccgtcccaactcaaaccctgcaaaaatatgtgcgtttcctccgccgggcgccagcacccatgccgccttttgcacatctccggtggtggtgactgcgcgtgaggagctccccggccgacggctcgagggctgctccgactcccacgcggctccaggacttccggccccctccacccgctccgcttcgctccccaagaacgccacccgccgccgcgcgctccgctcctccggggagcccagggacgggcgcgtcgggggcggggcacggcggtcacgccgcccgtcccgtgcctgcaggagtcacgtgtccgcccgggtcacgtgctcgcgccgcagccaatcgcggagaacgctgtccaggagcaaggaggctgtggtgagagaccgaccaagaccggagatgtttttaagcctggccccggcggcatcaggggctgttgcagcggcgacggagacaccggcagcggcggccacccggaggtcctatttcagggggtgaacccttctgcgcccgctgagcctcgggtctgtgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgccgtgccgccgcgcgctcccggtgccagcggcgctgcgtgcgcggttgtcggagcactcggtgcgggccggggcgtaggaggcgcgatggtccccgggagaggtgcgtgaaagcgaaagagctgcggctcgccggagccagttctgtcctaaatgccagtgcgacctgcccttgccgcgttgagcgatcaggtctagtttgtgccagttccgattggaatgatgttcagagacccttagagcgtattggaatcttagatctggtttttggagagtaagatggagatgacgcatccttcaggatccacggcgttgaataaaaacgctgtacaaagaggtcaccgaagcccagctgacagctgttttaataattacagcgagaatagttgaggatggaaatgaacagtattgcactagttgagtacgtcggaaacatttgaagcagtgtggttgtagggactgtaatttccgctggacaccccttgaactggggcgaagtatgttgcaaatccggcgatcagtgacgctcagggattatcgttaattctgtggttgagacgaacctgcattctcagccatgtgtttcttcttattttaaaatggcctgagtcaattataaagaaagatgaactatcccagtaagtcatctgttcattaaaaacatatgcccaagtaggcctttaaaaatcttgcttactgatctttttttcattttcttaaagcgttacacaaaggctttcctggagattaactcagaactgccaaaatgtgctctcttgatgccaaatggtttaaaagcaaaaattagaatcaccaatgtgacaatgaagacattgttgtagttccctttaaaacgtttcagtttgacatttaatattttaatatattttgtttacatggtgaatgtggagggcagatgacaacttcctaggagttggggttctcacctttccctgtgtgggctccaggcaggctcttaggcttggtggttcgaacctttatgcgctgagccatcttgacctccttcagttaacctcctgagagcgctttcatttggattaaaagcaaaaaacgtataaaagtatgtaatgcttctccctgggtttatagatgcagagagaaaggctttatttactacttaagaatctgttatagtcgatagaagtactaatcgaatttctaacactctccaagacagcttggcccaggacaaacctagttgttcaacgtatgtgttctgttttagagactggcaaagttctctggaaatgaaaccaggggtttaagtgtatttgtggaaggaatattagaattgaaagttggaagctgttctcaatttgttacagtttgtgtgttttacaattgttaacatcatctatggactaagggcctctgagacagttggtgatgtctgggtgtgcaccctatgaagtgaattggaagaagagttaacagagcaacactgaaagaactcgggtgctgaagatgttctgcagtttcggtattggctctttaatatccaggaaaaaaaaaaacaaaacactggttggactttatctggtgacagtggaatatgtgggaaagaagctgctttttatccagattacagagttgtggaagtgtaacttggaagggaaaccctgaatttcatccccgccattgcatgaaccaggcttgttgttgttttatgttattatgacaagccactgaattacatccccagcccccaaacccccattttaaaggctttaaaaaaatacataatttattttttattctgtgttccttggtgtcttgcctgcacatatgcctgtgtgagggtttcagaagccctgaaactgcaattacagacagttgtgagttgccatgtgggtgctgggaatagagcctgagtcttctgcaataccaaccagtgctcttaactgctgagccatctcttgagccccttaaaggcttatttttaattatgtgtctgtgtgggtgtgtacaggagtgcagggtgtctgcagaggatggaggtgttgatccccagagctggagttacaggtgcttgtgagccacctgatgtggttgctgggaacaaaaccaacacccatgcccttttagtgtttccagaatgggtcttgctaaattgagtagacacacacactttccatccttcctgtctcagcctcccgagtagctcagattaccggcctgctggactacttctgggttttgttaataacattaatttcagtctgaaaagagaatggttagtgagatgagtcatttctgttgttgtaagatcaaagcactttcagcacatgtaaggttattggagtagcatcatttgggtagcgcttcctttacatttgcaggaggttgctccagcattgttgctaacaagacatatttgttagcagcttgtgtcatgtacagggcacattggagagttagccgtagacctagccgcagcctcacactttgtggtccacgtcactcacttttcagatgaaaaggtaaaacttggccgtgactgagagagagttgtctgccttgctgatttgtctagaagcttcttactgtgagatgctccgttctttatttgggagtagttgtgtgaagcagaaggaagaagacctggaactagaactgagaaggtctggatttaagttcttcattactttctggtcttgttcttgttttgacaaaccatgtaacattcagaaccttgcattctttatgtacaaagaatcatcccctggggctgtagacggcccacttccatgtgtgaggcctggccagggccgtcaccaccatcaccaataatgataatgattttcttgtataacgtaaaatgagagcgctatagaaagaacgttgtacactgggagccttcatacagataggcgtgatgctgccgcttttaaagaaagtgtagtccttgaggtgtaacaagatgtttcagtccctaggtttttccttagccctggcgttattattttgtacacctgctattttggagattataattccgtgtagatacagtttttcccggtccccacttagttctaatcttagtaaagctgcttatgaacactctaaatattgctctagccctccgatttctcctggagagtataaagttgctccacacagcatttgaaaacattcttgttatatgctcatgcatgcataatttgtttcctttgcagacaatggcttttaaaagcaatagtgaaagtatcatagtagtgatgttaatttgtctctcactgatttttagacatgcagtagaaggaaataaattttctttataaactcagttttgaatagttcatatttttggtcatctagtggttctaaaatacatagaagtgctgtggtggcttatgcctataataccagcatctaggaggctgagatagaaggattctaagccagcctatccacagcttgaattaaatgtcagacctgggttagagtgagactctgcataaataaacagataagtcttaaatttatatttgtctatctgtcatgtcttttctcctcctcttcttttctcttcttttcttctctgttttctcttcttttcttttgagagagagttatcttatacagccctggctgacctggaactcactgtgcagatcaggcaggccttgaactcacagagatccatctgtctctacctctctagtattgttgttttttttttttttttttttaggtaaagtttaatttagtgttttcatttgatattgaaaattaataaattgatattataatgttgcctagattatcagagcacgtgtcaccttgaacataaaaaatattgataatcaaccaagtggtggtggcgcctcatgtctttaatcacaacactcaagaggcagaagcaggtggatctctaaattataggctagcctggtctttagagtgagtttctaggacagtctgggctacacacacacacacacacacacacccctttcttaaacccggctttccctcctcccaaaatgcattggtaaaacatttactgagtgctttatgggagtctttgttcaaggtttaagtgcaacatttcaggtaattttcattagtctaaagacaaatcctattctaagatgacaaattaaactgaggctatgaataactatgagatttagggatttacaagctaagtagtagcaattttccatgtatatcttagccatttctcggttgtctctctttagttaagaatggttagctggttttgaagagctttaaggtagtatttattaaattttggattttatgaagaatgcttgagggccagctgttccaccagctgggtggccagaaaggaaaatgaaaataaatattatataagaatactggaataagccaggagggtttttgttttgttttgtttttgtttttgtgagatacatgtgtgggttgttctccatgtcccccatgactgttaattctggagacagatctcagggccctggtcagagacacactaggccatgtctgcataatattttgtcatgcactgtttgttatctatgagctgcatttccagcccaagatgaggacttgccaccaagtgtgaggtctttagttggctctgtggtaccctgtggcggacggagagaactggctctccaaagtggtcctctgacctccgtgcacacatgtagatttttaaaatatgtatttttaaaatatttagtgtagtgtttttcaaaattcttaaaatataaatgttattttgtgtgggactgctaaagagatggctcaggggttaaagagcacttccagtttgtccagaggacctgagttccattcccaacatccacatcaggtgggttacaaccacctgtaatttaagctccaggtagtcagttcgtaccccaccccctaccccaactatcacacacacacacacacacacacacacacacactcttaacattgttttccatagctgaacccactaacagttgttcattgatttataaattgattaaaaatatgtaatagtttgcttttctggttatcagtatgtatttgggctacaattagaacagttttcacaaatactagcagtaaattctttgcctaactactttattgaaacaagtgtatgccatatgtggttggtctctttcctgcctagaatagctgtaccgatctaagactaaaaaagaaaagaaaagagaaaagagaagaagagaagagaggatgccttaaaagttacagtggtttgttggcaggcacacacaggcagttcgaggtcagcctagttatccagtaagctccacactagccaagactacatagtgagatactgtcacctctcccaaaccaaaagataaaaataagaaataaaaattaaaaagttagagtggtttgaagtctataaggtttgctttttctttttttttaatttcacgcctatgtgaggcaagatttgtcagctgacctcacaggaccatggacgaatctaggataaacttactggggtaagcctaggctgtcttgaaatttacttccaaatgagaattgtgaacaagcctagaagaatagagaagaaagaagcactaatagctgcggtgatcatcagtagggattagtcaattttcggaaattctccccatcttccaggatttctaaagaccatgctgtttaagcttcacttggacaggacagaaagtagcattttactgtttgtgttcttgttatgcagggtaaacacagggttgtttggtggcctacgacttactcatcctgacctttatcatgaagaaagaaactctttctggctcttgcccgtgcctctgtgctctacagattgctattcagaataaacacaggcttagatagggatcacatgctacatttactatatcaccacactctacttttttttttttaagatttatttattgattatatgtaagtatactgtagctgtcttcagacactttcagaagagggagtcagatctcgttacggatggttgtgaaccaccatgtggttgctgggatttgaactctggaccttcggaagagcagtcgggtggtcttacccactgagccatctcaccagccccacattctactttttaaaatatttatttttttattttctccatggtccccgtgtggtggtcagagaacaactcctaggggtcagtttatgggtggtgtgggcatttccctcaggccctcaggcctggcagcagctgccttactccttaccccgcaggccctcactgtacattgtaaggcgttagtctgtgttgtagaaggtatttgactctagctaaatgaatttggatttagggagtatttatatttgtaaattggctctgcatatccttcggacatttttctctttgttcttctttattcaaacttttaggagttaaaatttaagcaaatactattatactatgtatattagaatttttacattactgagttaacttgggctactgttaaaaaaataggttagctgtcttttaaccctttcatgcaattttgttattagatttccacatctttattttacaaaccatttttctttagaatcatgacatttacagcccatttaaaagccccagaagaaactgtaaactatatcatatcactccacttctagttatcagggtgatgactctggttgttgttgttggttgttgccatgtagcttagataaaggtacttactgtgtagcccaggttggcccaaatttatgacactattcatgctcccaggttgtaaaatttcaggtgtgagccgttatgctgagctgctgctgtagcattttgtatatttggtttggtttgctttgtttgttttttgagacaaagttttctgtgtaactcttgactggaactcactctgtagatcagactgcccctgagctctgagattagcctggctctgccatctgagtgatgggattaaaggcatgtgtccccactgcccagggcttactgtttcctttagcattgcgcttctaggtctatcgatagtatcccttttgtcttaggatttctattcctacacaaacatcatgaccaggaaacaagttggggaggaaagggtttattcagcttacacttccacattgctgttcagcaccaaagaaagtcaggacaggaactcacacagggcagtaacctggaggca

SEQ ID NO: 1970 - DNA, 1011 bp, Mus musculus
agtcagcctagagcggccggggtcggagcatcgcgtaccccgccatgttctccttggcgctgcgggccagggcgaccggcctcgctgctcagtggggaagacatgcaaggaatttgcataagacagcagtgcacaatggtgctggaggagccttatttgtgaggatagaggcaatagtaaaaaactacccagaagggcatcaagccgctgctgtgcttccagtcctggatctcgcccaaaggcagaatggatggctacctatctccgctatgaacaaggtggctgaagttttacaagtacctccaatgagagtatatgaagtagcaactttttatacaatgtataatcgaaagccagttgggaagtaccatatccaggtctgcactactacaccttgcatgctgcgagattctgacagcatattggagacccttcagagaaagcttggaataaaggttggagagactacacctgacaaacttttcactcttatagaagtggaatgtttaggggcctgtgtaaatgcaccgatggttcaaataaatgacaactactatgaggatctgacacccaaggatattgaagagattattgatgaactcaaagctggaaaagttcccaaaccagggccaaggagtggccgcttctgttgtgagccagctggaggccttacttctttgactgaaccacccaaaggacctggctttggtgtgcaagcaggcctttaacttgtattcaactgtaaaaaatgtcactggacaaataaaatatgaacttccctacataagctttattcggtttgcttattcccacctgtacatcctggcagtaatctagtaacttgcagctgctaaatattatgtcaaaacaacaggaccactatctcggtctacctgtgaagacctatcattataacagaatcaagttaagaattattttagtgttgcccattcatagagccatgtcatttttatcagtgaagtaaaagttttgcaaaacttaaaatacatt

SEQ ID NO: 1971 - protein, 238 aa, Mus musculus
SGRGRSIAYPAMFSLALRARATGLAAQWGRHARNLHKTAVHNGAGGALFVRIEAIVKNYPEGHQAAAVLPVLDLAQRQNGWLPISAMNKVAEVLQVPPMRVYEVATFYTMYNRKPVGKYHIQVCTTTPCMLRDSDSILETLQRKLGIKVGETTPDKLFTLIEVECLGACVNAPMVQINDNYYEDLTPKDIEEIIDELKAGKVPKPGPRSGRFCCEPAGGLTSLTEPPKGPGFGVQAGL

SEQ ID NO: 1972 - DNA, 51615 bp, Homo sapiens
  misc_feature (1)...(51615): n = A,T,C or G
caggacggtcggatgagcctttagagcccagacattgtgcaaatagaatgtgaatctaggtttatctagtgaggtcaaccagcaggcatttaggaactgcatatgctctggggagtagtgtccacagagattcagagtcaaagttcagcagaagaggaaattcctctgaaaatttgtgtaaaattgtcctcactacacaaggacagctataaaattttgtaagctcctacaagtctgggactgcagtgggtttaagaatgtgtccattgttttagcatttacctcagatgaaatgctggttagaacaggaagttcactagttcaaccattgtggaagacagtgtggcgattcctcaaggatctagaactagaaataccatttgacccagccatcccattactgggtatatacccaaaggattataaatcatgctgctataaagacacatgcacttgtatgtttattgcagcactattcacattagcaaagacttggaaccaacccaaatgtccaacaatgatagactggattaagaaaatgtggcacatatacaccatggaatactatgcagccataaaaatggatgagttcatgtcctttgtaaggacgtggatgaagctggaaaccatcattctgggcaaactatcgcaaggacagaaaaccaaacacctcatgttctcactcataggtggaaattgaacaatgagaacacttggacacagggtggggaacatcacacaccggggcctgttgtgagatggggggaggggggagggatagcattaggagaaatacctaatgtaaatgacgagttaatgggtgcagcacaccaacatggcacatgtatacatatgtaacaaacctgcacgttgtgcacatgtaccctagagcttaaagtattaaaaaaaaagtataattgacaaaaaaaaaagtgaaggaaaaaaataaatatttttaaacatgcaaaattgtttaaaaaaaaagaaaaggaagttcatttattaagagaaattactccttggtttcaaactaaaatacttaccctcattcattctttctcttcttccttcttttcctctctctttctctccttcttcttctttctcctccttcccacctctctttctttctccttctctctttcgtttccagctttctttcagtacatatatgtactgttttcctgggaaattccataaaaatgacaaagattttctgagtggttctcttatttttaagcaaaatcaatattcacaaagatagcctacttgcataacccgattaagcctcagttggagtaaactgatttttttttttttttgacacaggctttcatttctgttgcccaagatggagagcagtggcatgatcatagctcactgcagcctcaaactcctgggatcaagcaatcctcccacctcagcctcccaagtagctgggactacaggcatatgccatcatgcctggataatttttaaattttttgtagagacggagtctcacaatgttgcctaggctgatggtaaattcctggcctcaagtgatcctcccacttcagcttcccaaaatactgggattacaggcacgagccaccatgcctggccaatatttttaatagataatttcatattgcgtttcatgactcttcttatttagatacaccatgacacttgttgctggaggcctttagctaaacttggaatttctgtaaccactgtacatgtttattaaatgatgctagccctaccactttccattcccctgcgtcacatgcttacacaaagtcaaattggcctgctatggttatcttagaagccagcctttcacaccctgctgtaggtatggtccctgagaaagtaagggcagactctctttcctttgataaatttgtctatcatctctgtcttaggaggagtgatttcctgattctatacatgtaagatatttgtggaaagtcacaaacattactggccaattcaacattcttattccgttttgggtgacttaaaccatacatattaacactagcattccttagatgttgatagatgagtaagaatcagattgtgcacttcataagtacaatggggtggtagtggtggggtgcggggggaggttaccaagaactacggatactgcaaaacaaatcccttaagtaaatagtggaaaatgatagtttattttaagccctttgaaaagttgaaaaatgatgcaaaaggaaagaactcgtctgttcttagtcagcttttgacctttgactatataaacataagaaacacatgagctagagctaggtaactaagcaggacttctctgccagccagatgagcaaaatgaatcttctcattaaggtttatagagcaccactacacaaaactatcacactcaataatttattcatgaagaaggtggttgctaagatcttggcattctcagtaactttttattttttaacctataaaatgaggagattggacaagatgttttctagtctttccttctctaaaatgttgataccaggacccaccaagtcaggctatctcagaatccacacaatagttcctgtcattccactgctctcatagcaaagccccttattatctggcttgaaagttctgtcgtatgtcatcttgccattagcacgcaacaattcacacacatagtatgcaaggccctgccaaaagcatccacgaaggacgatgaaagcctccgcaccaacatcatgtgcctctgttactatgcactgaaatgacctggcaggaagtgggccccagaggaagaaggggaacaacgactcctctaacctttattatcagaatctgtttaggtttgttatgtgccaccttgaccttctaactgctctatagcaatgcttatctttcatttctttcaggtgaaaacatacctccaagaaaccctatttatggcaaattcctgtgtaaccttcaagtgttacacgccctgtgacatctgacatccccagtaagactttgggattccttcctctctaagttcccaattcatgttgcacatacactcgtattataatcttttccctgccagcatgtaaggtcttcccaggaagggctatgtcttttgcctttgtatctccagtgccctagtgcctggcatataagaggagctgaacatatatttgcatagtaaatgaataaatgaaagtcttttctgaccagtttcatcctgctccgaccactctttcattatacagcttagactatttacatctcaccacacaagcatacacagcaaatgaaccactgagatgcaatatgatttttcttagtcaaggaatattttaacgtgcaagaaaattgactatttaaagaaactttacatgaatatttttgtaactggtcaaggaagacatgaattcaaatatttacagggattttaagaagcagcctgagggagggagtccagagctatttcttctgtctagaatgaaaactgcccgaagagtctaagaactggcccatttccctcttctcagcccacactcctcaataccctaaattcaaacccgaataaaaattaatagcaatcaaaagaagtatactctaaagaggtttatatccactaaaaagaaatgaatataaaagagaattattcaatttttcacttttatttttcctttattagactatttctcaaaatgaacatagctttgttttttcttaccataaagtagcatgtgttaattgaaataaaatcaggcaatacaaaaagcataaagaaaaaaatgaaaattacctttaatgccatcactcagagagaactctcattaacattttacctttccatattttttcctatgcatatacagaaaatgtagtaatgttatatgtgatgttttgtaatcttttttttattaagttgccacacattatgggcatcttttctttacaataaatattttcattattatttttaaatctgcagagcaatatcccattgtatggctgtactgttatttaataaattctctaccgatgtcatttatatagcttccaggttttcagtattacaaataacaccatgataaacatttttgtatactttttcagttacttccttaggataaattcatattaagaaaccgaacacatattgccaaattaccctctccagaggctgatcttatcacactcctaccatcaccaatgagagcatgtagctccacacattaccaacaacagtgatcagcaatttgcaaatctatcaggcaagaattacattcattgttgtttaattactttgactacttgctagggaagcatggatcaaattctgatagaaaatttcacttcagctgcagaagctgctaggatcagtcccatgttggggaagtaacgagcgatgtgaatctgataatggcttaggtgacgttctgcttatattatttttttaaaacaatctgttcttgaagtctatgtaattaagttactggctgttttgattttcattttcccttttggtctcgaatatgcaagaataacttgagaagaatctgaaagaatcatgcagaactcactcgctaacctcacgtcccccctcacctcaatgtgaaatgggtctaacacttcagtttaccaatgtgaccggatcattcttctttacatgctccaatttcctgctggaaatacttctctctctctctgtctctcacccagcagtaaccttatcccatttttcccttccattgagttttgactttataccaactggctccctttccctgcaaagcaggactgggcctgcagctcacatttttcattagaaaacccagcaaggcaggcacgtcagtattgttatgtgagggcatgctgagagccagagtgcacgatctacctgtggctgctttaataagtaggatgtgacttaggagttaatcacaatttagaaagcctgactaaagtgttccatagatggagcagacaagttgttagatactgaaaaaaaaacaaaaaacaaaaacaaaaacccaaagcttttctgaactcttactgtgtaccaggcaccatgttcatcattttccataaactgaatgatttaatgttctaattatactttcagaaactgagaaccaaagcttcacaaaggcgagtaagtgacgaggtcagaattcaaatccaattacaaagctcatgattttcattacaccacgtccttgatagtgcctatgtgtgatggtttaaatggctaagaaatcaagaatgagagagtcaaagttcccacatttggtcatccctgtagactttattctagctcccccagcctccagtccctcactccccacccccaacacccacacattctttatttaatggcttgaccactatagttagggccaatttccctgggcttatggtactagtgccaacttagaatagtggaatatatcaaaccaggcagccatgatgttcactatgggttcattacataatcaagccaatttcaatcaagcttgtagggttaggtcagtaacttgaaatcatcgatgtccatgctggtctgtgtccagaaataatgactttgatagtgggaggaagaagaggaattttccaaacagcccccacaattctatcctaaggactctgagaatagttgattgcacatgaggctactttataagtggagtggctccagaaattaacttacgttactgggtgtaaaagatatccattctgacattctcacttaataaatatttgggctaaggataagccaaagtcatgctggacattaacaagtcttttgacttggtgaacagtgtggtgccacacttactggcagttgaattgaaataaagttgaattgaactaaaagcatcttactttctgtaacatcttcaagaaggtgttaacaggttagacactcccttagcacacatccttaatgttttaaacattactctttgcactttttggttctgttcctaggtaatagaaattgggggcacctggtaagtccttgattagtgtcaggcaccagtgggatatacactttctctataggtcatgaactcaaaaagacggtggtctactgtggatgatcccgttagttgcctacctagatttacttcttcagccccttccttgctggcagagctattttgttcaggagctaatgggccccaaactagcccttccattctcctttctgattagtggcttaattatcttaatattgtaatgttctattctgatgatggtgatgatgatgatgaaggctaacacttactaagcatttactctgtgctaggtactttttaaagaactttaaaaggtatcaactcatttcgatacaggagttaagaagaaattgcttaggcagatagtgagggtatgggagtcctcagtaaggtttcccttttaataaaaagcagccgccaatcattttcttttctaacaaagagcagcctgtaaaatcgagctgcagacagacaagcaaactagaagcttgcacaggtgaattctggcagttgtgcccataggaatatactacctgggatgaggcatgttcaaagtggcggccccatcttctctttttgccagcaacgtgtacagtaaggagcagactagatggcactgcccaagtggaaagcccatttgtataataagattagggttgggagaccagccttccccttgctacataaacgttacacctggtcaaaccaatctgtgagccctacataaatcagacactgcctcctcaaacctgcttataaaatctgctgtggtccgcccatgccccttttttcagacgtcttacaaggagctgctctcctctcccctttcttctggctattaaactttccgctccttaacccacccacatgtgtccctttccttaatcctcttggcaggagatgctgaaccctggatatttactccagacggtgatgccacttcaatttcattcttgtaaaccaaaagagatagttctcaatcaatttagaaagtttattttgccaagcttaaggacgcaccctgacatagcctcaggaggtcctgccgacctgtgcccaaggtggttggggtacatcttgcttttatacattttagggagacatgagacatcaatcaatatgtgtaagatgtacatctgttcacttcggtaaggcgagacaacttgagggagagcttccaaatcctaagtagataagagacagaaggttgcattcttttgagtccttgatcagccctccactgaatacaaaatttagtctggctcagtgcatttgcatttttacatgaacaatagggcagagaaagcaatcagatatgctcttgtctcacgcgagcctcagagggatgacatcgagatctgtctgtactttgtccgtaaggaattttcttgtgggcaaattgtgagggaggtatgtagctttttatctttgtagctatcttatttaggaaaaaaatgggaggtaggtttacctgacatagttcccagcttgtcttttcccttggcttagtgatttgggggtcctgagatttattttcctttcacattctcctaataaagccatgaggaaggtaccattattaaaccaaagcccagagagactaacttgcctaaagtcacgcagctagaaagcagcagctgaacccccgtagtctgattctagagtattccctcttaaccactatgtcttgtaagccaatgagacaagaaggctgctggaggaacatctgggacactttagaggtaagagttctttttcttctttggaatgttgtcatttgtacatgatacttggaactgctgcagatatcttgtgtctataataggagtcacggctgagtatgttggagtaaaaagatggaagccactaaacattttgaagacatccttgagcaaggttgaattaactaaccttggagctactctacctctggaattgtttttcatgtgagaaaatgaacccagtatcctttaatctacttgttagaactcctgttacttgtagcgaaaagcactctcaccgatacacatagaaacaagcataattctgacctaagacaaatagaaatgagcataattctaacccttttaggtaggcagaatatttgcactatgggcaagattttcattcagacaacaaatatttattgaatgccttctacttgccaagtatagtgcaagttgctgaaccaaacaatataggaagggcaggtttctccatccatggaggttataatctggtcgtaaatgtagtagtgaaagtgcgggcaggcatattttgggacggtatcttgaggactaatctggattgggagtcagagaatgccctaataaaatccagtaaaagcatgcattacagattcaaaaagaatccatataatgtctatctcatccatcaagtatttgtgacatgttttggctttagttgtataagaacagtaagtatgtgcacaatagtgttaggtgtataagtatttttattttttattttttatttttgagacggagtctcgctccgtcgcccaggctggagtgcagtggcgcgatctcggctcactgcaagctccgcctcccgggttcacgccattcccctgcctcagcctcccgagtagctgggactacaggcgcctgccaccatgcccggctaatgtcttgtattttcagtagagacggggtttcaccgtattagccaggatggtctcgatctcctgacctcgtgatctgcccacctcagcctcccaaagtgctgggattacaggcgtgagccacgcgcccggccaggtgtataagtatttaggtaactttataacaaaatacatttacattaagggccagactgtcttttccttttaaagggaaatactgaagctaatttaggagaggcaaactaacataaaatataaggcaaaggagtgggaaccaaggcatttggtatctatttctagctcactgggcagcagtcctctgtgtcttgaattctgtgatttgcgaaatatgattcataggggttgcaatggaatatttctgagtttttaaactaatgagggataaatttttaaaatccctgtgctgctgtgaatgttctagaaattattcacaagtttattatagcaaagaaaatgggcaaaaggaagggggtgggtacaggacgtgacactccagaaaagaaggcagtgacgtaaaaaatcaagaggaagtccacaccaggaaatagtgctgtgcacattagagctgttactgaataaatacttgttggaatttccagagataaccaaacaaacatgaagaaggaagtgggtttttttttcagctttattatggaaaatatctaatatgtacaaaagtaccgagaatagtaaataagaacgaccatgcagcttctatggccttacttaacggccaacttgctttatttttcacctcccactccccactattctcaagcaaattccagacatcataccatttaacccctaaatatgtcgcacatatctctaatgcaaaagattgggaaccaagacatttggtgtctatggctagcacactggatagcagccctctgtgtcttgaattcgtaacatgtagaataagatttatagtgggttgcaacccgactttatttttaactaacagcaatataagaggaggtggctaatcctcacaaggctctccatgagggaagctcacccctataaatccaggcgggcgcttcgttacccaggagcccaaggtgcagctccgggacgcttcttttcaaggccgggacccctgcagcggcccgtaggacacctccctttccgagcacggactggtccccgcccctcccccgggaagtctccgcccacagggccccagcagcccccgcgcgccctcgctccctcccgtcagcccccgcccctcggcgaagggagcggcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactgggtaaggaggctcaagctgagcccggcgctgccgccgcccttctcttgctctccgtgtctcccttagttttgggcgcaggagagccctgggctctgcacgggcctgcaggcggcggcaaggacactgcggccttagccctcttagggaggccgctgcagccccaccgtgagaagccccgagggagggttgccatactgggaagtgtactcctagtttggtcgaggaggacagaaaagaggggctgcttggtgatatatatatatatgtttgtttgtttttgctgttttgctgtagcgcagaatctaggcctgctctggccagatcagtttcgaagaccgtcgctccgaaggaggcacctctcgtttcaagcctagtgacctcgatgcttttaggttgcagcatactggagagctctggcttgcttcgtgaaggcttagggagaacttcattagggctggaaaagggtggccaatgtttgatttactgcagttgtgctttgcatatcggaaatgctggctaaataaacggtatcaaactaactctgaaagaacggcgccgcaaataacagcacccaattaaagaaccacaggattttagagattaaatgatctttttgagatccaagtacatctcatggtaggcaaggaaattgaattgcagagaagttgaaacactccttcacgttaatctaaaaatgcagatttccagaaatgtcgattataacaacagggcctgttacacaagtaatactggaaagaagccttagttttgtttgttttctaagagtgaaataggttaagtcagttctcagcaagagggagctagtgtatattcattgagaatgaattcagggctttagagttagactcgagtttggatgttagcttaactgccttttgtggctctatgactttgtgctgttaatcttcctcagtttcttcagttgtaaaatgggaatattcctttttacagagttcagtctttcaataaacatttgaagtcttactgtacgtcatgcactgctgagctctagttaacagtgtggataataatgatagtcatttgataactgttttctgtatgccaagcaccgagttaaatatctacattccacatctcatttttgaggctggtattactttttcctcatattacagataaggaaaagatttagacagttcccgttcttttggaattgatagtctcatgtaagaggaactttaaggttgagacaatgtaaaagtacagtgttagagagatgaatagggtcatccaatgtggtttcaaggtgcataagatttttcctgaaggtaatactaacagattgggcatggggtccgagggtattctaggtggaaaggacaacttaaagtcttgttggcaagaaaaagatcggtatgtatgagaagccaccctctgctgttggaggtaaggtgtgttcccaaatgaaataagggagagacaggggccagatattggagctcctggcgtgccatactaaagaatttgattttagaggccgtcaggagtcagtgaaaggttttaaagtagaggaataagatgtggtttctgttttggataggtcactggataggactgagggtggaatgggtttgatttggacccagaaacagggagactaagtagataagaggctcttgcagaatgctaggtgaaagatgatgaggatcagacatggtagaaagaaaagaaattagagtgcttgtagattttgtttcttttgtttttgaggcaaaggggctagaagtataaattgaaaagcagttttaatgaaaaagaacaacttgaggtagtggaggaccattgtaatccaggtttaatgtttctggaactctctttctctccctccctccttccttccttctctctctccatccgtctccccttctccctcccccttccaccctccccccttttttaaacaaatagtacctgatatgcactatgtacacaataaatatttgagttgatgaataagtttaatttttattacacacgtcatacgtgtgtagaaaaaacaatactgagactagcaagtagagtaagctcaaaaaataaaaatcatccattgtcttgtcaacctggaaattaccattgttaacattttgatgtctacacataacagaccttacagacaatttgtttctacaaaaatggaaaggtatttatactgtttggtagcctgctcttttgtaatgtattctgaacagctttccttatcagtagacatttctatactgtcattttaatgctacatagcattccattgtgaggatgttctattacttatacaaccaggcccttctaacctttcacaagtagtgagatttcacattaaacctagcaagtatcaagaaaagtacaagaaaagtctacctaagttcctttcctaaatgagaaacctttaaagattatttacgctttcaaagaaattgcctaatctaatttctgctttgctagctgccattctcttgacgaggcttttcagctcatcattgcttaaaatatggctagaattaagtattagtttgtgtgatcttgagccatcttaatctctttgagcctcatttttcttttctgtaaactgagataatacctcataggtgattgtagtaattgactaaaagttataaattatggagtaatagataatcagaataagtttattcccttcttcagtaattgcccatggtttttctgtaatgttgatgccactttagaacttatcactgcctcattcccaagctgctattgtagtttcgaaggtgagagggttgtggtggcattttcaattacagatgctcctttacttacaatgagatgacatcctgattaaacccattgtaaattgaaagtatgtaaatttcagtttacagtggggttatctggacttaatcgaggagcatgctgaatacttatcattttcatacagttgtaaagttgggaatttgcaagacaggcaattgtaagtcagcgacccatctgtattgtgtattttttcattcatcgaggatattttcctttatgtctttaggcatgattatagctgtcctgaagtttgtgtctggtaatcttagttgatttttttcttgaaaatgtgttttccttttttgtttgtttcccatatgttgaacaattttggattgtatgctgaattttgtgaatgatacgttgtagaggctctagatcctgttttattcctccaaatagtgtgttttgttgttgctatccatatcccttgtgggcagcagatcaaatattggttccgttcttttagctaggctccttggagtctgcagcatgtacatgcatggttcagggttcagccagagatttccgtagaatttatatacagaatgtatagggctccctccccctttctggctcttccttttctaggatttcccactttaccatgtctgttgttccaaactctcactgaggcctgccttcaggctaaaagatgtgaagaaaaaacaaaaacctcattggttttttatgaatgtagactccccttctgtgtctgcctgtttggttgttccccagtgccttcagaaagcttttgtttttataaaatattttgtccagagtttatagttattattcagtggtttgccctgacagtgtctacttagccatactagaagtatgccatcttgtgtggtggtacttttccttccaaattttaagttttgtacaatgaaatgttttccccattccattagagattcttaaacttgattttgtaatgtcccagtgtatctccattgtgactcaaaggactctaaagaagttaatgtaggaaaaacaccccaaaacatttagttttttattcctgctgtaacaaatttccacaaaactttgtggcataaaacattatatttttaaccttacagttctgtaggttaaaagtgacacaggtctcagtgggctaaaattaaagtgtagcccgagcttcattcctttttggaggctctagaggtgaatgtcttttcttggcttttccagcttctagaggctgctcttggccccttctttcatctccaaagccagcaaaggcaagtctagttcttatatcacatcacttcgaccctcctggcattcatcacatatccttccttgcctcttggtaagaaccctgtgattgatgacattgggcccacctagataatccaggataatctccctattttaaggtcggctgattagcagccttaattctcttttgttgtgtaaactaatactcacaggtttccaggattaggatgtggttatctttgagagaccattattctgcctgccatagccataaattagcagtttaaggagagagagaatgaacaaactttagtttatgcagtgaggttcagtaggccactattgcaaactgcagactcggatctttttattagagacttgaactcagtttccatttcaaagtaataaaaagttgactttcctttctctttgggcactgtttagtaccttagtgctcagaacattgagtaataaattacaggtctgttgcccatgctgtataacctattgagtgacagtcagtctgattttccaatgaggaaccttgtcactagtttttgaatcagttcaggaagcatgttataaatcagttgtaggaaatgtctttcattacaaaacatcaaagacagtttacacacattttggttagggggaaggtggctttatctgtcggatattttgctaggtgttaccccattttatgtgtgagatatatgaagattgctggacaaataaatgcccaagatcacacagtagtaagggctgggtttattcgcaagtcctgttttgttttgtttttaatctacctttctgaagttgctcaaacaattgaagttgctaagggaaatcactatgtatggtgaagatttaaatttaataggcactctaataataaaaggtgtaccagtgtaagcagactagggaaatgatttcactttgcttagggaaaagagatggaggtttaggggctttaaaggggtaggagatggaggtttaggggctttaaaggggtaagaggaggaggttaaccttggtcatgatggatgagtggaaggtgtaagttgagataatgctgtaggtatagctagctacatatacaaagacactgaagtgcatgaggtgagactgaaccccgggtccactggatgggcatttcatttctataaattattcttgtccttagaacaattggttgttgcttatatccatgtgggattttagatatctaaagaatgttttctttaatatatggtcaagatggctggaatcattaatgctgttatcttaatctgtaatgcacagtgcctgtaatacctgggctcttcatgcagcttttctataatataaaatttagccaaattacatttgttaattctctcatagtatggtaaaaattacttacattttaacctgaattaacatttttaggtaaattactgatggaactttatttggaggatgtttgtaaaagtcctcctatttctatctgaaaatacagcaaaacttaaattttagtggttaaggcatgtactgaagtcaggaaaatctgtatgtggcatttcatttatttagctgtgtgagctagggaaagtttttcccccttctttgagccttaattttctcacctgtaaaacaagataataatacctacttggtaggcttgctgagaggaataaatggattatagtgtagatttgtagtttatagcatgagatctgacatagagtaagcatttgtatttatgattatccttgaaatagatttcacaattattaacccagcatcaactttgttaaaataaaatgcactgaaaaacttttgtttttcatggaattttttttttttttttttgagacagagtcttactctgttgcccaggctggagttcagtggcgtgattttggctcactgcaacctccgcctcccgggttcaagcgattctcctgcctcagcctcccaagtagctgggattaaaggtgcgtgccaccacacccggctaatttttgtacttttagtagagatggggtttcaccatgttggctaggctggtctcaaactcctgacctccagtgatccacctgcctcggctctcaaagtgctgggattacaggcatgagccactgcacccagcctcaaggattttttttaaatgtaaaattacctagtctgaatgaatgtattgcagaccctgacttttttaggaggtttcagttttcttgcttgagctggcaataggggaggctgtaggtaacaagtcagcagatgttgtgaacagtgagaggaaggcacggagggacctcagaccactttggattcactagagatgtttcatgtgtgcactgtgactcttgcacaggcaaatagatatcttggtggatttaatctgtaaatattagggatcatctaaaaggtatattccttgccttagttggcctctaataaaggaaaaaagaagggtttttgaattgcctgaccttagtcttgtctttctgactaattagattactgcttctgtcagttttgtcttacagcttcttagtctcttattaacttctcttagctggatgcatttataatgcaaatgtctgatagaactgaaaagtgagcttcgttggatggtagtattgtttgaacaacagaagaaattcagaaaaagagtagagcccatgaaaagacaattaaggaatcctattggggagaatataaaactttaatttttgtcattttgagctattggtattgccagtgacagtaaaagggaaaggctggtagaaagagcacagggcccttagattgaaagagcctgggctcaaaatccaggtctgtcactaattgtgcggtatggggcaagttactgtctttgagcctgagtttctctaaatgtaaaatggaaataatgactcactacagattttttaggaatcgacgaaaaaaagtatgtagaagagcttaacacagaggcactcaagtttacttgactccaacgaaaaggcagtcactgttttggcctgcttaaatcttttcttttccttctgaaacactgaaaaaaaaataagctagaattcaaacccactgttaattttgagctgtatattaggttatgatcttatttacttaaaaaagttacttggttgcatgcttttcttcttaaaaaaaggaagttacttggattttcaattggactcaattggaatttcttgaggtatagacatttcagagtctaatgagaagctagattctagagaaaagactagactgtactcaaagaagggggtgggtgggaactcagcttattctttgaatcattccagcctagctaggttgttttttccagttttaagcctggtcctggaatgcctctttatttcaaagtgaaacaaaattgaaatggcccagtaagtagtgtaaagatgttaatgagaacttttaatgttttattcctttattgaaagtgtctgacatagacattacaatgaatgtaaaataggtgatattctttaaacacaccaaaaaaacaattttcaaagccattttcaggccacctgtaacttgatagggatgaataacagtttatgccagttgaaaaaaaccgagagctaagatttatcagtttatcttcactatttagtttgtttctttctttattgtttgtttacttactacttttttgagacagggtctcactctgtctcccaggcttgggtgcagtgcatgatcatggctcgctgcaacctcaacctcttgggcgcaagcgatgctcccacctcagcctctcaagtggctgggactacaggcatgtgccaccatgcctggctaacttttgtattttttgtagagacagggtttcaccatgttgcccacgctgatatcaaacccctggcttcaagcgatctatggggcttggctttccaaagttctgggattatgggtgtgagccaccgtgtctggccagcttcttttattttataaacattatctcagcccttcttatacaactttgaagaggtcgacttcggactttgaaattaagttgctcaaatgttatgctagtgtgtatacgttcaggttttttgcaggaatagaagagaagggtggcaaggattaaaaaaagattaaataacttgcatctttctctcttaacaggagcattgtaagccaaggaggcagggcttttcatttcttatctgcctgcctgtatatatggaggcctgattttcttccttaaactccttggtttcttagacctactatgttcttttaaagctttgatgtcatcaaacagtcaggtggctaataataaggtcatggcctttgtaatcatctggccctaggatctaacataatttctgccaataattagtgatgtgacctaaccttgagaagttttcataactcatttaaatttctgggaataatacccaccttgcaggaaactttaagaattaaataatgtgtaaaaagcttagtgcctgacacatagtacttctaataataatagctaatgatagccaacactaatacagtacttaccatctgccaagcagaatattaagcactttacatgaagtacatcttttttttttccccccgagacagagtctcactctgttgcccaggctggagtgctgtggcacgagctgggctcactgcaacctctgcatcctgagttcaagcgattctcctgcctcagcctcctggttagctgggattacaggcacgtgccaccacgcccagctaatttttgtatttttagtagggatggggtctcatcatgttggctaggctggtctcgaactcatgacctcaggtgatccgtccgcctcagcctcctaaagtgatgggattacaggcatgagctactgtgcccggcctgaagtacatcttttaatgctctcaagaaccctatgaagtacatgccgttatttttctgtttttataaatgaggaaacaggctctagagctgagcttttagccattttgctatattgtctctccatacataggatatttatggaatattagataacagtgatacatcccaccttcagaggtgctagaatgtggaaaatgtgtttattagaaatgatgaaattgacatttcatatactagaacgtgtttggtgttggtcatcttttacaccacactcagcatcagaagggttttttttttttttttttttgatagagaatctcgctctgtcgcccaggcaggaatgcagtggctcgatctcagctcactgcaacctccacctcctgggttcaagcaattctcctgtctcagcctcccaagtagctgggactacaggtgtgcgccaccacacgcggtgaatttttgtatttttagtagagatggggtttcaccatattggccaggctgatctcgaactcctgactttgtgatctgcccaccttggcctcccaaagtgctgggtttacagacgtgagccactgcgcctggccagaaggatggtacttttaaaattagtttggtgatattagacaggatgttttggattgagaaaaagggatcagccagaagacttacagtaatgcacagacatgaaataatgtctgaaatagtggtgatagtaagacagggaaagaactaaagacttcattgggtttttttgtttgtttttgttttgagacagggtctcactttgtcacccagactggagtgcagtggtgtgatctcagctcactgcaaccttcacctcccaggttcaggcgattctcccacctcagcctcctgagtagctgggactacaggtgtgcgccaccacacccggccaatttttgtattttttggtagagatgcagtttcaccacgttggccaggctggtcttgaactcctgacctcaagtgatacgcttgccttggcctcccaaagtgctgggattacaggcatgagccactgtacccggcccttcattggtttttaaaagtttaaatgtaatacatataatggcaaaaaattcaaacagtaagcaaggctacatattatagtatatatacataacagtacagagtagggatacaagaatatgtattatgataaaaaatatatgttgcatatattatatatgttaacccatgatacatcccaccttctaactttccacattctaacacctctgaaagtgggatgtatcactgttatctaatattccataaatactctacatatggagagacaatacaacaaaacagttaaaagctcagctccagagcctgtttcctcatttgtaaaaacagaataataacagtatgtacttcataggtacataggtacttgataggtatttaatgcttcttgagagcattaagagatgtatttcatggaaagtgtttaatattctgcctggcagtaaagactaaattttcttcccactccagatcttgattcctctccttagagacagcagctgttactggtttcttttatgatgtctctgttgagatattttgatagaaaaagcagtaaaaaatggaaactggcacatttctagattttattgactttcttaagaactttgacagatctgaaattttaccccatttgtaagctaacaagttaacctgcctcagtttcatggatgctggcaggaggcagcatcctgggtcagtaggcagcatgaacttcatgtcagttccctttgacattcatatctcacggtaagggaggagaccacccctcatattgtcttatgcccaatttctgcctccaaaaaaagaagaagtaaaaactaaaaggcagaaatgaaatccacaagcagatagcccggtgccacaccctgggcctggtaaagatcaacccctgacctaattggttatttatagattacagacattgtatagaaaagcactgtgaaaatccctgtcctgttctgttccattctaccccctgcttgctcaatcgatcacgaccctcccaaacagacccccttagagttgtgagcccctaaaagggacaggaattgctcacttggggagctcggttgttggagacaagagtcttgccgaagctcccggctgaataaagcccttccttctcagtgtctgaggggttttgtctgtggcttgtcctgctacaatgggagtgacatggaacagcctaggtgagtgctgtgcatcactgctaagggaccttgagcttgggaaaccctgtctgtaagaaaactcactcaacttttgccccaggagaaggtattttatacaaaaataatagaaaagatggtctgaaacaaaagctgttcagtgctgctgctcaccaaatgcacaaacctaagacccatggaaatctttctaccagcctatttcttcctccttccccactttctttaactaaaagagaaatttatgaattaatttcagtggagaagtagatggttttttaaccatcaaatacattataattttactagaaaaagtataagcattatacatatggatataaagaaaaaataattatgtgcaaatgcaagaatattggcagtatgttgtgtttgacagtaactctttgataaagtcaactaacagcacaattttttaaaaataggtgtagttttaaaatgcagttgtttggatcttttttttttttttttagttattaaatgttttatccttgtgtcagttaagcaggtgataatgctttacaggttatatagtactttcagagaaactttacttaaatctcaaaatagtccaataagaagataaccctgttttataggtacagaaattgaggcttaaaaaaaaattaagtgagttgttctaggtcagatgttagtaagtggcagaatggtaatctaaacccaaggcctcaacaactacaaaaaatctgaaagtctgtttttttcctagagtttagctactttatcctgacccttctcaatcagtagtctgtcttcaacgatttggacttcaaaccacttttagaaatatgtctgtgaactcatgtgcgtatccagagctttacaagtcagcaagagaatgcctcagaatagattttccaatatgtagcaacataagcctaaagaataattttcaagattatctctatatttttattttaagtaaaagtacatgacagatcctggattaatgagaaagggatcaaatattaatccaaaatggaagctattttaatttagacatttggtggtatttaatttgatatacaaggaggttagaaggagaaataggttttacaatagagataagtttttcttatacctgctgagtgttttattttaagtaggatttttttggccagttaatccatgctaataggaaatttggaaaatagagaaaaatataaaaaatgtaaaataagagtcccttatttcattaacatcgtaataagagataagcacttttaattatttatggccttctagtcttttaatcagtgtctgtatttaatgtaattgggatgataatttatgcatttttgttttttttgttttgtttaaccctgattccagtttctacatgattatttttacgacatatttttgttagctacataacgttctagtgtcagaattattagtatttagttaaaacctgctcagattgggtttttaggttgtgtttttgctgcaataaacataataggaacaacatgttttcatgtaaagctttatcctcattttgtactgcaggaaaaatacctaggttagaattactaaattaaaaaatggacacttggggccaggcgcagtggcttacgcctgtaattccaccactttggggagctgaggcgggcagatcacttgacatcgagagttcaagaccagcctgaccaacatggagaaaccccgtctctactaaaaatacaaaaaattatccagacgtagtggcacatgcctgtaatctcagctacttgggaggctgaggtaggagaatcgcttgaacccgggaggcagaggttgtggtgagccgagatcatgccattgaactccagcctgggcaacaagagcgaaactccgtctccaaaaaaaaaaaaagacacttatttaggctttccatatatcatggtaatttgctttctaaaaggctatatgaatttttaagtgtgcttgtttctctatatgctcaacagaatggaatgctatcttaaaagaaaaaagatacttggtagtttgataactagtaatgttattttaagttgtatgtttttagttactagtaagcagtttgaattctgtgaaacttttgttcatgatctttactcattttttaagtgcatttatgatctcttcaggctattagcctcttgtcatcaaatgtgtgtaagatttaagactcatcactgtcaagttaatggatgagttctcagaggcaaaggctttatagagaaaagaagataggagtgtgaactgagccctgaggacagcctgcaaggagtggataaaaagccaataaacagaaaatgttagtgttcagaaattaggagaagactgaatactttccctactcttaaaattaatccttcttttattataagtatacagtcttttctctcagaatttagttaagtaactcactgatgttactcaaaaattgttactcgattaaaaaaattttctgagctaagatgacagtgactgtcttctaaattttagtttcagttaatttttcaaaacaaaaccaacacaatcaaagcccccttgtgcacctctgactgtatccctccctgccttccaattatcctgaaattgatatttatcactcccatcttttgtacgtgtgtctcacatcctgtaccttagtcttttcttgttaattaaagcagatgttccatgtaaacttatttattaatatttcttcaactgaaatatcatttggacctagggtaaagttaaatatactattgtgttatattactccgtttactttcttctatgtttgcctttgaattgtccaactctttgctagttccatgcttggtttaacccagccagtgttctgccgtctgtggttagtagaactcagaaattggaggaatccagaacagtagttgaaatacttgggggcgggggacagggtaggagtggagggtaggagcaagagggcaaagagaaatgaaatgcagctgagagaataatcagattccttccaaagcaactgaacattgtcagtccgcatagcatcataaatagctttctgaaactactttttttttttttttgagacggagccttgctctgctgctcaggctggagtgcggtggcgcgatctcggctcactgcaacctctgcctcccaggttcaggcgattctcctgcctaagcctcccgagtagctgggactaccagcgtgcgccaccacgcccagctaatttttgtgttcttagtagagatggggttttaccatgttggccaggatggtctcgatctcttgacctcgtgatctccttgccttagcctcccaaagtgctgggattacaggcatgaaccaccacacccggccagaaactactttttacggctggagtttcagaactaatttagtaaaggattgaaaaggaaggaggatacagttgactcatttgtacagagtatatgactcatttgtacagaatgaaaacatgtttatgaaggttcacactaagtgaaagctggcatccaagttgattcagacaaaagtgaaagtcaagaagttaatagtacattaattctccaaatgcatgccagcagagcgtggcaggaaggtacacaagtcagcagatctgggttgtcctggttctcctattgactcgtgtgtgtgatgttaggtgggtgaatcttggctttgaatctccatttgtaaaataactctcctgaaatagagatggatagggtagaataccatatttcttaagatcttttataagttgattccattgttgtaaattatgaatcctaaagtatttctttatgaaaaattttttaaggctatgatttactaaactttcttaaaattttaaattttagggaagacatgtaaggaatttgcataagacagttatgcaaaatggagctggaggagctttatttgtggtaagtaattacttagatttctttggaaagaaaagacttggaaattggggtaaatccattgtaaaaatccaaaatatcttaaataccattgtctttgatatatgatggtcatcgtgagaatttacatacagctaattgaatttactacatttcaaaagatgttggttccagttgaacctcatgagtttaaattagtatcaggaaaactctgggaataagaatttatttccagtgaaattactgtgtgagccctaacctgattctcatcacactttgggttctcagtcatgttggcttactgagagtttggagattgtaacttgttgaatcccaaaatgacactagtttgaaactcatggattttagtaatgtagtaactagattagcagctggtctttatatttttagtttccggagttttaactataaatagaagtctgtgaactccccagattagttgcacaatttggaaaggataagatattatatctcccttttctgacaaggtgctgttttcagggattaatctagtataaaggcaatatagtggacttgtgtgatgatttagagttagtggtgtaagaagtagcttcctgctatatatcaagcatcaaattggccacatatttgagatcattgtccagagtgtctgttttctttcctcttttggcttatgtcctttaaaaagcagaactccgagagttaacatatcaagagattcatttctgtattcaccacacatacataacattaattgatcgtaagtgttaatctcagtgtgactcatttgatttcctgttgacatgccatttcttgtcagtttttgaagagggcctgcttctgctcttttaagaagagataaagcttcttgctgttggctattatggaaaacgtgggaaagagatggtgctgtttttttttttttttttttttttttaagatggtccttttgtaccctcctaaagtaatgggtcttaacccttttggatcccagatccctttgacaatctgataaccttgcttttgggaaaatacacatatgttcacatttaaaattttgtgttttaatttcataaaggcttccaataattggtaatgttttggtaattctatcagaagatcttactctctaatgaagctggataacactttttgttgtttgggtttttttggtcctaaaggtacttctcttattctttaaatggtcctttgtaaatttttaaattctgctaactttactttggtaatcatacttatcaaatgtgtgtttagacattctttttgatggaaggatagggtggtatatatcatgttggaattaaaatggagagattaaacaataagtaatagtatagtaatgtacagtgtcattcacacttgagagaatttggataagtctgaaaaactgtttttgttgtgtagcacagagatactcctgagaataaccctgatactccatttgatttcacaccagaaaactataaggtatggctaaattaacattataattaatttaccaaataggtaatattttctagatgtataaaatgatgttctttcttttatacagaggatagaggcaattgtaaaaaactatccagaaggccataaagcagcagctgttcttccagtcctggatttagcccaaaggcagaatgggtggttgcccatctctgctatgaacaaggtactggattcatttttgccttagttctaaaagagaagagattgtgtatgataatttccttttatagaaattactctgatcatctccagtgtcagaatctaggattttggagccctttagccatttgtatgtttccttgaattgtctttgtgtttttgttcattcccttaatgcatagaggtgatttctaaccttgcaggaaataaggaaggcattatggtgaaagagggtatgtgtttttttttttccttttgaaggaaatggtcaaagataaaagattccaaatgtgtataacttagtgtcaagatattctgaaaattaatgtaatatttaaacactagaattacagaaaagaagatctgctcactagtatgaaaatttttaatattttacatctttggctgtaggctgtaagaaaaatctgtataataggtgatatttatacaatttgattatgctactttggaatcaacgacctatagaaatgctatggatgacccattttattcaaagttactctattcatataatattcatttttcctaatagttttgagcagtaatacaaatttcaagtttattcgtatcctgttaatacaaataactacatttgtgtggtgatgtattacagcatatcatttataaagtgccatacacaaaccacatactatttgattatgatgagaatcacataaccattaagctgtgttatataatggaaaatatttttgacttagaactaagacacctgatttttctctgaacttcctcattggcaatgaaagttttgaaccaggtagacctcttctaattattaagttatgatttctgagcggtagtgctaggactgaattcatttctaaatcagtgcattttctacttgactgactataacagagattttgttgtacttcattcttaccactttctaaacttaatttggttataactcttaggctagacaatcatctttctgagagaataggaatgtcctcaatttatctaatagaatcctaaatgcaaattttagatttagtttattgatattttattttatttgcattgtatagtactataacactggtattttttccctatgaaaaatattataaagcaagtttagtgagttactatcctgagtaaacataggtggttatttcttcgataaattatgtatttcttgggaagttacttaacatttttttaaattaaaatagccaactttataatgatttaggtatatgtttctaattataatgttattattttgaaaaaatcatatttttagtaatggtaagcctgttggaaatcttgctgagtggcacgttagcagagcaaaataaaaataaataagaaactgaaagtgaaaacatttaaaaaataagacaggcatggtggtgcatgcctgtagacccaggtactcaggatgttgatgtgggaggattgcttgagcttaagaccagcctgggcaagatggtgagaccctatctcttaaaaaatatgtatttatatattgtcctattatatttagggttggatttgtgtgggggaaaggcaggaagtgtagggtatagggaatagactcaagattctttgcactttacatttgggacttttattttaatgttactgcccctccccccaacccatgaaacacctaaccttacaacaaaaaatatccagaagcttaataattatttatttaaccgtcactaaggtgtagggagatgtgcagaattccaggaaggagtcttttcctaattagacagtcagagcctcattccagatttattattcctttggtagggttccagcatgtatattttgatagagagctccccagattcagggatacgtccttgattcagaactgccgaatgaaatagcacaattactttatctgtcacaagtgagccatgattagatgtcttttgagaatatatttcctttagaattcctaatatgagaaagttaacatacttgtctgaaatgcccgctcttcttttatattagaatatggatatatctataatttttaagaatgccagatagtaagtcttaatgataataggtcacctagaaagttgtagacagaattataaatcacgatagacaaggaccagccctggcaaacagctagaaatcctcgttttccctaacagacttgccctaagaaaagatgctgagttagtgatccccttagtcctgaacaccagaatgtcaaaacaattgttttctattaatgtcttgacgtgaagggttagaaagtactagactatatgattcaactttcaaaagagtattgtgatatgaaatagaagtagtgtgctggattctgggagaggagtgtgtgattgtgtatgataatatgtgtatacatatatgtagagatataaaattttgagtttacatatttaaaatatgggccaatagtgagctttgattttcaacctttttttctgttgctgtaccatttgtatgtaggctgtttggaaaaaattggtgagagtttaaaaaatctaattgcttcttttattggggtttggccatcaattttttgccatttagacagattataaaatgtgagttgacatgatcaaagtagaaattcttaatagtgaaatacttaaagatttagagaaaaagaatatccttttacagaggtgagaagtagggtagaaggaggaagtgctgttaactccattaactttcgggctctgtatggtttaagtgtaagtacattgtctgcaaaaattgaagagtttatatctcccagttatccaagacaagtatgttttctgctcttgaagaacttttctgtttttaccaaattgagacaatattgaaattatactttgtacaacataattaaagctccattactaacactgtaattatcttatttttaaatgtcctaatattttaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggtagggaatacatgatatttgtaacactgataaaaagtagaattgtctctctagatttggtacatttctatctaaaatttccaacttctgccatcttattggatctgtacttacctagtaatattttgtgttactgtgtttccacatctttatttcttcctatttggtattcttcctcagttcttagtgttaaagctgagtttttaattttttcttttttaatcagtatgtttgaaatgcttgtagaagttataaaatattcgttgtttagaagattgtttcacttagaaaattgtttcacttactattctatgacagcatgtggtatattaaaaagtgacccattattgtctttatattcttctaaagaagtcatggaacaaataagatacaagcatagtaagaatgctttgggaagggaaatttgaaacagatgttattacagtagcatttgaaaagtaaattagcattttaaaagtaaatgggcattttcccctacaaaactgccattgctacacttctaactatatatgtcaaatgaagtaatattttgttattgaatataatatgtgcatgttgtaaaaatagctgggtggtattgaaatatataaaacagctgaagttggctcaaacccccccacccccaacaccatcaaggtataaatcctgataacaattggatatattagttgtagattttatatcattttaattattaaatatataaatgtactacatgtatgcttgctttttagactttattttggctgtatttctacagcacaatatatatgtctgcctcatttttttttcctgtttttttgagttgaggtctcactttgtcaccaggctggaatgcagtggctggatcatggctcactgcagcctccaattcctgggctcaagtgatcttctgcctcacccttccaagtagctgtagctatgggtgcatactgccaagcccagctaattgatttttgtttgtttttgtagagaggggtcttgctatgttgcccaggctggtggttgtgaaatcctggcctcaagcaatcctcctaccttggcctcccaagtgctgggatcacaggtgtgagccaccatgcttggcctgcctcatttttcttttacaaacagttactttgatgtacacacacatctttgcgtacttgtcctgttgtatactgagatagtttacaagaagtagaattgtagggtcagactttaccgtatttttcccaaatgccttccctaaatgtatgagactatccattttcttcacatcccttgataatctttgacgttaggagttttctgagtctttgccaaatctgataatgtgactgtgattttagtagtttaattattacaatcaaaatgaaaataatacagcctgatgcactgctgtataacagtaaacactggtgataagtcctctgaaatttgattgcttttaaaggaacaagtccactaaaaacttccttgaatgttaaaattacatagagttttttttttgttttttttttttgagagagtcttgctctgtcacccaggctggagtacagtagcacaatcatgactactgtaaaaaatttttactactgtaaaaaaatttttaatttttttgtagagctgtgtctccctatgttgcccagactggtctcaaattcctgggctcaagccatcctcgcaccacggcctcccaaggtgctgggattataggacggagccactccacctggcctaggatttttttctttttaaaaaacttttttttttttttttttggagatggagtcttgctctgttgcccaggctggagtgcagtggcgcaatctcggctcactgcaagctccgcctcctgggttcacgccactctcctgcctcagcctcccgagtaggtggcactacaggtgcccgccaccacacctggctaattttttgtatttttagtagagacggggtttcaccatgttagccaggatggtctagatctcctgacctcgtgatctgcccaccccagcctcccaaagtgctgggattacaggcgtgagccaccgcgcctggcctctttttaaaaaacttaatagtcttaaacttttaatatacctctataaaaattctttttttttttttaaaccaaatgactattaaaatataacctggtccttagagtgtttatttgtatttttaggaataaaggttggggagactacacctgacaaacttttcactcttatagaagtggaatgtttaggggcctgtgtgaacgcaccaatggttcaaataaatgacaattactatgtgagtatttcaggtaatacaagttaaagttgtatgatgtcatatttaaaacattttaaatatttgattttgtgtccttagatgttggtttctgaattactcatttagaagaaatggttaccataaatatccaggttttaaaaaattctttaaacatttttgcatttaacttcagaagacaaattttaaaactttagattatgaaaaatttaataatttggatattaatacagaaaataatcctagtgtagccaactatcaggacttaactgagagtaatattttgccacattttacttcagatactatcatcatcatcatcatttgtagaaataagctacagatacaggtgaaatactccatcccaaatctttttctcttccttttatccccagagataaccattatcataaattgtgtctatatatgtatgcagctatactaatatgttgtatggctttttaaaaaaattttatagagatggtatcatacctctaagtactgcagctggatctcacaagttttgcagtcttttttgtttttgattgagcgtttctgttttttttttgtttttcattttgatttctttgacctgtaagtttctaaaaatgttcttaatatccatatatatggcgttttctagttatttctttaaaaattgcttgctaccctaattatatcaccgttttcattcaagataccttgttagctcatatttcttagaaatttgtttatggaaattttggagggactgtacttaaggtagattttcttttaagaagggatttgctttgtttctctcctgctcctggcagtactgctggccccagaaaagcccctctccttataccctaggcctctgtttctcccgtgtgaaaggttccagactagcagttttctttgagggacagtttactcttataatgaggttaaagcttttggggaccttaactttgtgtagcttacatggtctcttgttagactctctggggctggctgggtcccttgcccctctaagctttgaaactctgaagcaaagtttgcttgatgttccactttctttctttggttttccttgagaatttggcgtctgggtacttatttcttgatttaaataggaattagacagtcaaggctttgtgtgaagcattgttaagtctaaatatagtagcctgtagatgggtttgtttgagataggtattctttcagttagcagtagttagatctttagggatagatactaggcatctacttaacaagttactacagctactttgtaccttactgtttcttcagtaatacagcatttatttagtatgtacgttgacactgttctactttatatattttctcattaatcctcaaaaacgtgctgaattaggtttacaaataaacaaacaaacttggggaggctgggtaacttgtccaagattactagctagtaagtgatagagccagaactcaaatgcaaatatgtttcaattcagagcaatattctgtattgcctcttcagctgcaggctcttgttgcatattatatttagcagtgtgtactatatataggagttacttaattgttgatgccttggtaactatcttgtgagctgagacagacaataaaatcactggcattagggatttacagatttcagccgtagaaagtaattttgtgccatgcgtggtggttcatacctgtaatcccagcactttgggaggctgaggtaggaggattgcttaagcccaggagttggagaccagcctgggcaacatagtgagaccttgtctctataaatatatcgatataaaagaaagtaatttaaatatgactattgttaattttttttccaggaggatttgacagctaaggatattgaagaaattattgatgagctcaaggctggcaaaatcccaaaaccagggccaaggtatgctttatttatatataggaagttttagtggctcacctaaattaatctttcagataaacttgatttaaaaaattttataccttaagttcataggaattggtaggagctttggatagtattatctatatgaatctcatctagagcaagaataattttttttctaaaaccctgtctgataatcatccgatacctgaatatttatagagaaggaaattttactacaaatagaaatctattccattatttaaaagttcatactgatagaagattgacccaaagaccatctccctctaatttctacctaaaaatccaattctgccctttgaatcaacaaaagataattttagtacctcttccaaatgacagctcttcaattacttgaaatagctaccctgtcttccccttatctttttctcagatggaatatccacaattgtttcattgtttttctcatatgacatagctttggtctccctctgtgggttttctagttggctagtgactatttaatgctttaatgtgatgcttaaactaatcatggttttttgtcttttttatttatttatattttgagacggagtctcactccgtcacccagtctggagtacagtggcgcagtggcacaatctcagctcagtgcaagctccacctcccaggtagaagtgattcccctgtctcagcctcccgagtagctgggattacaggtgccagccaccacgcccggctaattttttgtatttttagtagtgacggggtttcactgtattagccaggatggtctccgatctcctgacctcgtgatctgcccgcttcagactcccaaagtgctgggattacaggcatgagccactgtgcccggcctaatcatggtattttgagatacatactgagcagcacagagcattgtgggactgcctcctttgttccagacattatgcttgtaataattgtgcctaattatatcaactcctacttcagagacattacacaattaactgcacttcataatacctagatctttttctgttcactatttatccaggttgctcccgtcccatacctgtgttacattaattactttcctttcagttatgaacttggattttcacttttaaacaaacccttattccatgtatgtgttcaatcactcaaaattctctcttaatactagcaaatgttctcatggttttagtcataatccctcaaattttttgtttatgtatataaattttttcttccctcagcacatttggagtttttgatgtccatacggtattctaatgttttaaaacagctgtgatgtgctcttactcccgttttaaaatatttttcttaagctttattataaataacaattccctgaagtagaattactaagagggtatgagtggttctagagtttgctctctaaaactactaataataccctacttaatgagaaaatgaggtcagttcaggataacttaagtttagtaaatgctagctggcccctgttgaccattactttcttttctaagaaacgtatactgttcttaacaacctgagcctatagaattgaatttgcttaaagagtgttggcattttcttcctaattcctcactttcttgggtatacccctttttttaggaggtaaatcatttccctggtgaaaaatcattctcctttatggaggcaactgaagtaaaacctttagtcatctatcattacagtatctttcttagctagtgctcctatcccttacttattcttgctttaaatagacactgtccccccaaaaagtacaaatttcataatattttccacaagcttcatctgctttttaggattcaggtattttaaaataaattcatgctattcttaggtttgtacttcagcccataacttctttcaccttttgggtactctaaagaatatctcaagtgcagatttccttgtgaaatccacttgggttctttagatggcccctctcttctgattagatgttttgaattctatagtcataactttggtgttgggcttcctcccccccactcctcccctcacccgagatggagtcttgctctgtcacttaggctatagtgcagtggtgtgatctcgactcactgcaacttctgcctcccaggctcaagcgattctcctgcctcagtctcccgagcagctgggactataagaacgtgccaccaccatgcccagctaatttttgtatttttagtagagacggggttttaccatgttggccagggtggtctcgaactcctgacctcaagtgatctgcctgccttggcctcccaaagtgctgggattacaggcttgagccaccacgcccggccactttggcgtttagaatcttctgctttgcttcttgtgaactgtgggatctatggttcatattaatctagtattactctcctgccacacaaattgatacctgctttgtctactttgttatgtcacattacattaaatactcaacagtaatttttttcacaaatttttttgagtgcctgctgtgtgtcaggcattattttaggttatgaatacaattatgaacaagataaagttctcatatatcttctagtgatggagacagatgactagtgtaatatgtgagtgataaaaaggctacacaataaaatgtagcaggtgttaggggatagatagggagtaaatttagtgaggagaggccgcttagaggtggtaacatttgagccatgacctgaatgaagagctagagggaaccatgtaaagagctgaaggaacaatgttccagggaggggaaagaggatgtatcagggtcctggaagaaaagtaaggtaacagtatggctgcagtgaggtgctcaagcaagaaagcagtggaaggggtcagaggagataagggcccagataagtaatctgggctgaatcttaaatataataaaaactgttggaatgttttcagtagggaatgaaatgagcaatcttaaaatactgccatagttgctatgtggagattagaatttagtagatatgtgggactaaggatttatgagtgattttcagctttttggcttgagcatctctgaggttcctttaccgaaaatagagaagatttgtggtagggcaagtttggggaagaaaagtcaaattttgttttagacatagtaagtttgagatgcctgttaagacatccatggtatgatgctgataggtagatacgaacctggaatatagggaataggttagggctggaaacacaaattggggattcatcagttactaagggtagtatttaaagttataaatctggatgacattatcggggtgaaattaaaatctgttatttgtaatatgaggtactataacattgtattttaacaataagcaggaactaagtactcagttaagcattttcaacaacatctgataataatagggatgttacttatcagtaatcatgaatagtttttcgctgagattttcttgacagtgttctggatttgagccaaatacttcaaaattattcgtgtccgaatctctttttttacttactacctcttatttaaaaagcagacaaaagtctacttaggtttcaataattgcaagcatccaccaatgctgtattatataaagcttgtatttggacatagcaatactagaatgtcttgtcagcatatgaaaacaagaacttttcactttacttacccaatatcttggatatataggataatgacagagactgggatagcaataaccataatatagttatagttattctaaattaaccaaagctgtctaattcttttttattggtattttaataataaatatctctgctctttgaaagaggtactaattgtgcgtctctgtaatgaaaaaccgagaggaattaaactggttcaatagtaactgattcctgagtaccactgccaggtcttaccctggccaaaattagtaaaagactgatgtctatatgtggttcaaaactgcttttgtattatcgttggtgaatgaccactgaaaatattaaagcagtggtaagataatacagttgactcttgaacaccatgggcgttagggacattgattactcatgcagttgaagatctgtgtgtaacttttgactcctccaaaactttactcatagcctgcagttgtctgaaggccttaacaaataacatagtcagcacatattttgcatgttgtctgtattatatactgactgtattcttaccataatctagagaaaagaaaatgttattaaaatcataatgaaaatatatttactcttcattaagtggatcatagtacaagtcttatcattttcatgttgtataggctgaggaagaggaggggttggccttgctgtctcagaggtggcagaggctgaagaaaatccatgtacaagtgaacccatgcagttcaaacctgtgttgttcagggtcagctgtagtctcttaatcttgacattactaaatatttttgtgctgagattgttcttattttcagtgaatttaaagtactgaaaaattctaaacttgttttcaggttactaataggtagaaattttttagtatggattagtttataactcattttaaatccaactttaattcttcatatttagagctaggctacagttccaatgcggttggtagatgactctagacaataacatcacttttggttttttatactaaaagtagggacagtgctggatatatctcagcaatagtaaaaagcactaaacttttataaagtaatttgtctatgtaaagtactttaagccatgaaagtttacagaaaggccaagttttctagaaagcaaataagttaaaatggtacacatacgtatagtgttggaatgactgacgaaccatactttttaaattttagtgaagatgtaattattagatggcattttaagcatgagatatcaggaaaatcattttttgtttagttaagtgaaaaacactagtgtaaattgtggctgtcaggtgagtggatagggctagctcactgcctcttgagtgttctgaggcatgtttacagatgaaagggggggttacatttttagtagattaaacaaaattataggctttattggaggatttttgtagcctttgtagtattttaaggtacactgtgtgaatggcgaggaagggaggtttacagccagacatactggatcactgggactcccgtttttctatacaatgccatgggattgtaattttatggaacaaactttaggaaactctagaccagattatttttaaaattacttccatatataaaattctataatcctgtgaagaactcaggaagtacttacgattaattctcccatttattgttccggaaacttcagtttttataatcttcctaaattgatcctttatgttgataaacagtgtcgatattaaggagctcattaattttggaagatccatatctatccaaactggtaagaggctttaagataccaaatgctcagctttcaggagacgtctaaaatgaaacttttaaatcatattccattctgatatttgatcaagagaaaagttttaggcagaaaagaagaggtagctgagcttaaaccgtaagaagaaacctagtaaaggtgaagaaagtttctccaaaataatttcattgacatttaaagagcagcagtggtgcctatcaataggcaacataaaaaattacaggccgggcacagtggctcacctgtaatcccagcactttgggaggttgaggcggacagattgtttgagcccacaaattcaagaccagccagggcaacatggtgaggtcttgtctctacgaaaaatacaaaaattagccaggcatggtgacgcacacctgtagtcccagctacgtgggaggctgaggtgacagaagcacctgagcctgggaggttaagactgcagtgagccattattgcatcactgcatcccagcctgggtgacaaagtgggaccctgtctcaaaaataataaataaatttaaaaattgcaaaatataatactgttgtcttttttttaaagttaagtatcattttgctgcttactctacaagtttcaggctcttacagtatacaatgactgcttttttatctgtttttgtagtgaacaagacctataatccaaagatattaactaagttctgactttgtagataattgttcattacttagtaacttgtattatatgctgtgacatcttgaaagatcttatattatgtggtgtcactttcctggctccaataaaaaatgattccctagggctctaaagaacagacttaaaggattgatgacacaatgtgaagggcaaagccagagggggttgaaaagatataaactgaacaagttctttctttaggtaaatctgtggcaggaacaggtaaattagcaaagccagggaatagtggtggaggggtgacatacagtaagtctgagctgggctctagaaacagaggtcagacagggcagaggtgagcaattacctgggaaagcgtgtgtggggttgacagacaggttcttctccctctatgctgcctgtcttcataaattgctccatcaggacttgttcttgtttgcttccttttgtggctgctatggccatcctggtttggaaacttttttcagaaaattactactactaatatagtctttataatacataaatacaaactgattttgacttcgctgcttctaagggacattgtcccaaatcatatttcctcaaggaatccagtttctatttccaaatacaatgtataagtgtgtgtattccctctattcactgtgactgtggatcttgatctaaataaaattcaactctaaaaagaaatacagtgctctagtttattaaaacatggtttttaaaaatgttctctggggttgggtatttttgccgtagttctttgctttgattcttgggtagatgctgaatctcccaaatttggtttctctaactgtaaaataaagccagtatcacttgtcttgtggcatcgtaaggattcaatgagctagtgtatgcatactgctcagtaaataggaactattattagggctacttttgtattttttatgtttatggtgaagtctgatgtttttccatatttaaatttaggaagagaaaatcttgcatcagttgaaatgtttgaattaaataatctatgctagttcttagggtaaaaatagttacttaactgggctcttgtgaggtaaccattacaatttaagtaaaaatttacaaatgttaatcattaatagtttaatattacttttcatttcaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctacgtaaacttatttgtttattctgctctgtgtacatcctcatgctaaccgtagcaacttgcagctctaagtattatgtcataatgacagaggaccattttaaagtcttctatctatggctgtgaagacatcattatataatctagttaacagttactctagtgtcacccattttcaatttccagatcgcttttatcaagatcaggttactgtgaagtaaaaatttggttaaattacaaatgttttgctttcccatctttagccacagccaagttttaagttaacatgatctttctataaactttgtcagtgctccctttaaacattatttaaaacacataattgttactgtatttccaactggtaagacctcaagcacactgtaggtttaaggaggatatggtagttgtctctagaagccttttttttttttttttttttttgagacggagtctcgctgtctcccaagctggagtgcagtggtgggatctcggctcactgcaagcattacaggcgtgagccaccacgcccggcttaagcattaccatttttaaaaaagaaaggtccaaaacacttgacattatccttagctattctgacactgcaagtatacaaaaaataattgggtgaagggattggaagtatgattatgtactctgcagtggtatggatattacaacttagaaaaaaggataaacccttttgtgtatttaagaaattagctgtagtacattagttttgcattagccagctttaatgcatgaataatttatattaatctaatcctcgatttctcaaagtcacctgtacttgaaacagactattcactagtaattatgctttttttttttgagacaggctgtgtccccaggctggagtgcagtggtgtgatcttggttcactgcaataccctggcctcagcctcctgagcagctgggagcacaggcaggcgccaccagcctggttaattttcatatatttttttagagacagggtcttactatgttgcctggctggtctcaaactcctgggctcaagccatctgcccgcctgagcctcccaaattgctgggattacaggcgtgagccactgcgctcggctataacgattatttttaagtatgtctttaagattttttttttaattgagagaaggtaaacaacagttaattttccaagtggcacaaaaaagtaacaatgaaaatgtcctaccctggagctctcctgactttctcataggcgactgtttttttctttgtatttcacatcataaataaccaagttaaatgtaacactattccacctctagccataaggtgctctttttctagtcttgttgaccctaaagatttgtaggtgggagaaatcaggaacccaggaaaggaaaaactcctgatctttaatgcaggtttatgctttacatagtaatttgatgggacctcgccgtccctgtcaggtctgaatgtcacttcatctgctgtgatcacacctgaaccctcagttcatcaagacgttaaaggacagtgtaacataaacttgtaactgcatgcactaagtcataaacagacgctgttgttgcagattaacctctacgtaaataacgcgcccagaagggagtgagtacacgctgctgccacgctgcgacggtcaattttcctccggcacccttcctagtacctgagcagctccctctcaaatccccaacactacgtgtgggagggtgcactgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagacagtggctttttaaaagtaatagtgaaagtaatcttagtagcaatgttaatttatttgactcttgctagttttcaggtacgcaaaaggaggagatgatttcctttaaaaactcagctttgaatagttcgtgttatctggtatatctgaaatattcagaaatgttaaaacagtttttgtttgcctttgctgttaagtttgaaacctcttagtgctttcaattgataatcctggaaaccaacctcagtattgtagtattacatagattatcggagtttttatagtcttgaaaataaaggtactaataatcatagataatatttgctgaacacttagaatatgcaaatttgtgttttaagtgaaacatttcaggtaattttcataataaccttgtaaaacggagaggaaactgaggctgtgaacagttatgtgatggatagattttacatactaaataatagatttcattatcctgttttattaaccattgctctgcctctaattaagagtgttggttttcgaagagtttgaaggcggggattcttaaatttcagatttcatgaaaaatgtttgggggccagctattctaccttctgggtggtcaaaaaagaaaagaagtaccttatgggaatcatagaacataggccagcaaccctttttatgagatgctgatatacttgttgctgtggtggtggtggtggttttatattagttgtcagagcacattattcttaccagatacagaaagggccatggttgttcatataatatgaggctatcctagcaaattccactttgctattgatatcatgcttctaaagagacattctttcatcacagtgactgaagaaaaagctaaccaaactcatttaggattttcataagggaatagagccagcaatagaaaatctgctgagtttgtccagcttagaaaacagtatccaagaccaggttttctgattagtgcgatcctccaaaattgtaagaaacttaaattcaaacataagtccttagaaaattcagttgtaacatggagatgcttccaacttaaaggaggtagattatgaagctgaaagttacagggtggaagtcatttctttttctttggctttaaaaaaaattctaaaaatttaaaaattgtgtcatctttggccaattccttaacatctgtttattgggctaaaattgtttcaaaatatgtaatagtttacctttctggttttcagtgtgtactcaggccataactgggaaaaaataacacaaatgttagcaataagtacatttttaactaccttatgtctgttaactatcttattttgacaattaagattaatctctaataatatgcatagattggggaattgttaaccttttaaaataaatagtgggttttttgtttgtttgtttttgttttgtttcactatgttgctcagactggtcttggtcttgaactcctgacctcaaacagtcctcctgcttcaccctccctagtagctgggattacaggtcttagccaccttaccttgctatatagtctcttattgtaacaatagcaaagagttacaatagaactctatagcttctcagatttcagattgttactcctacataggagttttgtcagcattctgacttctaatagagaacaaaaaccatttgtggctctcttttctgcctagaaatagctatattgactctcaaaagaaaaatagtaacttaaaaattacagtgctttgtagttcacacagtgctttttacatctgattctcttttgaacctcacagctcagtagcagaacaaggattgtcagctaatctgatgatactgagccatggattgaatccaggttaaaagtatctggagtaatgttagattcctttgaaactcacttatgaaagagaagcattagcaaacctaaaggaagagaaaggagagacatgcacttctattttctcccaccaaattcatattgtacacaactttctattcttgtttacccgttctgaaacagagtagaggtaaacattaaaaacattccttatacagctttaataattagtagtaatgggccaggtgcagtaggtcactcctgtaatctctgctctttgggaggctgaggctggcagatcacctgaggtcaggagtttgagaccagcctgactaacatgggtgaaaccccctctctactaaagaatacaaaaaattagctgggcgtggtggcgcacccctgtaatcccagctacttgggaggctgaggcaggagaattgcttgaacccaggaggtggaggttgcagtgagccaaaattgagccactgcactccagcctgggagacagagtgatactgcctccaaaaaaaaaattagttgtaatggttaatgatgataaagacaattagataagaaaattaaaatttcataacacatttcctaccataatttgcacaagaatattgtaactaggaataaagccttggcttgcattccagtgttctatagtagtcttggaacctctgagttaaaataaatcctttctaccagagtttaattctcactacttggaagttacttggtaatcaaggaaaagaacttctattgagcttctgtacgctagatactattagatactttcatgtatgttacatgtaagtgtagatatcttaaatatcgagttaagaaaacacttcaaaaagttgttgccagaatatctctaactgggtcttttttactcaagaacttaagttgaaatttataagttataaaaatgttaagtctgttactttgagaaattttttcttgattaagatcagtccaattcactaatatatttatagttgacgtgatcatccagtagtggttattgagccttcagaaattacgcttatcttccaggatttgtaaaaacatctcaggagtgaagagcattctttttgttttgttttgtttttaagacggagtttcacactgttgcccaggctggagtgtaaaggcatgatcttggcgtactgcaacctccgcctcctggtttcaagcgattctcctgccccagctccccgaggagctgggattacaggcgcttgccaccacgcctggctaattttttgcatttttagtagagatggggtttcactatgttggctaagctggttttgaactcctgacctcgtgatccacccaccttggcctcccaaagtgctgggattacaggcgtgagccaccactctctgcggagcattctctttaagctgcagttgaatatgaccaaacaccaccaccaccaccgccctctttagtgtgtttctatttgtcctcatgttattgaaagtaagcaagaatggttgacagcagattggcttactcattctttcctttgtcctttttcaccctttgaagctcttcctcttccttcaggcactagtgctctttcttggaaagccccattgaaaattaatctatacttacatagatacttacatacctatatttgtgttattaaacttaaaaattatattaccactttcattttacattagctaatgcatgaggaaataatcatttgcattttctctactgtgacttgacacatcatatcctgtggccatttttctctttttttcttactcaaaacttccaggagtagcaatcaataatttaaataatattttaacatttttgttagggttttacagcatgcaattattgtatgctattgtttaaagattataataaaaaggttattaattctccaacctccttttgcataatctttatatattagtgattattaatcttctatatgttacaaatattattttatagcaccattgtcccttcaaaaaccccagaagaataggctctgtccaaagtactactaccttattggggtgattactctttatgctcttttattattccattcacactcctagtctaagaatttcccctccctatagcttttgtatactcagatgttagggtgggagtagcagaaaacagaatcttttgagcataaggggaaacatgtagtctcacacttgagtcgtattcattatgaagtgctaatagactggcagaggtataattacaactactccatagtt

SEQ ID NO: 1973 - DNA, 828 bp, Homo sapiens
gtgaacagtgtggcccgccatgttcttctccgcggcgctccgggcccgggcggctggcctcaccgcccactggggaagacatgtaaggaatttgcataagacagttatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctacgt

SEQ ID NO: 1974 - protein, 249 aa, Homo sapiens
MFFSAALRARAAGLTAHWGRHVRNLHKTVMQNGAGGALFVHRDTPENNPDTPFDFTPENYKRIEAIVKNYPEGHKAAAVLPVLDLAQRQNGWLPISAMNKVAEVLQVPPMRVYEVATFYTMYNRKPVGKYHIQVCTTTPCMLRNSDSILEAIQKKLGIKVGETTPDKLFTLIEVECLGACVNAPMVQINDNYYEDLTAKDIEEIIDELKAGKIPKPGPRSGRFSCEPAGGLTSLTEPPKGPGFGVQAGL

SEQ ID NO: 1975 - DNA, 58665 bp, Mus musculus
  misc_feature (1)...(58665): n = A,T,C or G
cttaagtagcccagtagacctcagacttggaatcttgcagcctttggttctagagtgctgatcacaggctctgcccagagacactgaggtttagaagggtacgctggttggttgtttttttgacttctttctagttaatttttgctttttttttggcaagtcagtggtgtggtaatcttgtgtctcagcactgttgccctaagggcagcctctgtttcttctggtggtgaagtaatgcctgccagatttcatactgtgaagatgtgggtttcctcttggaatgagcgaaggaatgatggtggcagtggcactgtcctgtcccggggctgacttcaccctgcagtatagggtagactgactgtgtcctgcatccactccggtgtcctagtcatggaaccatctggcaatctgctctgcagggccttggccccatgttccgttatggtgtgtttgctaaaatatgttgaagtccatttatttttataataatttcatacgtgggctggcgagatggctcagtggttaagagcgccgactgttcttccgaaggtcccgagttcaaatcccagcaaccacatgttggctcacaaccatccataacgaaatctgatgccctcttctggagtatctgaggacagctacagtgtacttacataaaatcaataaataaatctttaaaaaaattttcatacgtattagagttctctagaagaatagaactgagagaatatatatgcatatatgtgtggtgtgtgtgtggtgtgtgtgtgtgaaatttatagagtgtgacttattaggctgtgatccagttattggatattagacaatggctgtgtaccaatggaagggctaagaatttaaaagttgttgcctggttccctgtcacccctctcccactcacctttctctttgtaactagtcctcctcctcctcctctatgccttttggggcaatagcgaattgaattcagggttgcttatatgagcaagggcacagttatttgcaggactctggagcccacaccatggcctcagctctgtaaaaggaagcctgcccctccccacgcatcccacccctgcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaaaatccttagggaagggtggggccttgtaagctccttccctccataacagaactctgacaggcccaggcctgtgtggatgtagtcgcacctgctgtgagtttgagtgaaatggccgcgtcatgtctggaggacagcatccacaacactcctccccttcatctagaccagaaaaggcattgtgcctgtgatggctattcctggttgtcaagttgactacatctggagtgaactacaatccagaaatggaggacacttgatcttgaggtatagtggccatgaaaagtttaggtccaggcaaggcccatgccttaaatcccaggagacaggcaagcagatctcacaagttcaaggccagcctgagacagagtaaattctaagtaaagataagcttaggtcaggtggaggtgtggtggtacacagcttcagtctgggccatacataccttctctggaggcctacataaggacactggagaagggagttcgctcttcttcatctgcttgcacttgccagcacacctgctggaacccacttccacagaagaccagcggaaagacccagcctcttgggactgagaaatggctagatttttgcttcccattcacagctgacttgctgggttagttggactgtggactgtaagtcatcacagtaatttcccttaatatgtagacattccatacgttgtgtgactctagagacccctgagcagtacatcacctgactggagttaacggcggctgcccttcacttgaagatggtgctgggaactgagtttgggcctctaggagagaaaacgtgttctttactgcttctccgtttctcaggctcagggtctgcattcttactactgctttttctggtcttcaaatgtaaacaattgctaataaagtgttccacacctaatcatacagtcagccctgtccgggaaacgaatgcattttgaatagagttgcttcttctccgttgactcagtttgtgtcatgttgacaaaaatcgttgccttttcttagggtttgtttgtttttgtttttatgtatgtatgtgagtacactgtggctgtcttcagataccaaaagagggcatcaggtcccattacggatggttgtgagctaccatgtggtttctgggaattgaactcaggtcctctggaagagcagtcagtgctcttaaccactgaaccgtctctccagccccttgcttttttgttttgttttgttttttaagatttccattggcttttcaatagaaaattatttactgattgtaatggtcaacattttttttttttggtttttcgagacagggtttctcggtgtagccctggctgtcctggcactcactttgtagaccaggctggcctcgaactcagaaatccgcctgcctctgcctcccgagtgctgggattaaaggtgtgcgccaccacgcccggcttgatgatcaacattaataaagagcaataatgaaaactaaaatattttaagttgcatgattaaagaaaatacaaattgtgtgtgtgtgtctgtctgtgtgttggtattctatgcatgtttgtgcatgtatgcaagtgtgtggagattttctgaggtgagatttcccactaaacctgggtctcactgttgactggctggctagcagccgccccgctcagcaccgtggtgacagatgacagtgactgcactggctttgtgcgcgtgctcgggaatctcagcgtggcaagcagctgagcccgagtcttctcttcagcccagaacttcacattttaggcttctctttgttaccaagaaacaaaatcttttttttgttgttgttttggtttggttttgattttttgagacagggtttctctgtatagctctggctgtcctggaactcactttgtagaccaggctggcctcgagctcagaaattcgcctgcctgggattaaaggcgtgcgctaccacgccaggctcaagaaacaaaattgtaagcataaaagcatattgggacaaaattctgtggtaagaatggaaagtgatcacaaaggaagaagaaactgtgtaaaattgcttgctgagtggatttcttccttttttgagaaggaccatttatttagaggacaggatgcctttaagtgatccatgagagtgggtaatatgaactcattccagattcaaattaatgatttgagcacacccaccagatcaactaggaaagtatttacacacagtgcaataatattaaaacgaatcgcctccctgtgtgtgattttattttattttattttttttgctgagtgtatttcttctgtgtcagtttctttacacaactgagaatgggcacctctcacttctgtgctgacaatagctgcagatttgacatctcaggcttttgcactgaggcaggtttgggctagcttggtgttggctgtctgggtctttacatagtatcctggaactcactagatagaccaggctggccttcagctcggagccccacctacctcctccgcctcacactgtctgtgtttaaaatgagcatcatcttttggattttttgctaagaaggacttctctgttctgtttctcaggctccaatcacatcttgcaccaagaaagggcttcatttccgtatcaagccttctagaagagtttgtgggtgcccatgtgcacatgtgcatttttagctgtgtacctcaggtatacctttatgcctgtttttaaaaatcagttggtccctccctgccactatatagtgtaggtcctattctacttgctggtttcataggataaatggaaacttaacacagaaggaacattgaaaattcaatctctagaaacagttccaaaagcagagttgtggagtggggaagtctgttgatgggctctgtcagacactttatagccaaggaatgtcattgttggtgcctgacagtcttggcagctcagtgtggtgttgcacacctgtattcccaatcagggaggatcaatgtaagtacaagacacagttgggccactctgtaaatgataaacactactctaattaaacaattggtctagtcgagctaggtagcttatacgtagcagagcacgagagatgagcctaggcctggtttagatttcccacttctttctcagtttttaacttttatattttagagactacttttcttaaaaagctgaagattaggttgttttcaactactttgtatttcttttgtgtgtagggaggtgggagtcagcagggggtgggtgctgtttgtaactttgtgtttttatacagagaagtgttccattgtgaacagaaagtctcttcatgatccaggattagaaggatgtatgtgcttaatttaacttacagtgggcagcagttttcagtgggcttagaactaggaatggctaggttcccatcgagattccactctatggttagaacacatttagccccggttggcctcaacctcataaccctcctgcctcggcctcaacctcataaccctcctgcctcagcctcccaagtgctgggacccccagggcagtctgtacatagttaagtttgagatcagctggcttacatggcgagatggtctcaaaaaagagaaaggaaagaaagaggctctggttaacagacagtagcccagcgctgcccttgcctggtaatctattcctttaactaatatagtccatttttaggtggagtgatggttgcttgttggacttagggctggtatttttctgtttgttttattactttttgcttactcctttcctaagttcctttcatattaagtattttctgataaatccatttttattcctgtgtttttctctggttatacctttttgtatgtttcaaagattattcccagaattgtaattttcttctttaatttgtgttatcttcaattgagaggtaaggtactaggctgagtatagcttagtgcttgcctcctgggattgaggcctggaacttccagcactttaaacaaaacggtcagagagggcttctgggtaagacacttcctgacaccccgagtcccattcagaacccacgtggtggaaggagagaactgacttgtatcacatgtgctgtgacacctgcatatatacccacaggcacatgcccctgtacatgctatgatagaaacttagtgtgctacttcaataagctgtaaaaaccttgtagtaaacctaacctttgcatttacataacaccttgatgctggggcgggaggttgttattgtttttttttgttttgttttgttttttttaagacaaggtttctctgtgtagccctggctgtcctgaaacttactctgtagatcaggctggccttgaactcagaaatttgcctacctctgcctcccaagtgctgggattaaagacatgtgccacctctgccctgcaatgttgttttatttaaagataccagtactgtgtatatatggtgtgtgtgtctgtgtgagtgtgtatatatatacacacatatgtacagacttttttttcagcagcagtgataggttttaaacaattttagtgacattttcgtatgtgtctattacatatgacatagatatatgcatacatatatcatatgttctctgcttgtattatgggtttggtttttttttttttttttttttttgagacaaggtttctctgtatagttctgccatgttgtagagcagactagccttgactgagtttctcattataacctgtggcaagagcatttgcagtgtgggcagggtaagatttaagtcagttttaagtcatctgtagtcaaagctttatggtcttcattaagatgaaatctatagtcaagaatggatgaaaaagtaggtgtggtaacatgcttacaattccagtatttagaatgctgaggcaggaggactgtgggttaggccagctggggcacagagtgagatcctgtttgaaaagttgagtgtggggttggggtggggacctttaaatagactagggaagataactcaggccagagtgacacccttcctggggccacaatagtagatgtagaagtgagcctttcatcagtgtctgtgccagaggggagggagcaccctttttatggacatgtggccccccgtgactgatagaaggatgataaaagataggagcagatatggctctgtaatcctctaagggtgtgcctttcagatgtggctgtttgatgtatgtctacatttaaattaacaaggatatttatcaaaatagatgtctataggcctcattctagacttgcataatcaatatctgagtatatgatctaggaatgtgcattttagataattctccgtgctggtcttaagcgcagtgacgtttaacaatagctgctaccagagtcttccctgctcttcccaccttttatgaaccagaatcatgtttatctgtgaacccatgtgagactctgatgaaacagtttggtcatagtcatagaattctagagcctgcataaggtgcctgacaagaccatgccagctcagcagcctgacagtatgaaggggaagactgacggcaaataagtgtccagtggcttctacagttctttagttcacgatgaataaggtaccttatgattatagagtagaaatgatgtgaaatttttctgcactaagtaattatttctatatggcttagtgttggtttttaaacccagtttgaagtctgtcttttaatagacatatttagctcatttacaactggttcctaattataatatagttgggtttaaattcctctctggctcttctgtctgcgggttctgtgtctctctcactgcttttatatttttccttctttcctttgggctatttatgggctttattatttattcatctttgatttttaaatatagcagttgttttcaggtttatacattggtgttttaattctggctgggaccctggcctcactagtgtgtctcatgcagcagtgtacctgtgttgctgtcttggtgtgttaggtggatgtgtgtactttgtgctgtgttgtctgggagtgccatgtgttaggtgtgtctgtgtacccactgtatgcactactggtttcaccccacacatttttgcttcgcatttcagacctaatacctttgtctacttatccagttcccgatagctttgttcctccacgtagatcccatccttttattacgtctcctacggaatgtgtgcacgctgccatcagtatttgcatgcttgagaaaaccttagttgacaggtttctggctgttgagttgatcttttctttctctttaaaaatagagttatgtgtatgagtgtgtagtgtgcgtgtatgtatgtgtaccacatgcatgcagtgttggcagactagagagggtgtcagattctctgtacctgcagttagttgttgacctgagtgctttgggagagcagcgagggctctcaaacatggggccgtgttttttagccctccacctccatctttgtcaggattttaaggttgttgctttcctgtcttcttattctgtttttatgtaaaatgagtcctctctagtctaaaagactctgactattgtaagctgtcccattatattttagataagtatattttctttatagtttttgctaatgggattcattgagcctatggattagtagttttcattaaatttggatttttctagggtttactatatattcaaatataattttttttaaagatctgattatttttatgtatatgagtacaatgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggacccagttctggtctgtctgaagacagttacagtgtactcatataaattaataaataaacaagtaaatctaaaaaaaaaaatgtctgacattttcctttggttgaatgatactctagtctgctatgtttattttttgtttcatttttaatgctattttttgaagatccccattaatttcttttgtatttcattgatctgacctagtgtggttttcttctcgttgtttttttcccttcacctgaaagtcagggatttttgaatatttatattcctttcctccctgtcccctacccaagtgttgtgcctgtaggtgtgcactgctgtgcttaggtgtgtattgcatgtccagcccaagctgcacttcacacatgcggcacacttggatcgtttctgtgtccctgtctactgattctgtctttgttgtgagtctgtaatcagtactacgggaatcttgctttagagtctaagtagttacctgaatagtctgaccctgtgtgcttacctgggaagccctggagaattctctcgttaggtggcctgagtagtagacttgcaatatccagtgtgacagagacttagtaggagtcctctcttgatcagactgtttagttcccctctacccttcagctctcagcatggtgtagtcggtcccctcccacagctgctgcagatctgcctggagtgtggacagatgtgcggctgtagtgagtgttttaacacagacttgtctcagccttaactcttcacataagtattttcatggtttgttttcttaacataagcctagtagttgacataggagtatttaatatttgtctagtgaatataaatactaattatagtttgtagttcttctctagtaaataaagccaaacacttccgctttggtgtctttattatagaattgactaactcagtgttccccttcctgtgttttcttcaccagctgttagtgttctctgtgagcatggaaatttgaggttctttgttggttggttggttttgttttgttttgagacaggatctcgccatgtaagcccagtctgtcttagaactcattatgtagatcagatcaggctggtctcaaactcagagttctgcctgcctctgcctcccaagtgctggagccattatgtgagctaaatatttaaaaaagttttgatgtttttgttttgggttttgttttgttgtttgtttgtttgtttgtttgtttgtttgtttttgagacagtagggtttctctgtgtagccctggctgtcccacacttaatctgtagacctggttggtttcaaattcatagagatacagagatccacctgcctctgccccctgcaagctgtgtgccactgcagcagggctgaagtctagtcactgaatgcctttgcgctagtctctggagccactgactgtgtgctcctagaggccagtaagactgggtggagaaaggaggcctgtccctgaggtggtgctggggtgattttatggtatttgtactgctgtagaagcaggcactgcttcggcaggcagggcccttggagtttcagcgcactataaggatatttctgatgtctctgctagttgatgtggatgactacagctcagagtctgatgtgattattataccttcagccctggacttcgtctcacaagatgaaatgttgacacccttggggaggctggacaagtatgctgcaagtgagaacgtatttaacaggtacgtgggtcctcctcagtaggggcacagtcgcccaccccagaggaggtggcaggtgcagtcaggccccggcttcagcctgattgatctgtattgcatttgtcctccacgaccctggtgggttgctgggttaattgattactatcccgtgggttattggggactgtatcattcttctgccagctggtgtgatgcgcttcctgccagtcattcctctggaatctcaagtctctgttgaatttctttgactgtagataacagagctcatcataggagatacgacatttaacgtaacgaatgtgctttaccactcctgtgatgagacgataattgaagtgaaaattgagtcactaaaatttcctaattatttggataaagcttaaaaaaaattggtaataaccttatcagtaaaatcattaccaaattttgctttttagaaattacagatttagtatgtgacttgcagtaagaaaaactgtctttatgagacataaggattctgtattttgaattctaaataacaggtactagtggcactgaacactatctgactttctcctgtagacaaatggtggcccggagtttgctggatactctgagggaagtctgcgatgatgagagagactgcattgctgtcttggaaagaattagccgattagctgatgactccggtatgtgtctacagagagacagcacattgtttctagaaaggcttttgccactgaacctgtctttctaagctactggagagatagaagatttcccaagaccttggcaagtgaccccacctctaaccccaacactctggaagagcttgtgttccaaagctattccgtactacacagagagatcctttctcccccccccccccaaattcttttttgaaaggaaattattaacttactagttctatgtgaaaaaaaaatccagtttacatatgtccatttacttaattttggaaatttctcatcagtataaatgtaagaaattaggttacttctgtgatttatgttaacataaccatttttaaattatttagagtaaattggaagaagtggaaagggctttaaatgtttgtgggaaaataatacttcctgtctgatttacatgaaaaacatggattgatcgctcttggttttgctttggtctctctgtgtagccctagctgttctggaactctctgtatagaccaagttggccttgaactcacaaagatcctcctgcctctacttcctgagtactgggattaaagcggcatgctggtatgcctgtaaaataaaaattagtttattgttcaaagacaggagcgtttttttttaaagaaagaggtaaatttaagcctggtgtggtggctcatgttggcagtattaactcttaaaagaccaaagtgagaggattactttagtttgaaaccagtttggtttttagcatagtaaattcctgctagtctatcaagaggtagggagtgaacttaatttgaaaattagacaataataatgtgataatgtttttttaagatgtgttgttttttaattgtggtacaataaacataatatagaatatgctattttaaagcaatgtatgtgtggtgtgtgcatgtacatgtgtgcagaggtcaaaggaaggtgtcaggtcctgctgtatgactgcctattcccatggcacagggtttcctactggacctagaactggctgtctgggaggaatactgcacagcaagttcctagggactgcctgtcgcctcgggctctcagtgctgggccacgagggtcacccccatgtccacaggagtgtcgacgatcagagcttgggtctcctacttgctaactccccagtcatttctttatgtgtatcagtacactgtagctgtcttcagacacaccagaagagggcatcaggtcctgttacaggtggttgtaagccaccatgtggttgccgggaactgaactcaggacctctggaagagcagtcagtgctcttaacctctgagccatatctccaaccctccaataggaggttttaagcacgtgtatatacttgaatttacaaacaatccaaaaataaaggttgaaatctttttttccttaaatctattaaaatgtttttaatttctcacaaactctttggcttctcaacaggctcaatttttaaacatgaaatgaattagtcttttaataagcagttgatgtattaaccttaaagtttaaggttcaaatttaaagtttttttaagagtgaaaagaacatttataagtgtattaatttatctttgtcacaattgttcttgttattacttattctgaagtggctttaggagggtctagtaaagtataattttgtagtttttgtttgtgttatttagtcatacgagaggttatattggatttgttaggttaacaacgtgcagaggggaaagagcacacttcagaaggaaacagaaggttagaagccagaaggttgaagatgggagctgtggtcacaggtgtggggcggggtatcttctagttagaagaaggtgttggtgactgtgaaggtctgtaacctgctggtagagtcagcaggtcagcaggatgaactggcttgcttagttgagaggtgtgcagcttgttacacagttgggcctctgagacagaagtgcttagtaaccgttctcagttacttgagcagggagagtggcaaggtcggctgtccctgagaacaggctgtcctgcttgctggtctgactgcagggtctgagaaggaggcgagagtagaaactcagtagttttactgtggagaaatcagtgagtctaattttgtctttgttcctttcttgtttgtttgctttaaaagccctttccaagggagctctggttttactgtgctgtaattacgtgcaaatggattctactcaaatttttcatttttttcctagaatttgagtgtcaaagtatcttttatttgcctgaagtaattgtcatctctgatgcttactgtcttagtctgctaacccaggcccaggcccgaagcttctggtctgtgtacaatcttacctaggcctagaatgttctcaggcctctgaggctgactgctgaatacgcccacccttcctagttctctctgaactctgttggctggttcagctcagctattctgctcaaactcttccaggctgactgttactcatgttctctctctctccactcccctgccctccccttctttcccttcttctctcatctcctatcctctctcctctgctctctcccctgtctctccctctttcttgtgagacttgggcacatcatattctgtcaaatctttctgtcaaatctttctgatgtgtcactttgacactcaattagacatcagtttcaaacatggctgctttcttctccacactaacttcacattgattgtttaggattaaaggtgtgaactgagggtgtgcctgtattctagccagaggaattaaatgtgctaagactgagccacagcacaactagaaacagcccctcccccccagtaaataacactaactcgggggttacaatgtgaccgaatactctgcaacatttgagggttcattctgtcagaaaaattcagccattgacttttggaatattgttttatccctgtcttaacaaatcgtttttgaggtttacttttggttgtgtgtctgtgtgtgtgtgatataggattcatgtagtccagttggccttgaactgggaacaatcttgatcttgaaaaatagccatacagcttgtaagaaattggctttattttgagcttgagtttcttgtgttccctttaccttcacatcccaggtgcggatcacaggcacattgtgcagcgctgagcgggtgttccagcatcctctcgggtgtggatcacaggcacattgtgcagcgctgagcgggtgttccagcatcctctcgggtgcggatcacaggcacattgtgcagcgctgagcgggtgttccagcatcctctcgggctgagtagatatttttaaaatggttgagaatgtggagctgttgaaacaagtgtatagtaataataataaaattaaaataattattaatgaataggcttccatggatttacactgacttcatttttcattctttgattttccatgggcattttgatggtttctttcagcaaagtgcctgctgggaaagtccagcctgccccgagcactgagggctttattgctggtggtgataccttttttcagaagcttcggattctattttcatgttgtcttgattttcatgtcctgttgtgttatttctttggttgtgtctcctgatactgtctctttagagtgtttgaagagatgtagacctctctggttgttgaagacttggtgtgacagtccttccctgtgtcttacttgtttctgccaagggctcattttcatgtcccttagagactgagagttcatttagtgggccttttgtatttgcttctgtcttgatcatgagagtcctacagtggcagcagaggtgtcctggctttgagttgttagcaagcagcagaggtttcatgccggtgtcgcggtgtgttgagtgtgggtgtacattgtgagtgtagggagaggccctctgaccatgctggatatgagggtctggagttctgctcagtccaggaatttattcaccatatttcagagatacaggagcaggtatttttgttattgttgctattttaatactgagtataacagactactacagcacatgagtaagtgtatcacatttcatacaatgaagacttagcactcagatgaaaagaaatagaattagtaccctaaattcctctcatccctctcacccaaagtaagctccattttgatctgaatagctggcctcttgcaactttatgtagaattatatttaatgtagtcattttatctgatacacagtgtgctgtacctgacccactgcttcaggctagtaatgctgttgttagtggccacgtttctctgggtactagcttaaagaggagtcatgaggtcataggacacgcagagactgttatccatgataggtaagctattgcatttgccattctcacaagcagtgtgtgtgagttagtgtgatacacacctccagaggcatgtcctttacactttaccataaaggaatggatggatggatttgtagtggtgtgactttgtggagctcatttagtgatccccagtgatctgtgaaatgagccttggtcatatgctcattggctacgtgaatgtctttcttaaaatatttgttcaaatattccccatttaaattgtcaggtttttttttttcttagagttttttcataaggagtctttattctaatataagtctgtgtggttgatgtttcagagaggtgttctgttctgccatgaagttgcatctgtgtactagaactgtgttatctaacacagaccctgtaattgtttttgcttatgtttatataactgttaacattgatagataaaggttctacatacgtatgtgtgtgtgtgtgtgtatgtatatatgtatgtatacatatacattacaagatgttcctagaactatttcttacatttgcttaaggatatgtatgtgcctgagtttatgtatatgtatcatatgcgtacaagagtccacagatgttagaaggaagtatcagatcctgccatgtgaataatgtgaatgctgggacccaaacccaggtcctcttgaagatcagtaagaactccgaactgctgagctatctttccggcctttcttgtactttaatggtagccagttaacagcagcatttattgaatagactgtttctcctttccacctgcaataactacatacatttatacattgtctgtctctggagtttactgcgtcttttcttttgtttgcctaagcaaactctaaagaaagaaaagtttctgatttcattctttctgaaactgcaactgtgatcctttttgctttttaaatatatggagataaatcatatttaacctcataactggaacctatgaagaaaaatatgagtatatgcttgtgttttaaaattggattttttttttaattcaagagaagtcatctcacattatacaacaatataatgaaatgtggtttgttgctaggactcttagctttataaaataccagtgcattttctattgaagaccagatgaagatttggaattccactggatacattcatatatatatatttatgttaaggtgactagaaacacagccattcataggtgccataggtctcttaaggtctggtgtgatcgatggctgcttaacctagtaaccctcacatctgatgtggtgactggttactggcgtgctagtgtctttcagccacttgcttgctttcgaatttgcttgttttgtttcttttcttttcttttcttttcttttcttttcttttcttttcttttcttttcttttcttttctttttttcgagacagggtttctctgtatagccctggctggcctcaaactcagaaatctgcctgcctctgcctcccaagtgctgggattaaaggcgtgggccaccactgccgggttcgattttttttcttctatccctttagcagtagcatgaatatacttaactgttaatacttttggttgcctatgctgttttaccctttaactaatgtggtacctattatctttaatgtttttataaagggagattcgttgtttgaagtctagttattatctttcagagatgatactgagaggaggagccactagccttacaacttttcctaggtggttcttacgtcatggagtctgcagatggtagcccactgtagtgttgttctcatttataacattctcctgccacaaaagctctgaactcagtgcacactgggccagggtacatgtaggttgggagtgacttcattctctcatttaaggaaagaagtgttgggctagagaacagcgtgagctcttaccatgctggtgtctaagtagcctggaccccagatgaaggggggcagctgtctgggtgcgaggatgtgcttggtcatgttgctgctgtttctctagaaccaactgtgagagcggagctgatggaacaagtgccgcacattgcactgttttgtcaagagaaccggccttctataccgtatgctttttccaagtacttactaccaattgtggtcagatacctcgcagaccagaataaccaggtaaagttgcatttacttgttcttaaaggacttttacatgtagaatgccccaacccaagtgatataatttgaatgttttttgggtctaacctcattgtttattttccagaagtgacttcttatcttagattaaggtgtgtggagagtctaacaaatttattagaacccttgatcccgttataaagggtgcctgcttaccagtcttcccagtgccctcagtgacactctgtctgtcaggctgtctctgtaagaactgaagggagtacccataaatacctgctagggtttgcaagttacaggttcctacattagaagttttcccatctgcaaaaacaatgttgtctctacaatttgtttggttttggtttttcgaaacagagctttctctgtgtatccctggctgtcctggaactcattagaccatgctggcctcagattcagagacccacccacctctgcctcccaagcgttaggattaaaggcgtgcactgccatcacctggttgttgtagaatttattatatatttgtcttttttatactgtggtgttttcttggtaggtgaggaaaaccagtcaggcagctttgctggctctgctggagcaggaactgattgagcgatttgacgtggagaccaaggtgtgccctgtcctcatagacctgactgccccagacagcaatgatgatgtgaagacagaagctgtggctgtaagtctgttgcctacctttcagggagctttgagagtgtgctggtgtgtggtgtcactcccatccttggttcctgagctgagacagggggataggaaagtactaaatgaacctgactggacaccggagcattagctctttatacctttaacannnnnnnnnnnnnnnnnnnnnnnntatagtattcagtggcatttgatacaatcacaactgtcttagttagggttctactgctgtgaacagacaccatgaccaaggcaacaaggacatgaccaagtcttataaggacaacatttaattggggctggcttacaggttcagaggttcagtccagtatcatcaaggcgggagcatggcagcatccaggcaagcatggtgcaggaggagctgagagttctacatcttcatctgaaggctgttagcagaatactgatttccaggcagctaagatgagggtcttatagctaacatccacagtgacacacctactccaacaaggccacacctcctaatagtgccactctctgggccgagcatatacaaaccatcacagagacctacagtcatcatccctacctagctccaaacaatcacgtttcatttcagaaattcttcaataaagaaaatcaatttgggtaaaactgttggttatattaaggggagcctagcctaaaaacataatgttcagggttgaaagaaagcttatgattccccatgttttagaaaaccattagttataatatggtaccctgattagacagcgcttcagatctcagctttgcctctctgaagcaccaagctgtccgtgggatgtgggagctgcaggtattaccctgctgcccaacagtggaggactgaggtaggacttgttgacttgcaggctggcctgaggagacttgccagcctgaccacctgtgagcgtgacgcatcttgaagggatttacttatggatttgattacacagttatgttttgtaactttgaacaggaagatctcgctttttgttggatttcacattttaacattataaatgatgtatttttaaagccctccagttcattgttgatttatagaaatataagccgtttttattcttatatagatacctgcagctttgttatatgtacttattctggtaggttctttattagatcctttggagcttctgtaggcagtgatgctgcacatagctgagagtctctttaccgtccatgtgtcttttacacactctgggaatagctgtgtctgggaaatgctgtcaggcaggcatcagatctccctgtgtattaagtatggggatggacttgagcagttgttagggaaggaaactcttactttgttattggttagctggaacaaatttgtattagtactgtgtctatgcaaaggcaggcttgactcccccattgacaccaaagctgacgtgacgcagagctttcctcggagacacagctgcactcagcagtcatctcctcagacacagccttgcctttgaacaggcactcccttgctgctgctgctgctgctgctgctgctgctgctgctgctgctgctgcggtgggtgttttgagacatggccctggctgttgtggaactcgattgtaggccaggctggccttgaactcatagcctgcctgcttctacttctcaagtgctaagtttaaaggtggaattttctttttttctctttttcctatttttctctttcgaagttactggcaaaatgattaagttattaactagtgataggaaaatcattttcctctagatttagtacatttgctgtacattggttaatatgtgtttctttaaattattaagtttaacttaaaaaggctttagatgttttcaagatgaatttttctcacttgtttcagataatgtgcaagatggcccccatggttgggaaggacattacggagcgcctcatcctccccaggttctgcgagatgtgctgtgactgtcgaatgtttcatgtccggaaggtaagtctgcatccactctgggtttctgagtttaagaacgcatgatgctctggtgtgtggaatgtgatgtttttaaggaactcctatgcgatactaaaatgttagtgatggttctgttacaggtctgcgctgccaattttggagatatttgcagtgtagttggccaacaagcaacagaagaaatgttggtaagtatctaaggtattaaagaataagcaatacagagtaatagagtttattaatatgcccccgtgactgcaaaccagaatgatgtttgtacatttggaactacaagttggtgtttgcaaggcgttctgataaggattgcttctttaagcattaaacagtggttccctgttagcctcccacttgtacatagtgactcagtcctgactcactcacccgagtctctaacctcactagggcatttgctttactagagtcctctctggtgccacttaaatctcgtagcagaggagttaagttgtgacatgcatgtgccccatgcacaaattcatacgcgtagactgtctatacatccactggcacgaggagctcagctgtgagctctcgggtgacagtcagctgtgttttgcctttctagggggagttataaactggagtgatgcattagaagtttttgagttccagtgtttaaatacgttctgtatgttttaagaatatccatcattaaaacagaagatggcagggaagtaactggtgtccccgtgttcccacagctgcccaggttcttccagctgtgctctgataacgtgtggggcgtccgaaaggcctgtgctgagtgcttcatggctgtctcctgtgcaacatgtcaagaaatccgacggacaaagttatcagcactatttattaacttgatcagtgatccttcacgttgggtaacattgctttttaaaaacattttgagactaaagtaaatgatttatttattttgtatatatgagtacaccaccattgctctcttcagacagaccagaagagggcatcagatcccattacagatggttgtgagccaccatgtgtttgctgggaattgaactcaggacctctggaagaaagtaaatgattttttaaaaaaaaaagtgttttaatattttattttatgtctatgggtattttgcctgtatgcatgcacggacgtgtttgtatatgtatatatgtgtgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttagtgctgaaacaggcagtggtggaaagctgtgagttaccatgtgggtgctgggaactgaacccagggtttttggaagagtgtgttcttaactgcgagccatttctctagctcaatgatttcaaatttaaaactaatttactccaagtacaagtggcacacgcctttaatcctggcactcagaggcagaggacctgtgagtgtgaggccagcctggtctacagagtgatttctgagatagagctacctagggaaaccctgtcttgaacaccttccctcaaaagaaagaatttataattatgttattcatataaatatatgactagtcagtaggaggttattaaaggttgtctttttattagctggaaagtatttttttctttttccaattttttaattaggtattttcttcatttacatttcaaattctatcctgaaagtcccctataccctccccccaccctgctcccctacccactcactcccacttcttggctctggcattcccctgtattggggcatataaagtttgcaagtccaaggggcctctcttcccaatgatggccgactaggccatcttctgctgcatatgcagctagagacacgagctctggggggtactggttagttcatattgttgttcctcctatagggttgcagacccctgaaagtattttgtttacaaatcaagtttctaatttagcttgctgtttaatggttgtaaaactcactgacttttttgtcttttaattaattgactgtgtatttttaccaggtattgaggatgtgaatgtttgaccctagcactcaggaggtagaggcaggtagctggaggccagcctgggctgcacagttaggtcttgtttttgaagcgtacaggaacacagttctttctgtgttggttaggatatgccactcagctcctagtgtctgaatagtcaagtgaagagagagtcaggtttcttttacaaggctttcctgttatcctgaacatactttggcttttgtatatgcataggaagtatgtgtgcattaaaatatatatacctctttatgcttatgtttattattgtcctttttctcttcttaggttcgccaagcagcctttcagtctctggggcctttcatatccacgtttgctaatccatcaagctcgggccagtgctttaaagatgagagcaagaactcagaagactcctcggcagaagacaaagacaggtatgatggtgaagctttgtatacttgtgacagctttcccactgcgttgccggataatgttagttagtgagtgctttatagtttcttggtgatacatacattgtcctttggttagctacccattgactgagaaaatgcttggaacacacagcttgatgcctcacacagagagtggcaaacctgacttactgagtagttagtgaattatttgcctaggaaactattggtgcttacacaatatattgaaagcttttgtcttaaaaagctacttgaatgtttgcttctgtatatagtctactctgactctttattgttccttacagtcaatttaacgtggatcttggattctctgtacaaagagatcattataatccctcactgagggaagcattctttttaaaaagaatgatttatattgtttttatgagtacaccattgctctcttcagagacaccagaggagagcatcagatcccattacagacgcttgtgagccaccatttggttgctaggaattgaactcaggacctctggaagagcagtcagtgctcttaactgctgagccatctctccagccctgagggtagcattttaataattagccctaaattaatatacttattaaatagaagaacaactttaagattaccaaagtttaatagaggttgaaactctgattttcagatttctaggtttaaagaatttccattgacacttttagttcttagcatttattatagttcagcagagaactctgggtcagacagtgcatggaagggtgcgtgagcctctgctgtgcatacatgatgttgacacacagccccttgccgtgatgctaatgaccgttctcttctataggtcttggtactgtggtatttgctttcttggtgttttgatttgacagttcttcctttcttctctgctgccttgttttacctttttgcctgttctcctactgtcctgccaaacacatctgaggtactgttttttttttttttttttttttttgtaaaggaagagaatctctctattatgtcttcctagagagcacggtctaagttctttgagaacagtgttagaaggatttgataagtccagtggggggtggggatgtagccttctctgcatttgtgaagtccgcttgcattctttttaaagatatatttattttatgtatatgagtatcctagttgtatgtacacctgcatgccaaaagagggcatcagatcccattacagatggttgtgagccaccatgtggttgctgggaattgaactcaggacctctggaagagcagccagtgtccttaaccactgagccatctctccagccccatcacttacattttttaatgatcaatttaagtgtacttaagttggcacatcacttgattttaaatctggaaagagtctaatgagtgaatgtgtaagtgtataggaagtgtgtaagagcatcttcagtaggtagtaaacattgcattctctgtcacaaatgcagactctgctgtaagtacaaagcgctgtcagcatagtgtgcacagccttgcacagtgagaggcaccaggcgcggctgtgggctgtaggctgtacgtggtagctgcgggtgtgcggctttatgggacaacgaacaatagtgtggcttcctgattgactcgcactgagatatgagaggtgtgcaagtctgtgttatttggagcactggactatctgtagttgccattgagttgtgctaatgatagagtaaaggaaagagagttcctgagtaaggaagcgtctgctttaaatactgtaaaagcttgggcatatttacacatcgtgctcgtattgctgcctcaggtgatgtgactgccttgccttaaacagccctggtgtggtttccagccagtgtgggaacccagtgtgaacctggaatctggtcaggtctgtggtcagggttgtttccgttccctagatttcacacttgtcagtgtcaaacacataaggcatttttgtttttatatttttatgatatgctgtgtctgtggatatatgatatgtaagtgtggatatgcatgcatgttttgtatgtgcgcgtgagagtatcgcatgtgatatctgctggtgtccatagacgctaaaagagatgaagtctgctagagagaagctccaggccgctgtgagccaccctgtgtggctttcctagaaccaagcatgagcgtcgaactctgcacggctgagccatctgtctcttcggccctctgaggacagttttgttgctagctttccactactgctggtcttgtgtgtagtgtttcatctgtttggaaacatactgccacttaatatttctagaaggatttattgattacagacatctggttttatctgatctatcaggctataatactatttgaagatgctgacaaaggttgcttacagactgtactagctggttttgtgtcaacttgacacaggctggggttatcacagagaaaggagcttcagttggggaaatgcctccatgagatccaactctaaggcattttctcaattagtgatcaagggggaaagggctcttgtgggtgggaccatctctgggctggcagtcttgggttctataagagagcaggctgagcaagccagagaatgcaagccagtaaggaacatccctccatggcctctgcatcagctcctgctttctgacctgcttgaattccagtcctgactttcttggtgatgaacaacagtatggaagtgtaagctgaataaaccctttcctccccaacttgcttcttggtcatgatgtttgtgcagcaataaaaaccctgactaaaacacagacagattaaagcattgagatttactttgtaaagttatgcaaagtttaaaatagtgagctctaggactgtaggtcagaggtgggacgcttgcctaaaatgtgccctggatttgattcccgtcacagcagaagtagttatccaaagtggacactgatatttgctgaaagtgctgcattgctgcctggctgcctgctgttctgcatgccctttgtttgttggactcaccctgcctttttcgcttactgctctctgttggaaaggttcatttcacgtgtattgtctattaacaaaatatctgtcggtgttcactgtctccataccagcggctcctaggatcagagcctaatcgagtagcttaggatctgcacagcacttgtgttaagccatgtcttttgaaatgataggtttgctttcatcatgcttagagtatgagcatatcctttccatctgcctggtctgtgtctctgtttatgctgataccttcactagacctgactcatagtgggtgtgtggtcttgactgtcattctttggaaagtcgatacctttatgcaataggtcaccgtcacccccacccccagctcttcctagtgcctcacctaccttcctgccatctagacccagtttgttttttcttttgaatatttgagacagggactctgtgtagccttggctgtcctgggattaaaagaatgtgctaccacacctgaaattttttcccctttaattaataacctccataaataaaaatcttgactgaactattctaagaatctataggtttgatcttcaaaacctaagtatctgaacaatagctgatcgttatgtatcaataatttggaaatatttcactaatatcaaagcttcatttaattgcttcatagtgtaattatgaatttagcttggaagtagtatcctgttgtttgctttgttttggcttgatcatatttaaactagatgtttgtgagtcgttttgtccttgacataattgttctaggttgccaggttcccaggcctctgttaaggaagtctgaggtattggagattaacttgtatgggaatcagaggctgagccggggtcccatgaagtgaaggctggtcttgaactcctgacctccctgctcatgcctacctggtactgggatttcaggctggccccatcatacccagcttactcagggttcttcttgagaaaaacctgaaagcgcctctgctgctctcatatgcacttgttttagatgtgactaagtcttccatctagacccagtttcaggggattacaccattacacagacacatatgcaggtaaaacacaaattcacataaaaataaatcattgggagggtataggggactttcgggatagcatttgaaatgtaaaagaagaaaatatctaataaaaaattgaaaaaaatcattaaaaaaagaaaacgtagtgttttacctttcagcatactaattgatttacttttgcggaaaaggaagaaacggctccattatactgtcagggccagtgctaaaattaacttgaaggtaagccgataaggagtattcattgtcttgagtgacagctacttagatttctgtgagtgccttaaatttgtcagatgataaagtctaaggtttcactttgcccctgcagaataccaagttactataattttaagtttttatgtagaatgattctggaaaataaagaatactacagtctctccttcacccaaacattccagcaccgttttatcatgtgtgcttgcctatgtggattttccccgaccctttgagcagtttgagacattttttcttatttttttttcaagtattagctttgtatttttcaaatgtagaatcagtgcatggctgcaatccagtttctgacagcaggaaatgattctgtgctatggctaacaggccagagtgctcataaatgtgtactttatacacactggagatagacacttttcacaggagcactggccacaagctggtacactggaagagtaccttggttcattgagtcaggaacggggcaggagtctcccctgaaggtggcccccctctcttactgctcagtcacttcctgtttgacatacagatgcagagtgtgtgcatctcatgagtttatagttggggaagagaagcaccagatagcaaatgcttttactatataccatgtttttagatgacatgtgcttataaaatttcaatttgtaccttgcattttaaaaagcaggtgtttttagaaatgtttctgaaaatggtgagccttacaaaatggagctcagcgctttcatgaagacctgcactgggaccggagagtcacctcagtggttgggcactggctgctgctccggaggccctggagtcagttcccagcacacacatgcccacagtaaactgatgccacataggaatagtgcaggacccttatattttaagctcctcttaagtttccagtttgatactctgttctgacgctgagacgatttagacactttttaaacctctcagatacgttgtatttcttttcatgtacactgtgttggtaggcacatggtgttttttgagagaactcatttttctttactactttcaagttacaaatttacatctccattgacccttttactttcaagtcatgggagcctggattgtcttcttagacactgttagctcggctgctccgttcttcaccctctgtctgtcattcttcccctggcttcctctgattaacctgcctttcagcattaccatttcttgcctcctacactgctcacccctatgctgtgcccttgtgagtctgtcaactgctcatagatagcactacctggaatttagcagatgcctaatccacctggccagacctgaactttttaacctgtggaaactgctctcatgttggtagcatctagttagtgctgtgggcatctattggatcaccctagccagactctgggtttccaccaggctctgcatgaagtgactggatgcacacagtgtcgccaccttgatctctgatggagaccccacctgtgctcacacatggtctgtcgtctctggtgctgacattgcactccggcagccgggcttctctccagtttgtcttctgcactacttgagcgagggtcttaggaaaagaagatgtttgatagttgggtttttgttttgttttttttttttaagatttatttattattatatctaagtacactgtagctgtgttcagacataccagaagagggcatcagatctcattttggatggttgtgagccacgatgtggttcctgggacttgaactcaggaccttcggaagagcagtcagtgctcttagccgctgagccatctctccagcccatctgacaggttttatagttgcttcattatttgtggtggccgcaggttaaactcagaagtgtgtccagactttgcaccgtccctgtctgccattatagtctccttagctggaggagggtgtcctatgttctgactgctgcctagcctctcagcaccggcctggcctgtgtgctgtgcctgtctcttctttttcttttgtttgcctcaaagcacgtccaggtttttctagaaagtcacatcattttctccagggcccgtggcccacctgtacgtctctttttggactcattccctaatttgggggtggggtaaaagttaagcttttgagtcactctccctgtatagctagggctgtcctggaagtctgtacaccaggctgacctggaactcagaggtccacctgcctctctgtcttcagcactgggattataggcatgtgccactacacctgactagtttaattgttatggtagtaatttgcttttgtaagttaatgtttgtttacctgcaattattacctcagctttctcatgttatcgatgtagggccaggctccttttaaattcttttttttttttttttttttttttttttaaagatttatttatttattatatgtaagtacactgtagctgtcctcagatactccagaagagggcatcagattgcattacggatggttgtgagccaccatgtggttgctgggatttgaactctggaccttcggaagagcagtcgggtgctcttacccactgagccatctcaccagccccccttttaaattcttgatcctccagtctcgacaggtgtgcaccactgtgcccagcttggcttcctgtgttcatttttatttgtctatgctaaagatgattgtgctagagtgtgcatgaatgtgcatgcacatgcatgtgtgagtctgcagtgtgtatgtaaaagccagaggtctattcagtcatctttctctattacttcccaccctatttgttgagacagggtctcctcctgaacctggagcttgccaattcacccagactagcagaccagcaagccccagaaatccttttgcttctgtctccccagcactgggactctaggtgtacagctcctcctggcttagttacattggtgctggggattgaatttgtacagtttacctagacctatatgccacatcccgaaacctgatttattcatgggtcctagtgggtgtccattcagtaactacttgtcttacagcagtagtgtcaatggctgcattgggaagacagtggttagtgcttacagccttcgcgtgctcccacagcccgtcttggaaaaacctgtttttgaagtagcattggagattgtggaagaaataaaaatagctctgtatttatacttaagtagtttttaatacattatctgagagagttagtgtcttctgctgccttctagaggtgtgtgtgtgtgtgtgtgtgtgggtgctttatccctcctttttttttttttttttttttctgagacagggtttctctgtgtagccctggctgtcctggaactcactctgtagaccaggctggcctcgaactcagaaattcacctgcctctgcctcccaagtgctgggattaaaggtgtgtgccaccacggccgactttatccctcgtttataagcaaaaatgttttgactctcagctttctctgtgtcattggagctgaggagaatacagataatccctgaatagataatttaacatttgtgtgtatcttagattcttcttcctgctgttactaatattagtagtattgttgtatcccaggattttttaaaatcatcttttaaaatttatttatcttaatcttatgtgcattggtgttttgccttcgtgtatgtatatgtaagaaggtcagatcttggacttacagacagttgtgagctgctatgtgggtgttgggatttgaagctgggtcctttgggaagagcagtcagtgcccttaactgctaagttacctctcctgtccccagcatcccaggattcttaagtgttgccttctccagctgttaataatgcttgactgttcagacaagtttgacaggtgtctcacctctctgcagaacaactgatggaaaagctgtgtgtgtaacaagcaaggctgttgagttcctgtgggtgcttagctagtctgaatgctatgtcagacttgtccttgaccttctttccccagtaattatgtctatacttccatgtttcttttctctcccctaaatgaaacaatgaaaggatgagagacaatgatgtcgtagaagaagagcatcgcaggccagaggacgctccttcagacctcagtgcccctcactccagcgccaggctggagagcctcgaaggctgtgctgccaagacacctgggcactctgcaggtgacgtgcctgctccagtggacagctccttactctgtactttgtcctcagagtctcctcaggaagcagctagcaatgatgagaatggtagaaagcctgacaccaacagcaagtctgcgtcccggccagacgctggcaccagctccccagaggccactcccttagaccaggacatgttcaactccttccatttctggaggactcctctacctaaaatagatcttgataaagagctccagcaggaccccgaggagagactcagcccagagagaacaggagatgtacctgcagcccctctaccaggccctcccaatatcaccatggctacccggaaggaactagaagaaatgatagaaaaccttgagccacacatggatgacccggatgtgaaaggtatggaagagtccattgtactatttatttaaaggtgattttaaacatgccctttaagacaacattgctggtctgatttgtgtgtctaagatggctcctctctgctgtttgttgttgaatagatgtgttcactcagaaatcaccttttgcagttattcagtgtttaacatttgtaatttttaagttctgagttctgctatattcactttgctctgggtcttatttttaaagaagtgctgtagtctatatggtggacatagatttctgggttttcacatgtagggtgttttaagagctttagagttttttgtttgtttatggtttaagagctttattgtagaaaggcagggggaaagagagaaggtagaaagagagagaaaccggacgtggtcacgtgagagaggggggaagggaaagagagaggaagagagtaagaaaggtgagggctaaagagtgagctttagacttttacaagaataatttctttttcaaatttgtattttagaggtgggggacatcacatacatggcccatgtcctccactgtgggcaactgaactggttgttgagtcctaaagaaagcagtcttcttaccaagtggacgatgcattaagtccttagtgggaagtggggtgttgcgaggctctccttattctgcctgcggagcttaggaacagggttaggagcagacgcagtcagatggtgctcaatgttcttaggactaggcatgatgatgcacacctctaatcccagcactcagaccgacctctgggaattctaggccagcctagcctatatagaaagttccaggccagacaggtctacatgagaatttgtctctaagaaaaaaacaaaacaaaaaacttttaaatcctatagctgcaaacttttgcaaatcttcagatgtaataccacattctggatggtttttaccctttttgttcccaaaactaaaatttctaaactatcagtttgctcaattttgagaaatacccatttttaagcaaaaataaagtaaaatcttaagtaattcttttacaacagaaacctttcttttggtttctttgtttgtggggaagataagatctcattctgtagcccaggctggccccaggtcttcctgccccattgtcctgagagctaggattattacagtgtgacacgacataaaaccagctaaaaccttgtttaaactttgaaaactgtggtctgtgtgttcagttagctgccttctgcacttgttttcatttactatgacttttaagatttcctgttgtaattttatacctgaaaagcattaaattttattacatccttggtccctaatattattttaatttaactgaatttgatttaaactatctctctgcacagatgggtataatcttgaatccacaggggacagagaacgtgctgtattgtattgtctctctgagtctggcttattctgcacagcatgctttctagttgtgaccttaattttgaagattcactggggtatagttcctacgagtggaagccactgcccttctgaatgaagtttgtgagatgtgagaagtaacccagtggctagtgccacagcggaggtggagaacagtttcctagcccgagcatggccccaccctctctgaatcttaggacagacagctcagtgacacagcagctctgagtcgatggcgcagctcctcagcagagccctgcactgccttctcccttcttctcgcccatcctcagcccccgatgagaggaagcgagccatgcccacagcagctaccgtcaagtgtttgatgtgttatttcctttagcttcttgtttcaatctcaataatcaacctcagttttagtaacttcatctagctttagtgactctcattttattttccttaaacttaatttatatgcaaaaggccagccagtctttagatctattccaggactcttgtacctgttagttctctaacacattgtgggcactcagtgaatattaatagaaatattgaatgcacattttttcaataagtacaatgataaactttttaagtttcataatgtgtgtttttggagatggctagtatatttgacttaaaattatactgtagttaaatttcattattaatattatatggtaacttaactatttacatgcttacatatgaattatgcttataattcagttatgacacctagaacaatttaaatttgtcatgtagtgcttttagattttattaaaatctgaggacatttttgtttaatctctgctaagtaactagtctccattgtgttacaaaatgagttgaacttttagaagggctcaatggggctcttttttcttttctagcggtgcgttatagagcaggacttgcctttagttctccagaaagcattggactgttttaaaaggtgcactcttgatccagggctaaaagcaaaggtccgacccaggagaccagtgctgtgctgtcctgtaaacatggtgtcttgacagtaagcctgggaggagagggaacgtggcgacagccctaagggagcagctctacacagaccaggtcacagccgattgtctgtaaggcagtaccgcggacttagtttcagaccgcctgtgatcattgacgacggtctttttttctcctgtgatttttaatagtgaattaactgctttcactagactacaatagggaaggaaggggaatccttttgctagctgtgagcacagtaggctctcaggacaggttcagcagaagatcctacacagtgagacacagagatgggagagatcccctttgtaagagtgatgtgctggatctgcagagctgcagtcacagctgcctgcagcacatggccagcggctcacgacacacgacacatgacaggctggacatgcatggatggaaagcaagtccatgggagacaggggacctgcctgtcagacacgcgtgcactctgggacagtttgtacagtcagcttggagcacacttctgcttttgctttagaaacttgaaagaccccaaagagagttaaaatgattgtcatggtaactacaaattatagctgaaattctgagaacaatgcaaatcaccagaatgtcccacgagtaaacactactgtttgctttatttaggtaatgatgacccactgaagtagaagttccttgagcacaagtcttgaatgcgcatggtcagatacttaatgcatttagagaagcccgcccctaccctccgccacagccgcctcaaaaagagaacagtcccaggaatgagagtgggctagtgaactgggaacagctgtactcaggggcactccactgtctcagactcaccaccctttctaagtcatttgcatagcacctgcttttgatagtttcatacacacacacacacacacacacacacgcacacacactactgtctactacccctttaatctccctctgtaccctgtcttgccacctcatctcccagtggccatactataaagatgataccccatctccttcagcaaccaataacagctgctcaggggaggtgtggcctcatgagcacccctctgtgtatgatgggatgttggagggcccctgctgatagttcacaatcacagcagccatgtcctctccatgcagtttcatggacccgtccatctcctttgcttttaacaagcctgctttggtgctgggagaattagcgtagattcagtgtaaggctgagaggctgcgctgacctctgcagaaagaagctccactgtccaaggcaggaaactagacagatgctgtcacatatgcataggatgtcttgagcagtagatttgaattttatgtgtgcaaggggaatgttagctttggtccctccccgaaatataaatatattctctaaatttctcacttatttggtggggcagagaatcctctttcttagtttgaactttctgtataaggaagatcgtgcttggtaagttgttttggctttgggcaagcaagagtgtatacttgggctagagagatggctcagcggttaagagcactgactgctcttccagaggtcctgagttcaattcctagcaaccacatggtggctcacagccatctacaaggggggatctggcgccctccagcagagcactcagacattcaataaataaaatgtttaaaaaaatttggatcccaattgttttggaacaaactgtagtaatttcaatatcaaaaagggagagtgaactggggtgcgatagagatgtttaaatgttgccgcccagaagactctgcagccgcaattgttgcatgttggctggtttgtgtaagtgcctttctgctagaatagcttagtgagacttagcagcttgacctatggactcctgaacttgaggcctgcaataacggtgcaggtgccttcagcaactagacaccgtaatcagacagcacactgcacacttttttccgtgcagtctcttgaaggaccagtgatttcgccacggtagaaaattgtttccagctctctcacagcaatgtcagaaacacccgtgtactgacaccagcgtggggagagaagtctctgcgggtgttgagcttgttccgttcacagtctcctttgcccacagcacaggtggacgtgctgtcggctgccctgcgagcttccagcctggatgctcacgaagagaccagtggcgtagagcagcggagtgagctacaagatgaagtgtgtgtcagtgagcttccagactgtaacataagtcacgacacttgtgtgcctttgatcagcgctgctgaggaggtaagctcagtgcgtcaccaagcgagagctgcatgagcagtctccgtggggaccgtggggaccgtggcggccagaactccagccagcgctctgctgtcattctttctctagctcttcctttgtctaaagtaaaaatagttattctcacctcatccatccttgtgactttagcattgtgactaaaggctcaaaaaaagtcaatcctgtctatatgactgtttagatgggcggatgttgatgtagctcactgcagtgaaatagtcttactggaaacaaagccctttatcaagaataattaactcttcccttttctttttggagaggtgctttgtttctgatcggaccatttcactgcagcaagcaacacagtactctgagcagaagaccaggacttgaggccatgctgcggagggctgtggcattgtctggactcaagtgtgagggtgggtactgcacagcatcgtctttgctgcatccacgtagccattcacatgatcctaccctggtttcctactgcctttccctcaagccagaggcaggtagcgtctatttctctctctctctctctctctctctctctctctctctctctctctctctctctctctctcttacagacagagaaggaacaccactcataaccagagtgcagtgtttagactgaccctagcagcttgagtgatcaagctcagggaagtgccaggcagtgggggtggcaagggcatcggcatccttagtgctttggtgcggtcctgcttctgtggatggtgcctgacgcgtgtggatgtgtgtagcacttgtgcttcagggagtagcctgactgtatggaggcttggctgctgtgatgcacacgcactgcagggcaggctgagcctgtgtttgtgttctgcaagtgtagatggtgactgggaatagtacagcactgcgcgacacccattggaagactcctcctggtagtttatatatgagctaatacttttctcctttttaaatttgttgttttacattgatttaaggtgttttgcctacttgtttgtctgtggaccgtgtacgtgcagtgcccacagaggtcaggagagggcatcagagctcctagaactggagtctagagggttgtgagtcaccgcatgggtgctcccagcttgatcccagaccctgtgcaagagcaagcgctcttaaccagacccataaactaatttttctaagacttgttttaatacatttaacagctgttccacaagcttgatttaaagcgggggaaccttgttaggaggccttcagcatgtttataaacatttacaatcctaaaagtttctctctctgtgtctctctgagagtggtggatggtaagtagcccagttggagagtttgataagggaggatggcttccaggctgggcagttgttgaagtccatttttctcctgacagaatgcggaggccactcctgattatgtccatggaggtgcagacgtaagccctggtgatggcttcagcccggatgaagataggagacccaaagtccaggtgagtgaccagacgtggatgttgtatctgagtttgtaatccctcttcctaagcaagtggcaaaaccaacacaagcacacatattttccatgtcctggggtttgcatgggtgtgcgggaagatgggtgccctttacctttggggacagtcatctcgtgcttcttaggtgcatcccagtgttttagggattttattggccttcttgtgttttgttttcattctctagtcagggtctcactgtatagaccatgctaccgtcagacttactgtgtagctaggctgctcatgggtcacagcgtcctcttaacagctatgtaccaccttgcctgtctcaggcttgtgaattcaggcttatctttgtctttcctttcctttgtggaaatgaaccttggcgatctttctcataataagcaggcaggagcctcttagcctgacagctacagcctcgtctccacgaggtgcctgtggatcactgcaagccaccccagcccagcaggtctaccgcatctctgtgttgtctgcctcaggggaagggtccttttttatattttctctatttacatttcaagtattatctcctttcctggtttcccctccaacaacccccgatcacctctcccctccccctgctcaccaacccacccactcccacttcctggtcctggcaacaggacattcttagaaggagactcctctaagtcagtagtccgtggttatagctgtgtttctcatggagattgaatcaatgtttgattagaatcaaacagaaaagtattttttgaaacatacttttctgttatattgtaaaagtgttttaaagtcagtgcccatagatttgtcatcttcagcacatgacatgtttacctgggatgcagttacacactcacccagcttccacgctcagcagcctacagtctctaaaactccccttccaaagtacattgcacatgcattagcaagactgtgtgcacattttctctcatgaattccaaacacatgtgtacactttgattttctacatttttatagagggggacgtgaccttaactctttggtttgttttcctgagctagtgtctcgccatgtagttctggtttgcccagagggccgtctgcctgcttcttcctcctgagggttagggttggtattaaaagtgtggactgccaagcccagctccagtgtaagtttacagttaccatagaaggaatgtggcttcaactttttctttattttgacatacttctggtacaacatctagtccaagctggcttcagaattgatcctcctgcctcagccttccgagtgctgaaggactggcacacactgtcacacccttgccaggaagcatgttggtaatgatatggtcatggcagaaactcaaggagactcaccatagcctccttcataatgtacttttcaatttagtgacagcaattctgacctgttttaagaggctttttatttacatatgtatgtgtgcacacatatatacatttgcttagtacatgctatttttttagtgtatgttttgacatgtgtgtgcaatgagtgtggaggccaaaggttgattttgaatgtcttcctcaaccactccctacctggttttttgtttgtttgtttgtttgtttgttttgagaccaggtcttttgctgatcctggagtacaccaatctggctaaactagttggccagcaagaccctggtaatcccttctcaggcactagatatctcaggttttggaattagtattgatatatttttaaattagtcacatttatgtctaacctgctgataatttatttgaatgttcaaatgtgctatgtcccttttttttttttttttttttttggttaggatgttgtaccacaagcgttactggatcagtacttgtcaatgaccgacccttctcgagcacagacagttgacactgagatcgctaagcactgtgcatacagtctgccgggtgtggccctgactcttggcagacagaactggcactgcttgagggagacttacgagaccctagcgtcggacatgcaggtgagtgagcactgaagagtctggaaggcagcatatggctttattttatttattttatttggttttcacaatctgaagacttctgtgtcccaacaagtggttggtgttacagagaactgtgacagcttaaagcagtaccagaaagcacttgtcattgtagtcctgtatcgtccaagtttatcataggtgatgctagagactaaaagatatggtacctccctagcagtcctgctgaaagcgctcatttctcacaccttaacagagctgtatactgggcctgaggtttggtgcctgggtgcccagagatttgaaatgcacacatcccttgaaagcatacagaataaagggttgtgtggacatctggcttttcttctctttttcaaggctttgacttcagtaccccttgttcagtaaacaaaaagccaataataaagaccctgttctgttagttattaagctgtaaccttattattgagaaggcagtgttgggcctggctcgcacaggtagtaaatgctcactacccagtcaggacaccagggcttggctcagcttcctgggaaaaaggccttccagcttcctcactgtggctttgggcagggaaggaagcccagggcccagttcatcttggggttctgtcttctgtcagcagtcctcagactctctgcactctagcccttacatgccctgtctttgtagtccctcctccaggacatgtctgcttttgtctctctcagatgagttaccacaaacaggtttaccagtgagtgtgtgctatacacacagaggactctttatttttgtttcttaaattaccagttctgtacaaataagttttgggttttctccaagataacacagtacaagactcgggagggaagcgttgtatgggtgacacaggataatgtttaatacaagtggccagcagcagttcaggggtcagtggtcaaagaactgcacaagttagtagtgactcccaaacatgttttccctcacaagggaaaaggaaacagtaagtaccatagagggatttgagaatttatcacgggctggttaagagcactggctgctcttccagaggacctgagttcaaatcccagcaactacatgtggcttacaaccatctgttatgggatctgaagccctcttctagtttgtcagaagacagcaacaatgtattcaaataaaataaatctttaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcggaagagcagtcgggtgctctttaccccctgagccatctcaccagccccatgatgtaatttttttaagtatatatgcgcatgtgggtgccagcaaatgtggggttgtgggggttgtgggggagacgccaggttggagaacattgcctggattcaggtctttgctgtcaactgggatcagtgagtctagcgcagtgagctatcagcttcctgttgctggttggacgtctgagattactactgttcagagtacacagcactttgtgcttagatctctcacagtgatttttattcctacagtggaaagttcgaaggactctagccttctccatccatgagcttgcagtgatccttggggaccagctgacagctgcagacctggttccaatcttcaatggatttttaaaagacctcgatgaagtcaggataggtgttcttaaacacttgcatgactttctgaaggtaacttctaaatccttttgcataaatacataaaatatatactaaaagtctatttaagtctaaattctgatttccttttcttttttattttattttattgtgctggcagtgtttcttactaaagaaatatagccaaaagtttttgttagctgtgtatgacacgcctttctaagtgtgttgcagcttgaggataaaatgatgtggacactgtccattgtggtattaaggttgctcacctttgtatggggtctgctcgatttccttgagaatcagccattccacaaggtagttagtgagacactggaaaggcaaagctttgagtgctgtggatttcctatcctcatctgtacaccacataggagtcgtgtgtctgtctgtccatcctaagtgtatgtatgtgcagaatgtgtagtggtcagaagaggtggctgggtccctggaactgtagtcatcgcccactgccagagccccggtgcttaccacttgagcacttagcagcccagcgggctctctagcccacgctctccttctcaaacagggaagggatgggggagcaaaagatggagctcacattccaaaccccaggcatgggcactaaagatgggcacattgcaggaggtaatgggccagctagcaaaaaaaaggcagtgaaagaccttgtctcaggaataaacttagcaccattgctaactcacagtgttctcttctggcctctgcatgtgtgtgtacctatgtggtgtgtgtgcacagacactcacagtgaaatagagctgccatgtatctttaggataattactatatattttagttaataaaagcattttgttttgttacttcagcttcttcacattgataaaagaagagagtacctttatcagctccaggagtttttggtgacagacaacagtagaaattggcgctttcgagctgaactggcagagtaagttttaacagcttattggcactgtcttgtaggggtaggtttctctcatctctacctttttatgcttcctcctggcctcatgcccctcacgtcctggggcttcatcctttctcatcttacctgccttgctgccctggcttccatggagttgggtattaatgggcatccattggcagggtgctgtccatgcactgtggctgaggtgggctggggtgggctggggtgttactgcaggtggccttttctggtgttctgtcccatccctggctcccagccgtccctgcgctcaagtgcatgcacatatgtactggggagtctcccctctggctcgccttagtccttgcaggcctttggctcctgggctttctcagaggttgtcccctccctggcacccagctgtggctgcctgtggccagccttctgcacgtgcaggcctgtctcctctccccagtagtaggctgtgctgacttgcatttttaacatccatttttaaccttacatatgtatgttgttttgtcttcatgtgttatctgtgtaccacgtgtgcctggtgcctgtaggcatcgaaaaggggtggcaccctctggaactggggttcaggtggttgtgagctgtctgcttgctgactgcagctcatctgggtttttatcacattttggaaagtacttcttgcacacactcatccctcaggtgatgcagtttgtgtccccaggggcttgcctctctgggatttaatgtcaacagctcaccctgttgcccatagcaaaccctgctggagtcttgagcactgagtgcttggaaggctcctgctgcatgctccagttttccactgagctcatgtgtgccttggtggagtcaccctgccttctaagccagtgtaggagggagtccacgtgccagtgaacagataaagaaacattttgctctgtttctattcctaaacgcttttagtttattttgttggcgatgtgtaatatgagaaactgcttttttagcatatgatgctagtggctggaagtggaaatgatctggtattgctactgtcccaacacaggagagggaaacagggaagtacctgtgtgtgagcatggagtcagagtagctgtgctcagtacactaagtgtacacatacactcacatgtaccataccatgccactgaggatcatggggccccaactcacagtacagccacactgcacacaaattgctatccccagccctgcagcacacagtgttcctggggaaactacaggcatggaagcccccttctgtgtattccagcctggagggtgcccagcacaaaagtcagcttggttacagagtatctaaatgattagctgatgtctcatttttaaacctcggttgatcattttgttgctgtttgtgtctctgcagacagctgattttacttctggagttatacagtcccagagatgtttatgattacctacgacccatcgctctgaatctgtgtgcagacaaagtttcttcagtccgctggatttcctacaagttggtatgtttgtgcttgttggcctttgcatctgtggtgtgtccgttccgaggacaggagacaagccttacattatgtttccttctaggtcagtgaaatggtgaagaaactccacacagcaacaccaccaaccttcggagtagatctcatcaatgagctggtagagaattttggcaggtgtccaaaatggtctggtcggcaagcctttgtctttgtctgccaggtagggaaggcctggggagccctgctcgtgagactcctcccagtcctgcctctctcccctataatcatgagaaactgacgctgctctctggctgtctttcatgaggttgcatgctcctccaagttaggcatttgttggtttcattcagccagcacgtcctcaagctggcataggcacatagccacgtgtgccacaacactccctccatacatcacagtgcccaccagaagtcaggtcggaaatcaatgtatgcgctggctgccctgggtctgtttaaagccaagcatggtagagtgcacctggattctcagcacttgagaagtggacagagaggatcctgacctaaatgacctaaatggaatgggggaaggcagttgaaatttaccttatgataaccctaagactcaaagataggggctggagagatggctcagtggttggtagcactgactgctcttccagaggtcctgagttcaattcccagcaaccacatggtgactcacaaccatctgtaatagaatccaatgccctcttctggtgtgtctgaagacagtgacagtgtactcatatataataaataattctttaaaaaaaaagagagagactcaaagataagaacttccaactgcttttaccaccaccacgggcaggggtaccatttctagtagaaataaaatggatttactctgatggaacatcataaaacgtcctgaagcatcgtatggtattgtctgggttcccatcttgtgcttggtgatggctggactgacagtcacacttgtctctcccgccagactgtcattgaagacgactgcctccccatggaccagtttgctgtgcacttgatgccacatttgctgaccttggcaaatgacagggttcccaatgttagagtgctgcttgcgaaaaccctgcgacagactctgctggagaaaggtgggtggtgctggtaggatgtatgagcagtaaagagggtcacagaggccaggcaagcatgacacacaccttcaatcccagcacttggaaggcagacacagagaggcacatgggtttttgtgagttggaggctaacctgatccagtatagccaaggctacacaaagaaactctgtcttgaaaaacaaaagtgggagttgggagggtattttaatgaagacactggtgtttgggtgaaagtcttttattctggacatagggcatttttctaacttaaatcttgtaattttggtgatacggtgtttggggggatggttcattctgtaaagtgtttgctctgcaggcaagaggatctgcatttgctcccaagaacctgtataaacgtgtgggttgtgatagtgtgcatgtgttggaaggcagagttgggtagatctctggaactgagtggccatctaggcactgacaagcttaaagttcagttagaaagcctgtctcaaaaaaaaggggggggatggtttcacagtcttaggttttctattgcttgaccaaaaagcaagttagagaggaaagaatttattcagcttacacttccagatcatagaccaccattggaggaagtcaggacaggagctcaagcagggcaggaacctgaaggtaggagctgatgcagaggccatggagggtgctgcttactggcttgcttcccatggcttacttagcctttgttacagaaccaaggaccacctacccagggatggcaccacccaccatgggctgggccctcccccactgaccactaattgaaaaaatacctccagctggatcttatggaggcacttcctcaactgaggctccttcctctctgatgactccaacttgtgtcaagttgacacacagagccagccagtacaatgtggaaagtagtcaagggaaaatactgagtgccagttctggcctccatacacacacagtacattcatacatatacaacatttcagaacgtaaataatgggaagcagccaagctcctcagcagggtcaaacgagggtgccaagtacacaaggtagcctctggctccatgtacacagggctggcgtgcccgtcgtgaagacactccctgcagcttgcacttgactgtgggcattgtggctgaggtaggaggctcgtctttcccttcgttctctaagtaggagccaggcacctggcagtatgtgttttgttggttttagtactgtgactgccttctccaaatgccacatgaagttgagtgtgtgagctcatggacaagatatggaagaaatgtagagtaagtcatagtacaggaataagccaatactgcttttttccttgctttttgtatatttttacttttttgtcttgtcttgttttgtcttgttttttgagaccgggtttctctgtgtagccttaactctgtaggcaaggctggcccctaacctagaacccagagatccaccagcctcacctcccgagtgctgggattaaaggtgttcattaccactgcctggctcgatcttcccccaatcccatatacattttcaaaagaacagtaaaatggctttcccccttagaaaaggggtctgggtgtgattggtgtttatctgctcttttcctttttctgagctgaaaatagctggaactgttttaataagcatgagcttattcaccgtcaagagatttgcctatcaccaaaacaatctcacagtccctcttaagttagtgctgctttccctgcaccggtgagcttacagatggctgagtccgcgcacagtgcttactcagggaactattgtgcaggcagcgagccttctgcacctgactgtacttgactaaactcccaaacaccaagactaatgttgtgtcctgcacatcgtttccagagtacttcttagcctctgccagctgtcaccaggaggccgtggagcagacaatcatggccctgcagatggaccgagacagtgatgtcaagtactttgcaagcattcacccctccagtaccaaactctctgaagatgcaatgagcacagcttcctccacctactgacccacggtgtccatcctgcatccgcaagagcctggcctcgactgcctgcaccactcgggacagctgtggtgggggccttcctcctgccaactcattcgcaggtgcaggttgcctactcccaataccagtggttttaagagtcaagagaaagtacagtaaacactattatcttatcttgacttaagggaaagtaaatctcagaggattataattgtcaccaaagccttaactcgttccttcatcttcctgactgatggcttgaattggcagagcattttcccttcgggaaggatgaggttcccagagacctgcgttgctttcttctggttttatttaacggctgataaatgacattcttacggccagaaggtggatgtgcaccggacaggaaaggccttcagtattagcctaagcatttcttctaggtgctgagcctgttcagctccttggctgccctgcccagcccagccctaagtgtgaatagttcttggcgtgtataaatgacaaaggagtttttcctctcctaagggcttgatgttaacactaaatagaatctgattttgactcctaatgcagcacattgctgtacacatttacagaatgtttgcagaatctctcctgatatttttcatgctggtcatgacctgaaggaaatttcttagcacgaatattgtgtcaggtatttttaacttgatcatggtcagctctgaggtgcaactgtgtcttcccgtgctgcacccctgtgaccactctggggtgtgcagcctgaatcatgctgttagaactgttgtggtacaagctccaaataaaatttattaataggatctataaagagagacaccacccactttgtttcctaaatgtctacaaataaatgcagtatgtggcctgtattacttagcataagatgggagaaaggcgtttgtctttagctcagtgttcacctgtcagccctcctcttggcaggcggcagcagcctgaagtccaggctgctatgaacaccacctactcagtgcgccatggaagggcagccagggcgggtgttggcttcacttgaggactgacccagccttaggatgctaagccttagcttccatccacgaccccttcggccttgcagcttccatggtgggagagcgcgcaccttcacgggtggcccctgacctctgcaggagtgcaatccaggtaggtggttccaggccctgctgctccctggaactgactcaccctctctcacctctcaaaaccaggaccacatgaaacagctaccaaacctgagatgcagatttgcccaccctggaccacaccttgtatgtgctgaccctgagtaaacatccttcccagagcttgactcagtgtgttggtctcactacccagtgactagcatcaattgtcccagtaaagccaaggtttcactcattcttgttactcacagctcacttttcagccctagcggaacaaaacaagattctttattcaacatgtcacacaaacaacagtaggcccccactgctggtatttctctcagtatttcccacctttccacacaattgctcactgagccatgagcctcaacagcttctgcagagcagcattcccaatccatcttgaaactctcccctaaacagcggagccttgtcccgtctgtctgtcccagcaggggctccaccccagaagcgcccttccattctagtctgcttttccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactctcccctaaacagcggagcctcgtccgaccccagaagtgccttccatcctagtctgctttccaacgctgagaataaataccacggtcagaagcagcctgggaaggaatgggttcatctctgctgacaggttcattatggagggaaggcggccagggcagaagcctggagcaggaactgaagcagacacctgaggggcaaagctcaccggctcagcgtgtttatatacctcaggcccacactgggctgggcattcccatggcaatcattactcgaagaagaaatcccgtctgacggaggcagttccttaacggacatctctttctagacaaagctgctatcttgtccagttgtcaaaacctagcacaggaaagagttggctgactgggtttgtgtctttatcccagtccatcactgagggaacccaggagggacactgctgactagcctgctccccgtggcttactcagcccactctcttgtacagttcaggaccatctgcccagaaaatgtcacacaggcatctctgatggaggctactttcctcctagtgactcacttgtgccaagctgaccaaaagtaaccagcacaccatgtcaccttttaatgtcagttcctcagtagctgactgtccagaagcagccagagctgccagaatggcagcctgctaaaaaaaagaaacacagccattaaacctgcagagccaggtctctcaggcaaaagcaacagcaaaccaattagtacttgaagtagttttcctgatgtaaaagcaagtacagatataatgtattcccatgacagtttgtgactagtacacagtagtaataagtgccttgtagctacttcatactgtgtagctagccttagggagcctataggctgctgagtaggcgaatgctcagcttctcaccccaaaatggagtaaaagaggctattctggagccagaagaaagtggtcacggaacaggcttagctctccacaaacaccatattccaacatggcaaagtttcgtgaagtttttctagtaaggagacaaaggtggtaaatcgagatgtatttttcagctaccctggtggaaacaccaggcgggtgggtagaacacactgacctctgctgcaggactcaggttccctagccacaagcttagtgtgcgtcctaccggaaactcatagtttgctgagaattcattgtgaggagttttgatagtgacagtgaacaaggaatggttttcagagaaactaagaggagcacaagagaatttggtttcagtctgcaatattttaactccctggtcaccatgtggtcttgtaggatctttagtaacactgtagcccctccccacttctgttccttgcagagaagccatattcttcagaggcagcttgctcacctctccccagccggtctttctcccctttgtttacaagtatttgcagtttctgacttaagaggcaacagagactgtcgcctgtgtccttttgctgactgcctcctactcccttatcccaccccggaactagagttcctgcttgcttgcgtggttgcccagggaatggccatttctttggtacataacctttttcctgaagctttgggagttaaccatgataccaacactttagattttcttaaccccctagaacttcaaatagagcagctatcccaggggagcaacaattgtaaaattggcagcttttgtcaaagacaaaagttggctcatctggctgcttggcaggcagtaggcagcatggccccagcgctctttaatgctttctctacttagagctggaattttgagatctacctacctgcggtctacagcctacagccccagacagcagccaggaggatgagcatatatagcccagggagaatctcttcctccatatccacctgtcctgactatgctggaacccccagtcccaggataactggaaagacacactagtttctcgtctcaagctgtagtgaccataagtgccgccatttggaaaaggctgggcaagtgtcagcttggccctgggtcacgttcatgtaaaatgctaggcagcagggatgtgtgcccaggggtgggggaggaggggcaaggaagcaggattctagaagctcagtcccgacgaatcaatgtgaaacaggaggaattgtaaggttcatatactcaatggaatactattccactgtaaataatgaaagcattaaacttgcaggttaagtgggcaaaactagaaagtagtatactgagctcccgccccccccccaaagaaaacaaacacaatatttgttttcttatttgtagatggtagctccgaatcttcagatgcaaatatacctggagtaatcagataccagagaaacgggatggtgttgtgggaaacactagatggatagagacctgcctgcaggagagggagaaggggtagcgaacactaaggctactgaaaagctacagacaacattgcaccatgactcaaaattacagagccagctgtggtgtgcacctttgccgctcagcactcaggaggcagaggcaggtggatctctgagttttaggatagctaagctaaagactttgtcagaaaaccttatgtatattatctatgttaacatacaaacatgtaagttcatatgtagttcaatggaagttttgccaattagtgacacttcctccaaaatacacagaacagctaacagacatcatctcagtgctgggcacagggagcctcctttagagttgctggccagggggcagtccaagagatccccaaacgatacaggccttgttgttgtcgtttatgccgtccaggaaaaaaaagacaaaaccctactgctgaaggcaaccacacacttccaacacaggatttaacctggaagccttctcgctggggactggctctcaggatggaaccatgcaagccgctcacagcaatgctattatcagtaccatcttgctgtaatacattagtgaccatgttgaagtaatggcttgtacatcctatgggtagccagcagtcgccttgttggacttaaggcccacttagtagagaattcatgcctagctctatgaactcagccaggtaccacgtatgcctgatgaggacctggagcccagatggcctgcagccacttccctcaccagggtcattctacactcatccccataaccacagattgtcaaaagcttcttttttgcagcaggcagagattacagaaagccacagctggtgatatgcagagatggactgaggtgtttgatccaatcaatatatctgcaatacgatttgtacactgaaggctggtgagcaggagcgggggaagaggatagtctaagccagaggactaagacatctgtctgacagtctcttcttaaactgacaaaaggacagacacacagagggatgaggtgataggatcaaagtatgttatatatgaaatcccataaaaataagatatatttactatgtaaaaagatatttaatactaattaacaatcaagaaaagacacccaatgtcagcctctggcctccacacaccatacatacagtaatagacttacctacaatagacatacaacagacatacagtaacacacaaaataaactgttgatgcagtcttgcctgtgccctggcgcttcatgacaatatgcagattatgtcctcaggaaacgtctatgccttaaagccctacactagggattaaatctaataaaccttcctttttgaaatgaggatttttgttttgtcaatgagaaatgaagccctacaggataaaattgcttactgggggtgaagcatgcaagctatgtatttcctgtgcctccctgaaagccgtttctcacagttgagaagcccaagccccaacactaccagacacccagggccccttcgcctgaagtacatacacacctgaagagaggcaggagcctgcaccttgctgaagacatcaccagaggacatggtactgagcagacgtgaagcagttttaaaaattaactacagctcactgcaaatgaagctattcctctttcctctgtcaaactagaacaacttttcatgggtcgtactaattgaatggtggcaaaaccccagattagaggggacaagcatccaggctggaattgggcagtgggggacgtggacacagcagcagcaccttactgctctgcagagggagcctgtatatgggaatttaaggaccctgctacttggtccttacttcctgggtctcctgaagtccagtatagaaccatttactaattatgcatcatcttacaagtgtgtaatcttatcacgatctctctacctagttgataggggtctttgatttgtttctactgaagaatatcaactaagcttagatcatactcagacgaataaaacattagcaaaacgacctggaggaaggttccagaaagcccagtcttcagctggattcaccagccagggtatatattgtgtgtgtgtgtgtgtgtgtgtgtgtgtgtgtgtgtgtgtgtgtcaccagccagggtatatattgtgtgtgtatgtgtgtgtgtgtgtgtgtgtgtcaccagccagggtatatattgtgtgtgtgtgtgtgtgtgtgtgtgtgtgtgtgtgtgtgtgtgtcaccagccagggtatatattgtgtgtgtgtgtgtgtgtgtgtgtgtgtgtgtcaccagccagggtatatatagtgtgtgtgtgtgtgtgtcaccagccagggtatatatagtgtgtgtgtgtgtgtgtgtcaccagccagggtatatatagtgtgtgtgtgtgtgtgtgtgtgtgtcaccagccagggtatatattgtgtgtgtgtgtgtgtgtgtgtgtgtgtgtcaccagccagggtatatatattgtgtgtgtgtgtgtgtgtgtgtgtgtgtgtgtgtgtgtgtgtgtacaggcctgcatgagcacacatggcatgtgaaatgagaaatctgatatctgtgtcctctatcactatgctttacttttgggagacagggctggcctctgaacgcagagcacactgactcccctagagcagctaactagcatttacaggatcctcatttccaccagggtagaattacaggtgctcccagcactcctggctctgtacatagacaccagggtctatacccaggacttcatgcccggtgttgttcagtacagagccgcctacagagaagagcacggtgagagccatgagtccccgcttgggagctgatcctcttcgggccctcatttccagatccctgcctgaagttaagatgtcacagcagggtatctggaaccttctgtaaagcaacataaattctgtggtgcagttaaactactagctacagattcagatgtttgtcatacgtctctagcatgctagctgctctaagtcctcatttcacatttaaaatgcaaacctctgtaacctctaacaactgggccaagccttctggacttgacctagaaggcagagcttgctttcccaacagcaccaggaaactgtcaggttcaggaactgcacacagtctgagcaaacccttccagtcagcagcaagcacggtgggccgagggccaagagaccacagcaggagcacacacacagcatgggcgaggagcgaggtggaataaggcttcccactcgctctccaccttgggcatctccaccagcttcgtgccagatgctggctatgcaattatttcaaagagaagagtggacaatagaagcctttttttttttttttttctcaaatggctgttgaatttatttccttgatcaataatggtcctggcaaaaattagttaaccaacatcgagacatttgtaatgaaatactaattttaaaaacccatgataccttgatagaaattagagtttacacaaacaaaaagaattcttcaatattgccagcaaatataaagtggatgttgtacaccggacgggatgcagcaaggcgtttgtacatttatatttgacacctgaccatatttccagtcaccataatatcttctctccagatttaaaaaaatagtatgctgatttctataacaaagctttttttccgtacaaaaatcaaataatggccaacaagtcacaacagtgcaataggcagaggcgaacaaaaaaccgcacaaaagacaggcgctgaaataaatactaactaggaggagaccagagccctcctgcgggtttgtcgctcactttagagtgtgggatttgtcttcagagccacaggggacctccctgggggccactcatctgacagtgagatctggctgcctaagaggcaggcctcccagactcggggagcagtcatctgagttagaagcaaacaccaggtggggtcagtcacagctaccggttcggctcggttctgtcagagtccttatagcagccccttgagatgacgcggaaaggtgaacgttctgcgtgagagcatttacatggcttatcctggcagaggtgtgtatcctagcccaagctagcagctgaagtcactgtggttttcttggaaggtcagtgtggagaagggctctggtttgagaagcttcctgtgcaacgcctcagagtcaaggtggtcacctccgaccacctcagagaagaggcctttgctgatccctggcagtgagtgagtggcttgcactgcccaggctggtggcaggctgcacaggtaacttctgtctgccaccaacctgggccgtcctgactcacacagacagacccaactcggaagtggaaaagcaacgtggtgcagggaaccccagcgagagcctttctggccagtcagagaatatgaggcagctccccactgaacaatctgcaccaaaaggtgtggaaggcacaaacaagagtggccagagaccctgcagggctggggagaccacgagcgtccacgaggcaggcgcagaagtgacctgatttggttcctaccctttgataagaaagagagcctgattctgctgtgatttaaaaaaaaaaagccaaagaaaagaatttttggtttaaaaagaagccactcaaaggttaaaatagttatttttaacaaagaaaattatttttcaaataagctgacactatctggaaatgcctgtgttccctgcaagccccccgtgtgtccactgcttcagcctcccaggccctgagcctgacacggagtcagacgtgtgcgagaggggacgtctctgagagcgagcctttacagagtgtccagcaggcaggcggctcactcacactcacagtaagatgcacagggcccggcccgcagctcagatgggcgtctccttccggtctttgctgggcgaggccttcgcctgctccttggctacccgcacctcgaggacaccgtcacagggcggtgggcctgtgccccctcgcctctcgggctcctcctcctcctgcggctgctgctcagacttggctcgctgcatctggagcagccggagctgcactcggagctcgatgatggcctcccgctcctcatggactgcttggttcaagtgattgttctttatcttaaagaatgacagaaagggcagttaccacttaagggcacaaggaatctaggcagagcacaggctgcaagccatcctgagaaagatctagttctattctagccagcctggctggtgcagcattagataagaagatggatatgtggctagggtacaagcatcactctgaatgcctgagtatggactctgagttacaaagagaaacacatttaggaaacgatgtgtcaccagagcagtgaggacaggggccagggctgggtaaaagctgagactcttcccaagtcaaagtctctctttactgaccacatctgaattgtgctccttgaggagtgtgggaaccacagctgcttaaatgctggggactcactcattcagcaggaactcacgggtagctcaccccgagctcctgcaaccgccccagccatcggaacacccttcttcctcgggatttccccgcatcctaagcagctgtgcccacaactcgactttggttcagtgaggtgagcagaggtgccagtcccactgctcgctcggtgtgacactggggaagccctgacccgtccctccccaactgagaacacggcgagatgcaggggagccgctttggctcgagcaggccctacgccacgtgcacaacagaacactcccgattctgccatttgttcctgttcaggaaaatggagatcaaaccaggttgccaatgtgtcttctaaatgccagaattcccagcaacccgtctcactcacactaacttcctttcttatgttttccaaaacaaggtctcaactctgtagaccaggctggcctcaaactcagagctctgtgcgcctctgcctcctgagtgcagggatcccttaaggggtacaggtgcgtgtgtgacacaggtgtgtgcacgtgaagggagttggctttaactcggggcctcagcctcactgcagccccttcaccagtggggccatgtccctggatcctatcacacagtggatagcagagtcctgggcaatccttaaaatattatttttatttatgtctgtgtgagtgtgttgagtcccttagaaccagagttagacagttaagagctgccatgtgggtgctaggaaatgaacctgggtcttctggaagaacagccagtgctcctaactgctcagccatctttccagccacagtagtttttctatctttctgttgtttttcaagccccaactgtcctggactcactctgtagaccaaactggcctccaactcagaaatgcccctctttgcctcctgagccaccgcgcccagcctctgtgcttgaccccatgcgcacttgcctggcaggcagttcagtgaacatgaatgaagcaaaggtgtctgtttacctagtcgtccttacagaagacaatgtttattcaggatgaaaagagaaccccgcttaggccagcatctccctctcagtccagcttcccaggcatcctgtcacacccactcctctgtggtaccccacagactacaagaaagccactgcaaggcgacttaggacagtggccgggcgcctctcacctcttttaggc

SEQ ID NO: 1976 - DNA, 3280 bp, Mus musculus
aagcaggcactgcttcggcaggcagggcccttggagtttcagcgcactataaggatatttctgatgtctctgctagttgatgtggatgactacagctcagagtctgatgtgattattataccttcagccctggacttcgtctcacaagatgaaatgttgacacccttggggaggctggacaagtatgctgcaagtgagaacgtatttaacagacaaatggtggcccggagtttgctggatactctgagggaagtctgcgatgatgagagagactgcattgctgtcttggaaagaattagccgattagctgatgactccgaaccaactgtgagagcggagctgatggaacaagtgccgcacattgcactgttttgtcaagagaaccggccttctataccgtatgctttttccaagtacttactaccaattgtggtcagatacctcgcagaccagaataaccaggtgaggaaaaccagtcaggcagctttgctggctctgctggagcaggaactgattgagcgatttgacgtggagaccaaggtgtgccctgtcctcatagacctgactgccccagacagcaatgatgatgtgaagacagaagctgtggctataatgtgcaagatggcccccatggttgggaaggacattacggagcgcctcatcctccccaggttctgcgagatgtgctgtgactgtcgaatgtttcatgtccggaaggtctgcgctgccaattttggagatatttgcagtgtagttggccaacaagcaacagaagaaatgttggttcgccaagcagcctttcagtctctggggcctttcatatccacgtttgctaatccatcaagctcgggccagtgctttaaagatgagagcaagaactcagaagactcctcggcagaagacaaagacaggtatgatgagtctcctcaggaagcagctagcaatgatgagaatggtagaaagcctgacaccaacagcaagtctgcgtcccggccagacgctggcaccagctccccagaggccactcccttagaccaggacatgttcaactccttccatttctggaggactcctctacctaaaatagatcttgataaagagctccagcaggaccccgaggagagactcagcccagagagaacaggagatgtacctgcagcccctctaccaggccctcccaatatcaccatggctacccggaaggaactagaagaaatgatagaaaaccttgagccacacatggatgacccggatgtgaaagcacaggtggacgtgctgtcggctgccctgcgagcttccagcctggatgctcacgaagagaccagtggcgtagagcagcggagtgagctacaagatgaagtgtgtgtcagtgagcttccagactgtaacataagtcacgacacttgtgtgcctttgatcagcgctgctgaggagaatgcggaggccactcctgattatgtccatggaggtgcagacgtaagccctggtgatggcttcagcccggatgaagataggagacccaaagtccaggatgttgtaccacaagcgttactggatcagtacttgtcaatgaccgacccttctcgagcacagacagttgacactgagatcgctaagcactgtgcatacagtctgccgggtgtggccctgactcttggcagacagaactggcactgcttgagggagacttacgagaccctagcgtcggacatgcagcttcttcacattgataaaagaagagagtacctttatcagctccaggagtttttggtgacagacaacagtagaaattggcgctttcgagctgaactggcagaacagctgattttacttctggagttatacagtcccagagatgtttatgattacctacgacccatcgctctgaatctgtgtgcagacaaagtttcttcagtccgctggatttcctacaagttggtcagtgaaatggtgaagaaactccacacagcaacaccaccaaccttcggagtagatctcatcaatgagctggtagagaattttggcaggtgtccaaaatggtctggtcggcaagcctttgtctttgtctgccagactgtcattgaagacgactgcctccccatggaccagtttgctgtgcacttgatgccacatttgctgaccttggcaaatgacagggttcccaatgttagagtgctgcttgcgaaaaccctgcgacagactctgctggagaaagagtacttcttagcctctgccagctgtcaccaggaggccgtggagcagacaatcatggccctgcagatggaccgagacagtgatgtcaagtactttgcaagcattcacccctccagtaccaaactctctgaagatgcaatgagcacagcttcctccacctactgacccacggtgtccatcctgcatccgcaagagcctggcctcgactgcctgcaccactcgggacagctgtggtgggggccttcctcctgccaactcattcgcaggtgcaggttgcctactcccaataccagtggttttaagagtcaagagaaagtacagtaaacactattatcttatcttgacttaagggaaagtaaatctcagaggattataattgtcaccaaagccttaactcgttccttcatcttcctgactgatggcttgaattggcagagcattttcccttcgggaaggatgaggttcccagagacctgcgttgctttcttctggttttatttaacggctgataaatgacattcttacggccagaaggtggatgtgcaccggacaggaaaggccttcagtattagcctaagcatttcttctaggtgctgagcctgttcagctccttggctgccctgcccagcccagccctaagtgtgaatagttcttggcgtgtataaatgacaaaggagtttttcctctcctaagggcttgatgttaacactaaatagaatctgattttgactcctaatgcagcacattgctgtacacatttacagaatgtttgcagaatctctcctgatatttttcatgctggtcatgacctgaaggaaatttcttagcacgaatattgtgtcaggtatttttaacttgatcatggtcagctctgaggtgcaactgtgtcttcccgtgctgcacccctgtgaccactctggggtgtgcagcctgaatcatgctgttagaactgttgtggtacaagctccaaataaaatttattaataggatctataaagagagacaccacccactttgtttcctaaatgtctacaaataaatgcagtatgtggcctgtattacttag

SEQ ID NO: 1977 - protein, 792 aa, Mus musculus
KQALLRQAGPLEFQRTIRIFLMSLLVDVDDYSSESDVIIIPSALDFVSQDEMLTPLGRLDKYAASENVFNRQMVARSLLDTLREVCDDERDCIAVLERISRLADDSEPTVRAELMEQVPHIALFCQENRPSIPYAFSKYLLPIVVRYLADQNNQVRKTSQAALLALLEQELIERFDVETKVCPVLIDLTAPDSNDDVKTEAVAIMCKMAPMVGKDITERLILPRFCEMCCDCRMFHVRKVCAANFGDICSVVGQQATEEMLVRQAAFQSLGPFISTFANPSSSGQCFKDESKNSEDSSAEDKDRYDESPQEAASNDENGRKPDTNSKSASRPDAGTSSPEATPLDQDMFNSFHFWRTPLPKIDLDKELQQDPEERLSPERTGDVPAAPLPGPPNITMATRKELEEMIENLEPHMDDPDVKAQVDVLSAALRASSLDAHEETSGVEQRSELQDEVCVSELPDCNISHDTCVPLISAAEENAEATPDYVHGGADVSPGDGFSPDEDRRPKVQDVVPQALLDQYLSMTDPSRAQTVDTEIAKHCAYSLPGVALTLGRQNWHCLRETYETLASDMQLLHIDKRREYLYQLQEFLVTDNSRNWRFRAELAEQLILLLELYSPRDVYDYLRPIALNLCADKVSSVRWISYKLVSEMVKKLHTATPPTFGVDLINELVENFGRCPKWSGRQAFVFVCQTVIEDDCLPMDQFAVHLMPHLLTLANDRVPNVRVLLAKTLRQTLLEKEYFLASASCHQEAVEQTIMALQMDRDSDVKYFASIHPSSTKLSEDAMSTASSTY

SEQ ID NO: 1978 - DNA, 87687 bp, Homo sapiens
  misc_feature (1)...(87687): n = A,T,C or G
catcatgttggccaggctggtctcgaactcctgaccccaggtgatctgcccacctcggcctcccaaagtgctgggattacatgtgtgagccaccacgaccagccaggctatcattttcttaagaattcatcaagttaaattctttgataatgttttatagttttctatgtaatggtcctgcacatctttcattaggattcattttgaggattcaaccttcttaatgctattgcaagtaacattaaaatttttaattctatttataattattgagtagttatataatagatatagaactgatcttgtgtctaatgactgctaaatttacttttaaactttaagtttattattattattttgagataaagtcttgctctgtcactcaggctggagtgcagtggcatgatcatagctcactgcagcgtcgaactcctgggcttcaagtaatcctcccacctcagttttctgagtagctagtactacaggcatgcgctgccacacatggctattttttacatttttttagaaatgggtcttgctatattgtttaggctggtcttgaactcctggcctcaagtggttctactgccttggcctcccaaagtgctgggattataggcgtgagccaccacactcagcctattttcacttttttttttttttttttttttttgggagacggagtctcactctgtcgcccaggctggagtgcggtggcatgatctcgactcactgcaagctccgcctcccgggttcatgccattctcctgcctcagcctcctgaatagctggaaccacaggcgcccgcccaccatgcccggctaattttttgtatttttagtagagatgaggtttcactgtgttagccaggatggtctcaatctcctgaccacgtgatccgcccgcctcgtcatcccaaagtgctaggatacctattttcacttcttatagtttatttgtagattcttgtatcttctacatatataatcatgtcatttgtgaatactgacagcttaactttggatgagacacattttacgtaggaagatgtggagaaattagaaccctcatacattgctaatgaaaatgcaaaatagcgtggatgcattggacaacaattgccagttcctcaaagtagtaaagatggagttaacagccgggcgcggtggctcacacctgtaatcttagcactttgggaggccgaggcgggcggatcacgaggtcaggagatcgagaccatcctggctaacacggtgaaaccccgtctctactaaaactacaaaaaattagctgggcgtggtggcgggcacctgtagtcccagctactcgggaggctgaggcaggagaatgacgtgaacctgggaggtggaggttgcagtgagccaagatcacaccactgcactccagcctgggcgacagtgcaagactccatctcaaaaaaaaaaaaaaaaaaagatggacttaacagataacccagccaaggctgcagtgagccttgattgtgccactgcacttcaacttaggcaacagagtgagaccctgtttcaaataaaacacaacaaacaaatgaaaaaaacacacaacccagcaattccacttctcgggatataaccaagagaattgaaagcatatatccacacaaaaacttgtagatgaatgtttatagcagccttattcataataactaaaacaaggaaataatccaaatgtccatcagctggtgaagggataaataaaatgtgatatatccatacaacggacaatagacattaataaaaagaattttttaaaaaaagaatgaaatactgatacatgctaaaacatagatgaatattaaacacattcagctaagtgaaagaagccagtcacaaaagaccacgtattatacaaatccatttatgtgaaatgtccagaatagagaaatccatagggacagaaaatacattactggttacgcagaatcggggttgttgtagtggcaatcaggagtgactgttaatgatacgtgtttctttctggggttatgaaaatgttctcaaattagatgtgatggtcacataactgaatattctaaaaactaaagaattgtacattttaaataggtacattttattttatttattattattattttttgaggcagggtcttattctgccacccaggctggagtgcagtggcacgagcacaactcactacagcctccacctcctgggttcaatccatcctcccacctcagcctcctgagcagctgggactacaggcgtgcatcaccacacccagctaatttttgcattttttgtagagatggggccgcaccatgttgcctaggctggtcttgaactcttgggctcaagcaatccgcctgccttggtctcccaaagtgttgggattacaggcattggccacctcgcccagctaaatgggtaaattttatagtctataatttatatctcaataaagctatttaaagttttggggttttttgtttttttttgttgttgttgttgttttaaacggagttttgctctttttgcccaggctggagtgcaatggcacaatctcggctcactgcaacctctgcctcccaggttcaagagattctcctgcctcagcctcccaagtagctgagattacaggcatgtgccaccacacctggctaattttttattattatttagtagagacagggtttcaccatgttggtcaggatggtctcaagctcctgaccttaggtgatccaccctcctcagcctcccaaagtgctgggattacaggcatgagccaccgcgcccggcctaggctaaacttttttaaatataggactttgaaagctttaaaaaataggtaaacataaactgtttgggggtattatctctaaatttttggagattttagttttttctttatacttttctgggcactccaaaaacatgtatttttgtaattggaaaattcagaaaagaataaatgttacaaagatgtagaattccggccggccatggtggttcacacctgtaatcccagctctttgggaggccaaagtgggaggattgcttgaacccagcagttcaagactagcctgggcaacaaagtgagaccccatctcaaaaaaaaaaaaaatatgtagaattccacccctcccaacacctgccacatacctacaagcagcagcaacaacaaaacctcctaaaaaaccaagaacatcgtttgagggagaagtgagttggcacctgagttcaagattgtctacctggatgatttgtccgaataatgaaatggtggcaaactgcagccattcaagccaagggcagctggtgagaggacactgttaaggcacttgcttgggaatttcacagaattgtgatgaacaaaatattatatgagaaagataatttttgtatccttggccagaataattgaaacaggctagttaaaaagttattagtatggttttgaagtggttaatatcttggtcaggatattgagtgagaaacggagtgaagaggtgactcctaaaatgtttcaatgacaaaatcctcagggaacagtgataacttagatggaattagagattataccaagaccatacatgttgaaagactagaagttctcttaatgcgaaagaagttgacgaaggaccattttgacagaaaagctatgaatgtgaggatacgcaaacgctattgccattatttagaatcaggattccagtgtttgaatactaattcccctatttgcttgcttgtttgcttgctttcttttctttttttttttttttgagacagtctcactctgtcacccaggccagagtgcagtggtgtgatctcggctcactgcaaactccacctcctgggttcaagagattctaatgcctcagcctcccgagtagctgggattacaggcatgtgccaccacacccagctaacttttgtatttttagtagagacagggtttcaccatgttggccaggctggtctcgaacccctggcctcaaatgatccacccacctcggcctcccaaagtgctgggattacaggtgtgagccactgtgccaggccatttgctttttgatctttgtcaaaatacccaacctttctgagcttcgatttcctttatttttaaaatggtaatatcaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaatcgcttgtacccgggaggcggaggttgcagcaagctgagattgcagcaagctgagattgtgcaactgcactccagcctgggtgatggagcgagattccatctcagaaaaaaaaaaaaaaaagaaaaaaagaaaaaaaaagaaaaagcgcttaacatgatgcctggcacacgctctgaaaaatgtttcatatatacggtaatattaccattgggggaactgatgtgaaagtgacataggacatcctggcacatcatttgaaacttcatgtaaatctgtaattgtttctaaataaaaagttagaaaatgtattagctatctagtctgggaattatattgtgtcattgtgctaatatttttcccaccaaaggaaggaaccaaggaccagagacacaagcaatttgttacaaacagttacagagaagtgaaatgagaatggaagtaatttcttctgaatcatattaccatagagcagccttagtgtgaaggaagcttagagtcagggcagttaaccactgaacttatctgggtttgaatatgtggtttgctatggtttatttcctggttcaacttgactcatccattcagattcagaataataaacatttaaacatttaaaataataagcatctaaaatgataagcatttcctccacacgtactctgtgccaggcattgtggaagcctctcccatattgctttgaatgggattgcaactaaagctttctaaattctaagagaaaggcacaaaggaaatttactactgccactctaatccatttagtgctcactgtttaaacatctttgttttctcttaatgaaattaaaatgtgtggaacaaattgtgtaggatgtagtacctcatcagtggggaattcttttgcctctactaacctggagcactgggaaaagcacgggagtagggaacatagtggataagaaaaagagggtttattttcctttatactcagtttacagtagtgattccagcaggatgcactattttgttcagaaaaagctgatgctaagaaacttggagctgtggctgacgaccctgggacagagctgaagttctgttgcattctcggggcagtgttcagctcctgtaaatgtagaaagaacagcctgaatcagggtaactctgtatagagctcagttctgtaggtatttttcttctcttttttcttttcttttcttctcttttcttttcttttcctttctttccctccctccttccctccctccctccccttctttctttctctcttctttcttaagcacagtgtgagaaaatgtctctttagctgatgtgagtaaagagatcaaatatctttgaaaaactatgaaagctctaggaaaggctaaggcttcacattcagaatgtcaccttgacagggagctttaaagggagatagaagaagcatagagaggaggacaagtaaaatttcacaaatatacaatttttttttttttttgagacagtctcgctctgtcacccaggctggagtgcagtggcgcgatcttggctcactgcaagctctgcctcctgggttcacgccattctcctgtgctcagcctcccgagtagctgggactacaggtgcccgccaccatgcctggctaattttttggtatttttagtagagactgggtttcactgttagccaggatagtctcgatcccctgaccttgtgatctgcccgcctcagcctcccaaagtggtgggattacaggcgtgagccactgcgtctgtccttacctttatacaatgtatagaaatgtataggaggctttaggtaagagactggcaattagtttttttaaattgttacttttttttttgagacagactctcactctgtgtcccggactggagtgcagtggcatgatcttggctcactgcaacctctgcctccccggttcaagtgattctcctgcctcagcctccctagtagctgggattacaggcatgtgccaccatgcccagctaattttttgtatttttagtagagacagggtttcgtcatgttagccaggctggtctcgaactcccaacgccaggtgatctgcccacctcagccacccaaagtgctgggattacaggcgtgagccaccacacatggcctaaaaattgttcttcttatttgaaaatgagtttatgagggacattttgtcaatctggcttcaaaaaagatgaatgaaatcaatggtaaaaatttgtttaacgtgctcgtttcagcagcacatacactaaaattagactgatacagagaagattagcatggcccctgcgcaaagatgacacgcaaatttcattttaaaaaagcaaataaatatttgtttaaaaatcatttttaatcatgtaagtatttctccatttttcagactgtttctcttttcatcatttaaaacaataaataatagggctgtccttatatactttcagtttcaggaatgataattctgaagaaaaaagtgaatggttcaatcaccgatacaaaaattaacaaacatgatagtggcaagcaacatcaggtgggttttgtttattagcgatgttttcgccattttttttttatgtttgtttgtggttgaaaagccagacacattaatttccaaggctcattggctgctaagaaaaattgtcactgtggccaggcacagtggctcatgcctataaccccagcactttgggaggccaaggcgggcagatcacctgagcccaggagtttgagatcagcctgggcaacatggcaaaaccccgtctctacgaaaaaataccaaaattagctgggtgtggtggcgcccacctgtagtcccaactactcagggggctaaggtgggaggactgccagagcctaggaggtggaggttgcagtgagctgagactgcaccactgcactccagcctgggtgacacagcaagagcctgtctcaaaaacaaacaaacaaaaaccctttcattatcatttggaagaggacttattcttaaaaatgcaggccttagtacttacatagttggatgatgcttttaggaaaatgacttgggacactccccctatattttacacatttcagtggcagaacaggataacaattcagacttcctgtgtgtctgaccacggacaacacacagctctgccatccacgagctgcattgtaagtgaagctgggttaaaggtatgtagaataatgattgctattatttgtttaaatattatttcttagaagaaggggacagagtgcagtttgtaaacactggtttaaaaactcctttcttttagaaaggagagaaagtgaaatgtaaaaaacacatatttgtgctgaaccatgaatgataccgtcactgaaatatctaaaaaccatattgcttaaaggcacttcttgcaatgtgtaattcagctaagatgataatcaaatgcatagctcttgaatacagaaaaatgatacagatcctcctcctttgctgcccttcccacagaatactgagataaaacttactgaggcctagctaccaaaggcagaattagttgttccatatcctaggctagcatttggtacatagtccctattttatcatgattactgagaactgttaagtctaactcaactgtgtagatcaagacagttttgtcttagtgcatccagcggctgaagcacagttggcacgctgtagattttgtgttgttgcggtgagaccaccagttagaataaagagctgatttgggccgggtttggtggctcacacctgtaatcctggtgctttgggagaccaaggccagaggattgcttgaggccaggagttcaagacccacctgggcaacacagtagaaccacgtccctaaaaaattttaaaaataaattggccaggtggagtggcctgtgcctttagttccagttacttgggaggctgagatgggaggatctcttgaggccaggagttcgaggttacagtgagtcatgattgtgccactgcactccagcctgggctacgtaaggcaagactggctctaaaaaaaatttgctttttaatgaaaaaaaaaaaaagagctgatttggctctttcttcccccatttacccagaattgctaaagtggtagatactgacaaggtatcttagcagggcagaagtctcatggtttgagtcagttgggaccaattgctgttgatgtgaatttctaactcctttgtcattctgagtgtgtcagctgaattcacataagggcattcaccaagggaggaagagaaaggcctttagttttaattattttatagttgagaaaattagacacatactcggggttacggggtctattctgatttttattactcctagaaatttcatacagattataatctgtctatcttgttagtaatatctgactgaattttttggaatagctatgtgtagaacccattttattacacagatttaggaatctcagaggatctgattccttagtctcttaaatcttcagtggcattaaatgccaacacattgtccttggtcaagactacaacgtagaaaggaacaagctaattaactacttagaattccctctcctaagagaccacatcgccaaagtggcaccatgacacagcttggtgttttgttggtcactttaggagaacaccattttggaggccttgggtggagctggagatagagccatggaggtagaatcgtgtcggaaaacctgggtttagccccattttgtacttgggcgtttgagctaatcgcttaagtcacgtaaaacaacaagactaataaagtctgggatacagactttaacacctcaagtgctgccaaaagtatttagaagacaaagcgaatcataggcacccttcaccgagcacctcctagacatcaagaaccatgctaggttccctacattcttcatttaatgccaataaccccacgaggcagttatcaccttcattctacaaatgggccccactcctaccaattaactggctgaatcaggatctgaccccgggcctgccaacgctcccgctggtggattgcccgccttgtcagctcgagttggcaggacgtgggagtaaaaacccggcgccccagccttcaccgtgctgcacgaggaagctggctaggcaggcatgactttgtcagtcaaccatcccgcagccgggccctgggctttgttagcagccacttggcgagggccccgggcgggtggggaggcggcgcttcctccaagaggaggtgggaccccggccccgacgacctcggagccgcccccggccccggatcgccgacgacgtacgtgcaggcctggggatggggcgctggctgcgagcggcgcgcccgccgagatggctgcggctggcagggcggtgggcgaggccggtgacccaataaagcggccgggccgcgggaggccccgcccggccgggttccggcactcgccgcagggtcccggccggcggcaggttgcgcgcccccgtccgcagcgctcggcgtgagggcggctcgggaggagggtgtgagcgcgcgtcgccgggccgggacccggcaagcagcgggaaaggcgggaggcgggagcgccggtcgcccgggagccgcgcggaggggcaggcggggcggggcggggcgcggctgggggcccgggcggccgggagccgcgccgcccgcggcaggcccgggccctcggcccgccccgcgcgcgcgcccccgccagcccggccctcctcctccccgccgcccctcccgcgcgcgtccaccggctccccggctcgcgccgctccatgtagccccggctccccgggcggccgcggaggagggggcgaccacaagatggcgggtacgtggccccctgttctccgggcggcggcggctcctcgagcccacccgccctccgccgcagccctgagtggctgccgggccggggccggcgtggggtcccggcgcgggaaggcgcccccggggcgggggggaggcgggcggggggggggcgtcgcgccgggccccggggcgctgaccgggcctttcttctctcccctcggcgcagacctctcgctgcttcaggaggacctgcaggaggacgcagacggatgtgagtggcccggcctcgcggtggcctggcagtccgcggggagcggccggggagggcgggcggcggcgaggcctgggccgggccctggctggctgaggggacggtgggcgagggcggccccaggcgggctggggtggcgatcgggggggaaaatctcgcgtccgtgaggaaacggcgcgcccaggttccgctgggggagggagacgcccggagtaacgcccaagttcgctttccgcccttcgctctcttctcccggcgcccccgaatcgcctgcgggctcagcagtggcgcggctgttttggaaggagaagcggtggggcaggatttgaagtggggtttgggtgtgtttctgcccctggtgtccccttcccccgtcactctaggaaggaagaggctcgcgcgggaggtgtgtttccttagagtcgctcttccaggagcgcccgggggtcagcctgggccccggctagccgtctgggctccccgacccggttttggattgtttgaggatgacatacctgtcattttactttggctggtagcagttttcagatgctcccgatttgattagtggattacgagaaggttagaaggtgtggcctccgcaggaattactaggtttggagagcatatttctttaatgcggatgttcagaaatcacccagccctccttcagtgttaacagtgcagctttcctttgaggtactgaagtttttaaagagttgacgcttttatttttaaaaagacaaagtttctgacatttcctgatggcgacggaattgatatttagaaaggaatttttcgtcttatatgtacttttctaagcctcagaaaataatttgggtcacgatagaaaagacaaaagagttaagcaggtttgtattgaaagaagtgacaaattgcagttaacttaaaatagtttctattcttgctaatcttccaaaatagcgacccatcaaaaaatcaataggttttgagatgcattttaaaaatgcagagtgtgcaaaatatataagcgaagatcatgggatacataagggaccaagaaattgttctgagttgagatgataaccatagtaggattgtggtctgtttagtggaaagcctaccggatgctgagattgactgtctagtacctgtataagtaatttcagagatggctgcagtttgaaattactcttttaaatactctgtagttaatccttagcattgtctaatgtggttcccttactcagagtaaacttaatttttagattcctggttgttttgagtaaagtaagggggatttactatttagatggattatctgaaacgagtaatttatctttaaagtaaatgaaccacatccaaacttttgctaagtctgtgtttttagtgaggtggctcaaaacagctctcttaaagggagcagtactcatgtagtgaagggcagctttaacattttatttaatgtttaccttaagccacttatctgcctaatagtaagtttgagatattatttaaggcatctgttgatttcagatctcttgccaggttaggattggagaaatggccctgattatgttacctcgaggagggctttttatatttatgttcgacttcgtaaatagaagattcatttattcagcaagtatttatgactggagcaaaaacttctcactcctgaaggatgaaatgcagtctcagtttcttccttagcccccaagaagcacagtgtagaggggaaggcatacctgtgaaaaattcaaccatgagtttcaacactctgccaggtactggggatggagctttgagaaagatgggcacaacccatgccctctagtggtttacaagcagttttgaatctaggtgtacagtacagtattacagttaccactggagccaggctgctctgtttgtcttagcagtgtctttttgggcagacttgggcaactcacttaacctccctatgcctcagttttgtcatttgtaagtaggcataagaaatattacctacttcatagagttgttcaaggctgtacatgagttagtgcctctgaagcacttggaacaattcctggtaaacagcgatgattatgattatgtttgctgttatgagaaaagagcaagggaagcttaaaagaagagcagagaaggaaacactgatgttgaaccttacagaatgaaggtacttaaagatgctgccaatgctcgcaactaaattttttttttttttgagatggagtttcactcttgttgcccaggctggagtgcaaaatggcgcgatctcggctcaccgcaacctctgcctcccgggttcaagtgattctcctgcctcagcctcccaagtaactgggattacaggcgtgtgccaccacgcctggctaattttgtacttttagtagagacggggtttctccatgttgatcaggctggtctcgaactcccgacctcaggtgatccacctgccttggcctcccaaagtgctgggattacaggcgtgagccactgcgcccggctgcaactaactttttaaagattctgtttcctgtgcattttaatttaggataaaacagacattgaaggcacaatagttatttgcatattcataatttggttgaaggctttgttagagtaattgcttatttttctcagttactaaagtttttacaggtgatacctttacccagaatattcaggaacaaaggacttttggacatatggccagttgaaggaccacttcccatctcttgtgaagggagaaagaatgagggggaacactgggccatggtgcctccttagagagcaagatggttggtaaaggactgagacagctgtcacatcctggagaagctggagaaggtagaggacccaaaggtagaggaacggagcttgggctgcccttataacacggttgttatctcgtgagcctgagtttctctgtctatggtaaaactccagagtatggagcccaacctccagagtagttgtaaacaagtcctactacttcagccaagctaggtgtaagttggcccttgggatgggaagaaattgttttctggtcaagctctagaatcttggttgaccttcctaaatgcagaacctggactatgagggaagagacagtaagttctgttgtgcagatgatctaggaaaggacctagctggagtctaggacttgaaagaggggcattgccagacattgctaagagtctcaggtctttcgatttgatttgttttaatcccgtctctgtacagaggcacagagtcggggaaaaggttggtcaaagactgacttgactgataacctttggaggaaaaaaaatcctaatgagggaaaaatggatggtatttgtgtgtgtgtgtgtgtgtgtgtgtgtggtacacataatttcattgaaggagtttcattagaacttaaacttttatcaagtaacttataaaggtaagtaaatgaaatcattatcaggtactcttaaatttaggagaataggctgggtgcagtggctcatgcctgtaatcccagcactttgggaggccgaggtgggcggatcacgaggtcaggagatcgagaccatcctggccaacatggtgaaatgtctactgaaatacaaaaaaaaattaactgggcgtggtggcgtgcacctgtagtcgcagctgctcaggaggctgaggcaggggagttgcttgaacccaggaggtagaggttgcagtgagccaagattgtgctactgcactccagcctggcgacagagcaagactccgtctcaaaaaaaaaaagtttaggagaataatgcaataaaaaccatatgtatttaagtttaaaagtgaaactttcagtactgtatcatgaaatactttgaatttcaaattgaaagcaaaccagtgactccatttgaacataggttatctcagcagatttcagagttgggtaaaccctttttaactttttatatttaattatgttccttaaataatgggagacaatacaaaattgtagatgtttagaaaaaattatttcagatttctgttttagtttccaaagatgcaattttgattcacatttaagttggtagattcctaaaatgaaatgagactaagatacggttaagatttgatgagccaatgcttgtaaaaataatttcattgaaggagtttcattagaacttaagcttttatcaaagtaatatgttgaagaatgttatttttaaagaatggctatgtaacgcttagtttacagtgcctttcatacacaggttattcttcacagcagtcctgtgatgtgtaggctatggtattctaatactaataagtaagttgactaatgcccaaagggactaaagaaacaaaactcctaagtttagacggaattttaagctaggccttctgattctaaatatcatattttgaatattttcttaaatggcccagtttaaaatattgatcaacccaaacttgtacaggcaatttctttgaactcgttcttaaagtacccttgaaaattaatctgggatgctgcatgtggtttagtttacacctggagaatgatagagaggatggagcttgggtataagacagcttatttagtcgttaacttttatctcagctgtaactaagtatgacgttgaaaagtttttgaagctatgttattgagtatgccatacaacagacttttttcatatttaagttttggaatccttttacattatgctgtttttcgggtttaagggcggtgttgaagtagagtgaaggatgggtccagaactaactgagggtaaccgcctagaccgcactctgtgcagaatcttcaggccttcctaccatgtttcaaaaccagttctgataagcttagagtccttgcttccggtgggaggtgaggagcaaaatattggggctgtatctggtagtggccagggaatcattcagaaacctttggaaggtgcccttgaacgtgaatcatatttaggagtattgttaaatagggatttgggagggtgagtcgtgagacctggtagcctgttttgactgctgccaacaagcctggatggagagatctttatttagagataatatcattgatatcttagaaaagagtgcttttaaaatggtttcagtggtacccacatgtgtgttggatcaattaatgatacctctgctaacaacttcccacataaaattgaaagagagagagagagagacagagagaaaaacccctttgtaaatatgcttgggcctgtagctacacgatccactgccctcccccctccaaaaaataaaaaaccaagacacctaaatgcatactttttgtttgttcctgcctgtgaaagataaatagacctcaggaggtaaagttcagaagtctgctgccacatttgtttgatctctggtttattatttctggtccttttctctcagtctcctcaaaacaatgaatgtatgtttattaaactattgttaccttgctcctatgtttgtattacatcttttttttatattttggagtaaaagaatttgaaagttcctaaatttgaattagagttgtgttgttgtttttaaattggagctgagaataaacctaacttagtgttttgggcagaagtctggatggcacacctatggaattttggctgaggaggtattccctctaatttctataagagggtctggaacttgctctgcttttagcacagatctttgagctggtgacatcatcaatgctgcttcctccacattcatttcttaactctcctaacttttaagtcatcttagcttcttatctccctagactaaggagcaaacttaacttactttctggccttattgatatgaatgtggttggtatttgagcatctatcatgcagtcattctggaagatacctcagtatagttttgtgtaggggaaagaacactgggcttggtaagcctttagacctgagttaatattctggccctgccatttattctctttataatctgagcaagttaactttttctcagctttctacctttaaaatgttgatggatttttggatcatctgcagtttttttgctgttacaaataaagctgctatgaacattcacacacaagtctgtgtgaatatatatgttctttctcttgggtatacatctagaagtagaatggctgtttaactttttaagaaactgccagcccggtgcggtggcttatgcctgtaatcccagcactttgggagaacgaggcgggtggatcacccgagatcaggagttcaagaccagcctggccaacatggtgaaaccccgtctctattaaaaatacaaagaattagctgggcgtggtggtgcatgcctgtaatcctagctactcgggaggctgaggcaggagaatcacttgaacctgggaggcagaggttgcagtgagccgagattgcatcattgcactccagcctgggcaacgagcgaaactccatccaaaaaaaaaaaaaaaaaaagaaagaaagaaaaactgccaaactgttttccaaagtggttatatcattttccattcccaccaaaagtgtatgagagttccaggtcctcatcatcattgtcaacacttagtgtgagcagtcttaattttagccactcttattaaatgtataatagtattaatttgtggcttgaatttgcattaatggctaattatgttactctttttatgtgctcatttgccatctaacttatctcctttggtgaagtgccttttcacatcttttgctcatcttttcattgggacattttcttattaaattttgagagttcgttatatattacagatacttaagacatatacaaaggcagatggaccatcatgtctctactactcggttttgactttcatttatccatgtttctgtttttgtttttttttttttgagacagggtctggctctgttgcccaggctggagtgtaatggcactatcttggctcactgcaacgtctgcttcccggactcaagtaatcctcccacctcagcttaccaagtagctgggaccacaggcctgcaccaccacgcctggctaatttttttgtatttttggtagagatggggttttgccatgttgtctaggctggccttgagctcctgagctcaagcaatccacctgtcttggcctcccaaagtgctggaattacaggtgtgagccactgcacccagcctgatgtagatcacttttatatttaaatctatgaaattcatttttgatagaaataactcatttattcaatacttcatttatttaagattggtggcaatttggacctgagttagttcaaattttgtatttggattacctgtgggaaaaaaggttactaccaaagtaattgcgttaagagtgcaaagaaaatttttactcactgaagggaacaaatatctataatatttgggagatccacaagtgtatgtcagagcaagtgctttgttatactacctttctgttaaatactgtttgtatacataatcttggtaactaacttgaaactagataaacatgccactactgtattatataaatagaaatacattatacatatggtgtatatatataaatataaatacatatatgaatatacatatagtatacttcagcaaattattcttgccttaaattcagttgtgctataggacaattttgcatttctaaggatttagtaagcttttagtattgatatttgaaggaagggtttctgataaacattatttatattattgcaaagtacaaaattaaagtttgacatacctgttgctggagactataaagattatgttgtatggtccctgtaaaaggccaaatattaaatagtttaggttttgtggaccatatgatctttgttgcagctactcagatctgctgttgtaaggtaaaagcagccatgacaatacagaaatgaatgaaagtaagtgtcatccaataaaattttatttacgaaaacagaaggtgggccagtttggctcgctggctgtagttggccaaccccttcactgtgctataaaatccaaggtctgtaacatttttattcttgactcatcacacagtgttcagcaatacatctcatcagtgcttaatgtagaataagtattgaatgaatcttgatgtttcacaccaagctaaataagaccgtaaacctaatttggggtcaaataatgaaattatttttaattaaacttgttattttgaaaactttcagacctatacaaaagctgcacagatattgtaatgaattcccaactcttcacctgaattaagctgttaacattttgccagtttgctcgttacttctctatacagttatgtacacacacacaatgtaatgtaattttttggtgtacctttgaaaataggttgtggtcattgggacctttagcctgtgtctcctaagaacaagggcacttttacaatcatagtaatgaaatttgggaaatttaacattgctacaatcctgttatatagtatgtagtacatattgaaatatccccagtaatgtccttatggcaactgtcttttgctgtaaggacattacttacaaacttactagtttggaacaatttctcagcctttagcattcatgaaattgacatttttgaagagtccatttggttttatctgtttcctcatgatttgattcaggttattctttccttttttttttttttttttttttttttttgacaggactgctacataagtgatagtgtagttttctcagtgcttcagattaaggagcacctgatagcagtgtccattactggtagtgtggaggtgatgtctatcaaattgctccactgtaaagattctgtttttcctattgtaattagtaaggaaatagtttgacaatggggaaataccctgtttccaaacatttacccatttagtgttagaatgtgttgatgattcttgcctgaattaattgcatttactagctgacattctgctttatagaagagcctgatcttcctccctattcatttgttggtatatttatttgttaaaatataattttaaagccccaaatctttataaggtaactcattctgtggtgtatctcattgtctttcgttttctaaaatgtaaagatgggaaacaaaatgtggccgatttattgtggcctgagcagtatctagggaaaaactgaagggaaggatagactatgagcttttttatgttttacgttacattattagagattatgtagagaatagaagggtgttttgatcaaatttgataaaagtttgtacgaattaaaaagttctctttggtgtgatacttctcaaggtattaatatgctaatgtgcttgtgaatatcttagagaaggataaagtatagtaaactcttgacttatcaattatccctatggactacattttcattaacaaatattaatgaatgtgcctccatgagaagcattggactctgttttttagataatgaaaagtttagcaagacaatctttagggaatttatatatgttggggagggagaggagaagggaaggtaggagaatatgaaaaaaaggaaaaatactttgcaattattggtggagtaaaagcaagggcacccaagacggcagggaattaaaaggaagaactcttaattagaaaatagaaaatgcctcctgggtgttgttagtaataggtaaatttaagctgagatgaggttagagaggacagaaatggaacagatgaaaccacataagacagaaaagtagtggggcatgttgcagcaaattgactccacatgggctgtgtacagaggaggaaactaggttggggccagatcctggacacccttgaattacagcatgagaaagaaagttgtaccttaattcagactgcctgggaggcttatcagggggtggaatggtagggattgggagggagggcgtgcaagggcatctattgaacagagtgggaagattgaagtggtgctgatatataaactggattcgaatgaggggaggctgggagtagatggatccaggcaattatgttaataacagtctaggaccgtggtctttaaactttattactgcatacctactaaaataattttgaaaactctgtatcatgtattttaaagttgacattcaaaattttctccataaaatttccatatttgcaaaggatatatttctaatgtattataaatatcagtgttttaaacatagagttgtatcactttttaaaatggactaaatactatagcacttggatacccactattcattttttaagactcacaaatattcaggcaagaccgtgagagacaaataaaacaaaaaaattgtgaataaattctttaaattgagactcttgcatttttttctttatctcttttcattttccacacagaaatttaccttgatgtattttcatattttcatgcttgagagttgattgcccagtcacatttctttgcaccaaaaataggtaaagagaaatttaaattttatgtcaggcaaggtggctcacacctgtaatcccagcactttgggaggttgaggcaggaggatcccttgagcctaggagtttgagaccagccctggcaacatagaccagcagctctacaaaaaataaagaaaattacctgggcatggtgggtggcacatgcacttgtagtcccaactagggaggctgagttgggaggactgtgtgatcctgggaggtcaaggctgcagtgatccatgatcacatgagactctctctcaaaaattaaaaaataaaaagaaattaaaaatttgaatttcccgttaatataaaacttaaagttttattgagtttccattattaatacttggttgatcaaccagaatatattacagattgaaaaaacctagtaaataacattttatcaaaaaggcatctcttaatgaaatggatgggaattttacaaaataattatgtattcatggataaatataatctattgcttagaatgagataatacttaacatcatttctacttttcattttaagagctataagtgctgagaaactttgttgcataaataagtcaatgggaatggtagatagtgtatgtgctgtcctatttatattaagactactaattggttgaatgaaaactattaaaaacacatggtttccctacttactggttgaatgaaatgagtgaaaacaaaaacagttggaaaccacacacagatattctgtatctagaaacaaactgaaatgcaaagtgggagggaacatttgcttatttgcctaacactgttgcagacatttgcagacattatcactgtgtcttaaaagtcttaaccattattttatagatgaatataataagtgacaaaatgggatttgaatccagatctctcttaccttaaaaatcttctgttcttttcacacggttttgctatgactatgtacaattttatggtgggcccaactttttttttgagacagtgtctcagtacgtcgcccaggttggagtgcagtggcgcgatttcagctcgctgcaacttccttctcctggtttgaagcgattctcctgttttagcccagctaatttttgtatttttagaagagatgggatttcaccatgttggccaggatggtgtcaaacttctgacctcagatgatcagcccaccttggcctcccaaagtgctgggattaaaggtgtgagtcactgcgcatggctaaaggaaaggtgcaagttttttttttttttttgagacagagtcttgctctgtcgcccaggctggagtgcagtggcgcaatctcggctcactgcaagctccgcctcccgggttcatgccattctcctgcctcagcctcccaagtagctgggactacaggcgcccgccaccacgcccggctaattttttttttttttttttttttttttttagtagagatggggtttcaccatgttaaccaggatggtctcaatctcctgacctcatgatccgcctgccttggcctcccaaagtgttgggattacaggcgtgagccaccgcgcctggccacaacttttaaactattacattttaggcactttttcttaaatttaaaaaagcgaaaaattggaatttctcttctgctactttggatttctgtgttagattcagggaactgcaagtagtatagagagaggatacttctggagctatgacagttgttttgtgctgttacataatctcacgtctatacaaaaagtcattcagttctataggtaacaaggattaatgtcattgttttgttgtttctttcccttgtcatcttccttcctgatgttctctttatttgtattgtaacatatttgattcctttcataatttggaactagaaggttatattgagcctagtttatgtttagcagcagttttcaaagggtcttagagataagatgaactaaagctttaagtgtagggccttagtttatatcctaggttttctcttcctattaagaattccattcttttggccaggcacggtggctcacgccggtaatcccagcactttgggaggccagggcgggcggatcacttgagaccaggagttcaagaccaacctgggcaacatggtgaaaccccgtctcttctaaaaatacaaaaattagccaggtgttgtggcgcctgcctgtaattccagctgctcaagaggctgaggcataagaattgcttgaacctgggaggcggaggttgcagtgagctgagatcactttttaaaaaaattatttatttattttggagacagagtctcactctgtcacccaggctggagtgcagcagtgccatcttggctcactgcaacctctacttcccaggttcaagtgattcttgtgattcagcctcccaagtagctggaatttcaggcacgtaccaccatgcctgactaatttctttgtatttttagtagagaaggggttttaccatgttggccaggctggtctcgaactcctaacctctaagtgatctacctgcctcagcctcccacagtgctgggattacaggcatgagccaccgttcccggccagtatatgctttttttttttcccccaaaaaaaaaacaacagtaacaataacaacctggtttgaacactgtattgcatgctttttggtcatttaaaaaattcagataacattaaaaggtgatgtatggtttttttacttcatcagtgaaagaggctggattttaaaagccatggaacagtatagggctattgctgctattacagtgttcaagaatctgtaaactttagttatgcagagctacataagaattcaagagtcttgaagtactaatgtctccatttctagtaatactccttgtctttgatctattttgtctcataataatatagccactccagctttttttcttttttctttttttgagacattctcactctgtcacccaggctggagtgcagtggagctatatcagcttactgaaatgtctgcctcccgtactcaagtgatccccccacctcaggctcccaagtagcagggatcacaggtgtgcaccaccacccccagctaatatttttgtatcttttatagagatggggtttcaccatgttgcccaggctggtctcatctcaaactcctgagctccagcaatccacctacctcagcctcccaaagtgctgggattattggcgtgagccaccacacccggcctccagctttcttatgcttactattttgtgttatatctttttaaaaaactattttcaacctaatggttgaaattttgtctttaaaaatgtatctctggtagtcagactatatttctgatagtctgataatctttgccttttaaatgaaatattttagtccatttatatttaatgtaattattgatctagttgcatttaggtctgtgattctgctatttattttctgtttgacttatggttttttcctctgttactcctttccagactttattttgggttagctgaatattttttagtactcaattttagtttctccattatctttctagctataccttctagtgtgtttcagagattactcctaggattgtaatttttttttttttttttttttgggaaatagaagtgaacatttgtcaccagtgtctgtaccagagtggaacactccctttgtatggaagtgattatcaatcatgatagagtgatagcaaaacatttgaagcagaatatgattttgttaccttctaggagtaggcttcttaagtatggttgtataacagtctgcatttaaattagtggggttattcatttaaaaataaatgctcctgagccttactccagactaacataatcagtatctgagtgtgggatctaggtatctgcattttaggtaagtgccacaagcttgtcttgaacataattatgtttgacagtcacagctgtaggagttttttcccactgccctttgctttttatgggccagaatcaattttattgtttatctttaagattaacaagtatgagactgatgaaacagtttggtcatagtcatagaattctacagcctttataaaggtgcttcaaggttatgctagcttaacagtcttataaaggagaaaactgaggccagatgagagtggctgagtggcttttacagctctgatttataattaataaggtattttgctatgaattgtagacagaataagctgcagtgtataattatgttcatggttaggtgttgtttgtaatccaatttgacagtctctgcctttagttgggctatttagaccatttgcagttaatgtagttactgatatggttgtgtttaaatctctttatcttgttgtttctcatttgttgtcccatctcttccttgttccctttattctctttttctgccttcttttagattacttaggtggtgtactggcttagtagttatatgtctttggtgtatgtgtgtttctttttaaataatgattgctttagagtttataattaatatgcatttttacctttccacagtctaacttcaagtaatatgtatctcttcacacacagcgtaagagctttataacagtatactttacccttttcctgcctttgtgctattatagtcatacattatacttctacatatgttgtgaaccccacaatatatatttatccatttatttcttagtacgtatttttatttaagcagttatcttaaagatttgaaaaataagaaattttttatttatcccatattaaccttttttttttctttctttctttttctggagacagggtcttgctttgtcttccagactggggtgcagtggtgccatctcaggtcactgcagctttgacctcccaggttcaagcagtcttcctgcctcagccccttaagtagctgggactgcaggtgcacgccaccatgcccagctaatttttgtatttttttttagaggcaaggttttactatattgcccaggctgatcttgaactcctgagctcaagtgatccatccgcctcggcctctcaaagtgataagattacaggcgtgagccactgtgcctggccccatgttaattgtttctgatgtcctttattcttttgtatagatccagattctcatctggtgtaattttccttttgctggaatggtttgctttattatttcctatagtgcatgtctgctgttgatgatgtcagtttttgtgtggctgaaaaaaatctttatttcagcttcatatttgaaagatgtcttgtttcttaggtatggagttgtaggtatttttctttatgtacttgaaagatgttaatgtcttctggcttgtattttagatggaaaagtctcctatcattcttttgtttttctctatgtaacatgagtttttctccggctgcctgaaagtttttatcactagctttaagcaatttgattatattgtgccttggtatacttttcttcatgtttcttgctcatgggtttcattgaaccccttgaatctgtctgtagattgatagtttttaccaaatttgggaaaattttgtccattatttcttcaaatatattttatatctcccattcttctttggggactccatttgcacatatatttggatgcttggagttttcctacaattgattgatgcttaattctcttcctcccccatattttttctgtttcatttaggatatttttcttaccctttttcttcaaggtaacacattttttcctctataatgtttaatctgctcttgatcccatcccgtgtatttttcatatctttttttcatctctaaaagatcaatttaggtctttcgtatcatcttccatctctgttcttaacatgctctttttttctgccttcttaaatgtatggaatatagttaaaataactttcaatgttcttatctgctaattctatattttttgtcctgggtctgtttctgttgtagaattttttgcctcatggtttgtattttcctgccttttgtgtgcctagtaattttttattggatgctagacattgtagagtttaccttgttgagtgctagctatttttatattcatttacatactcgagttttgttctgtgacacagtttcttggagatagtttgtttcttttgaagcctgttaagctttgttaggcaaaaccaggagaattatttgccacttcttaggcgttttgcctcatttattttagaatttttaaaatttttgttgttggagacataaactagtccttgtcctttgtgataatcgaggattcgttcacttgatcgtttcaggtaattatttttcccagaataccgactagtttcctcacacacataaactgtttcaatactcacctaaagactcaaagggactttctgcagctttctaaagttctttctctgtgaaggtccctcctctctgatactctccctctgccaattctagctgccttggcctccctgaattctcaactctgtctcctcaactccaggagtctgctgggattatatttggaccctcctagtgctctggaaattatttccaggaagttagctggaggaatatagggctcatttcatttgtcctctctttctcagagatcactgtccagtactgtcttttgtccagtgtctgaaaccatggcttcgtatgttttatcttttttttaagagatgggggtctcactgtgtttctcaggggctagagtgcagtggctattcacaaatgcagttatagaagagtacaccctcgacctcccgtgctcaaacagtcctcctgcttcagcctcctaagtagctgggactacagacactatcagcatgcctggctctgtcattttatttatttatttaccatttaaggtgtgagggttaagttggttcctgttaatccatcctttgtcaaaagtggaagatcatgtttaagtgttctttaagtacagaagttatttttattttaacaaaaggaactgttgtgttctctttttgataatgttctgttgggagtaaaaatgttatctgtttaaagtagtcagttctgtaagatgggcccatggtatatacacatttactttaaaaacaagcattttaaaatgccctaacagcaataacagttcatcaggaaatgatgaatcttttctgtctctcatatagcaacatttgggaggagtttcttaggtggttttctttttctctcttaagagctaaaggagcaacgacaaaatctcattgtgagtgatgaacagatttatttgtttcaaaaatacttaaatgcttactttgtgcctggaaatatcctggagatgaagcagtgtatgggataaaaatttctgtcctcatggagccaataacttactctagagagacagactataagtaaaacaactaatatgtaccagatgttgacaggcactattgagaaagtaaatcaagtaatgcaggggatagaataggaagtgccaggaaataataataaaaatttcttggaaagctcttagggctttgggaaaggccctgatttacctctggatcgcatcctttccaaccccatggtgtttccatcagtaatattttcttattgctaaaacttcaatttatatttatttgttgactgtttactttcattatataaccatgtgcaactctgtcttcttttaaacattaggaacagaacaaaataaataatctttattttgcttgaatgccctggctagtaatctaatccagtttactatatcacagccacagttctggaaagtatattttgtattcattgtcttcactttattatattttcctttacctcttcagtcaggtttggcttctcggctttcatgcaatggaaaattgcccttgtcacacagcatggcacaaaagtaccaaattcagtgggcacctttcagttcttccttgactcctttggtagtagatgctgtttaatcatactttcactcattgcttggttcctttgaaataattaccttttggttagtttttagccattctttcttggtcttctcttccttctcctgcagcttgaatgggtgtctggccttttagtttgtattaatacatacttttattacaatgatcattttaaagtagattgttttctgtagaatattagctctttgaagtcagaaacattagtattttcattgttgtttctccagcatctaccctagtacttggcacaaatgtatttaataaatatttgtttaatgaatgtaaatatattaatgtttttagctttcttctattaagtgaagttagataccagtttcattagctttatcttccacattgcaggactaactatattggtgcttgactttttgtgtgcctattcacaagttgttagtgtcttgattgaacatgttctcaagactggtcactttcctgcatactgagtttctgtagcctctgacctttgtgcttttagagccaagtagaactttgtgcttatagagccaagtagaacatatctgtaggaaaaggagaggaggtatcttttagttatttgtggcttctggattgattctgagagtctcttgtgattttttttttgtaccattccagaaacagatttgtactgcttcagacaggcaaggggtacattttagtttcaaagtgttataaggagtatttctgatgtctctgatagttggtgtggatgactacagctcagagtctgatgtgattattataccttcagccctggactttgtctcacaagatgaaatgttgacgcccctggggagattggacaagtatgctgcaagtgagaacatatttaacaggtatgtgcatattctttttgttaaagtggaagtggaagggtggttttattaacttcagtagggaaaatgaaagtatccactttaaaggaggtattattaacaggcacaatctgagtcaccaagttttattcataatcatagcatgagcagttttgtacttgtttattctttgatcctagtaagcatacaacatgctttctttgcaaaaaaaaaaattaccattaattaccattgcttttctgccactggacataattttggtattcatataaattgcttattgggaagtacattattccttcaacacatgatgttgtatacctgctgtatgacgggtgatgctcaagatcattgggtcacacagcagtgaccaagagccagcactcttcctactgcattgtgtttgtccagccatgatcccagaccacctatatcacacttttctgggaaatcaaaaagtcttggttcagattttttgggtatagctatgcaaaactcatactactaaaaatatgtaagggtaacattttgtataatgaatgagtgtgttttttcattgtgataattgaaggacaactgaaatgaatttttggtgactttttaccaaatcagttagataaagattaaaaaaaaatgttgtaaatattcagtctcatcttgttaaaataaaatcaatactgccgtttgccacttaggaaattatagacctaatatatgttttaataatgtaataagaaaaaattttcttaaaaaatatacagattttgtcttttaaaattctagatatcggccaggtgcagtgactcatgcctgtaatcccagcactttgggaggccaaggcaggtggattgcttgagcccgggagtttgagaccagcctgggcaacatggtgaaacagcatctctactaaagatatttaaaaattagccaggtgtggtggtgcatgcctgtagtctcagctactcaggaggctgaggtgggaggattacctgagccagggaagtcaatgctgcagttagccgtgatcacaccattacactccggcctgggcaacaggaatgaggccctgtctcaaaaaattaaaattctggatattagctattgatgccattgaacatacataattttgttttttttgtgtagacaaatggtggcccggagtttgctcgataccttgagggaagtctgcgatgatgaaagagattgtattgctgttttggaaagaattagcagattggccgatgattcaggtatatgtggagaaagtgaatttactctattctagaaaggcttctttgatcaaatttgtgtttctaaaaactaatgaacaagttaatgtgatatgagatagctttaaaatatttcctaagtaattatcaaacccatcagtgacaacaaaagtaaaatttgttactgagacctggacattttacagtgggctcatttagtttaattttagaaatttctcatcaaaacaaatctaaaaacattgttttgcatcatgtatagtaatattttaggattaataaaaatatatagaataattttgaatacattaaaagagatggaggaggctgtaaattattttaggcaactatagaaagcttgctttctgtgtggtttctcacttgcaaaaaaatgttgattaaccatttgtaaaactaaagctggtttatctccaaagtgaagataagaaagtctgcttaagaaagaggtaaacttgatttaaggcttagaaaatggtgatgttaaagtttttataaatatatcttttgttgtagtaaaatatacttaaaacttaacacataaaactattttaaggtaatattaaacatatttttatacttgattttagaaaccatccaaaaatcttaaaactttttcccttaaatctattatctttattaaagtatattttctacctctgacagactttttggcatctcagcaagccctattttttaatttttagacaagctcatcttttgatgaacagttcattttaatgggaatgtgttaaatgtttacataagccttaaatgtttctaatattcttacagggtgggcagaacatttgtaggcttaactgagcaataatctacctttgtgtacataattgcttatgtatgtgcttgttctagaatggttttaggaggggtctcatcaagcataatttttacttatttttttaatttgatttaagttaaataacaatttaacataaattcatggcactgttatagcctattatggttatgttctttagtagagacagatactctttaaggatagatttgtgttttcctttacctgtttaccagctccagagttttttttttttttgtaagtgtgtgtgtgtgtattttaaaatatgttctcacattggtaaattcatagtaaatgtctctattgacataattccattcattcagtatacatcaaacagtacatactctataccaggttctagattaaatgctagagcagttattaaggtgaacaaggatttgtgtcatcaagttaacagtttagtgaatgcagccaacatataaacaataaattataatgggaaggatcggggcaggcttcagaaagttagtgacatttaagttggatttgatagatgaggtatagagagggaaaagggcatacccaggaggggaaaagatagagaaaggagttcaagatggtggcccctttggtcaacaatgaggccaacctgacaatgagactaacctgctgagtttccaggttagaaaaattaggctgttaagtaagttaggtgagggctagattgtaaaggtttataataaaccatgctgatgactttacctttttgtgatttagaacagtgtagtgtagcagtatgaactgatatggtgaaaaagatgggtgacaagaagacttgattggaagactataccaattaattgggtgtttttgtttttgagacagagtctcgctctgttgcccaagctagagcagagtggcgtgatatccactcactgcaaccacccctgcctcccaggttcaagcaattctcctgcctcagcctctcgaataactgggattacaggcatgtgccactacacccagttaatttttgtatttttagtagagaaggggtttcaccatgttggccaggctggtctggaacttctggcctcaagtgatccacctgcctcaagctcccaaagtgctgagattacaggcatgagccaccgtgaccagccagttaattgttataaggatgaattgttggatagaaattgaagtactaggagggattccaaggctaacctctggatagagtgaggaagagagaggatttgaccctgaggtttctaatttttaggactgggcttattgtgatagctgggtaagataaagactattgaataataacatagctctgaagtgaatgaaatatgtatccttagtttagacaaataagcagctgagaacctttcggtcttctgccttacctttcattagcttttatcttgatttttttattccccaaaatttaccatctgcttttattttcccccggaatggatggatgtatagtggtatctcattgtggttgtaatttgcatttcctcagtaaccagtgaagttcatacctggttatacacttactggctatttgggtatctttttttttttttggagatggagtctcactctgtcacccaggctggagtgtggtggcatgaccttggctcactacaaccttcttctcctgggttcaagtgattcttctgcctcagcctctcgagtggtgggattacaggcatgcaccaccatgcctgcctaatttttgtatttttagtagagatgggatttctccgtgttggccaggctggtcttgaacttctgacctcaagtgatccacctgactcagcctcccaaagtgctggtattacagacatgagccaccatgcctggcttcttcttttttgaaatgtctaagtctcttccccctttaaaaaattggtagtcattttcttacagatttacaggaattcattctgcatatgagccgtatgtcatttatgtgtattaaagatatctttttcactctgtggcttctctttgcactccgtgatgcttcttgcagaagagaagtgtttttcctttatgggtcatgccgtttgtgtcttctttgagattttttccaatctcaaagtcataaatatcttttcctgtattctctaacacagagaagccttattgttttttgccttgacattcagatctgtattccacctggaatttattcatgtgcgtgatacaaagtggaggacaagtttcatttttttttttaatgtgagtagccagttgacacaactgggaagaccatctttcccagttcaccttttaataaatcggttgtctgtacatgcatgcgtctgtttctgggctttattcccctgccccgccccattagtctatttgcctaagcggggctttgaagaaagaaaagttgctgatttcatttttaactgaaaccataacttgtgtcctccttttgcttcaaaaatataagcaattgtcagtgttaacttagaaaattcagcatccatgagaaaagcagaggcctgtatgtttacttttttaaaaattaggtttttcttcaaaacagaaacactctattttgttcatatctggccaacttcacatggtacaacagtataatagaaattccagatattggtttgttgataagattctgagctttgtaaaatacagtattatctacttaaaggtatgttaatttctctgttgatatctgaaatcctagtagacacattcatacatatttactttaatgtagctttattaatgcataataataatgggtatcagagttctagttaggtccgatacaatgacttgttactgataatccatcatgtctgtctgtatttcagtcacttgcatgtcttctatgaattgcctacttgtatccttattttctttcttattatttatttgaacagtgtgttcacttcctaatactctgttatacatgaatttgctcccaggctgttttcccttttaactgagtattggtatctgttatctataataaagtttttttgtttgtttgtttttgagacagagtcttgctctgttgcccagggtggagtgcagtggcgcgatcttggctcactgcaacctccacctcccgtgttcaagtgattctactgtctcagcctctggagtagctgggattacaggcatgcaccaccacacctggctcatttttgtatttttagtagagacagggttcaccatgttggccaggctggtctggaactcctgacctcaagtgatctgcccgccttggcctctcaaagtgctgggattacaggcacacccagcctataataaagtttttataatgtataattagttggtcttacggttgatttttggattttgtcttcccacctcaagattgaacatttaatattatcttttagtacttttgatctttatgatgtgcagtaggaacttttgttccgtgctaactagctgattttcctactgttgcttcttagacatttcatctttttgaagcccagaaatttgaaatgccatatttctcacatttaaatttgccatatgcacttgggtcttttcaggtgtttaaaaaatatttgtcatctttaattttcatttacccatttttagtcttagttaagtctaattatatatctttcatttattgactaagttgagattaggaactagtttttatgacttgtcctagtaggttcttaaatagtggaatttatggataatactatgtatgtgtcagagtattgatgtaaatatcagataggatatttaacccctagcacagtgtggcacagtgtaggtgatgaataaatttatttattgttaagaaatggttagatactcagtgcatactgtgaacaacagaagcttggattgaagataaggtcctcctttcactcatgggattgatctgtgtatgattctgaaaaggaatgcagaattaaaggatgttgtctcaagtcctttatattttgaagatgaaagtccatagccttcctaagtaccctcaagaacagataaaggttttgttgctgcaggagaacatgtttgctcacattgccgttatttcaatagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtaagagtaccatttatatgttcttaaaagaaatttacgtagtgtaatatatggagaatagccgagcctaagtgttctctttggaatgttttactgtttttcaaaaatgaatatttatcttagacaagatgtgtttagagtctgacaaatctagtagatccctttaatgccattatggacaatgcctagtaactgcactctcacttggtaacctcctagcggtcccttaaaaggtttgttactttgtgaggcatcttttaccaggatggctctgtccacttcctctgttacagcacaatctacgaagttctgtagtctttgtaatagttgaagaaaataaacacaaatatttatttgcggagttttgccagttatgggtccctttgagatgagaaatctttgtttataaaaatcaagtgatagaattttgtcatgttgcatatgtactttctttgtgttgttatttttctcctaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctgtaagtcaaatgccatttttccacttatgcaaaatgtggctgataagaggtgcttattaaaagtcaggccggggttaggcacggtggctcatgcctgtaattccagcactttgggaggccgaggtgggtggatcacttgaggtcaggagttggagaccagcctgggcaatatggtgacacctggctctgccaaaaaaatacaaaaattagccaggcatggtggtgtgcgcctgtagtccctgttacttgggaggctgaggcaggagaatcacttgaacctgggaggaggtggaggttgtagtgagccaagatcaggccactgcacttcagcctgggcgacagagcaagactccgcctcaaggaaaaaaaaaaaaattaggctgggctgggtgcagtggctcatgcctgtaatcccagcactttgggaggccaaggtgggaggatcacttgagaccaggggtttgagatcagcctggccaacatggcaaaaccccatctctactaaaaatacaaaaaaaattagccaggtgtggtggcacatgcttgtaatcccagctactctggaggctgaggcacgagaatcatttgaacctgggagacagaggttacagtgagccgaggtcattccactgcattccagccaggttgacagaacaagactctgtcttaaaaaaacaaaacaaaaaaaaaaaaagaaagaaagaaagaaagaaaaggctgctttctgttaaagttgccacaaatcattaaatttgaaatacaatcagggctagaaagggacataaaggcttacaaaggaaagtgtaccttctgcacacaatacgaaaaaatacataattgtaaattattatgtcaaagtggaaaactgaaatggttattttatcagtgcagttaaaattttaaaaaccctggactgaacgaagaaacacttgaaccccttcagtaggtattgaacacttttctaggcactgtgtaagcacagtggaaataaaataatactttgctcctgctctgacaggtatggtctttgtgggaaggatggtcaggcaagtacatttcccaggatatatgacatcagtgatggttatcagaagaatatacagattgttaagtcattacgcatatcataaagtcaaatgtaataggaagtttctgggtttttttttgacatggtttgcaaatattctgattacttgaaggccatgatagggcatgaattagtatagagtagtatctgttgtgattcacatctggttcctgagttcggatagtagtaattctcatggtaaattagaaaagtgataaattcgtctggaaatttattcatatctatttggatagtaagagttcactccttaagcctaaaataatatggttgcgtctttgttgatattttttaataatcacactatatttagtgcttctggatcatcagtaatgggatgaattagatgatctctctagtctctttcccttgaagaatttcttgaatctattatttttagatactcagttaccagttaataataaatttactttttcagtaatgtttttactgaagtgaaccttacatgacataaaatcattttagtgttagtggcatttaatatgttcacaaagttgtataaccaccacttcttcctagttccaaaacatcattatttcttttttcactttaggatttttgcaatgaaggaaatcagttttgggcttggcctaatttttggtttatattgagccgtttaacttgctgtattataattctcgatgcaatgtaaaattagtaaaacattacaataaaaaatttaaaaactatatccagtgctagtaggagtcttatgattctcttacagttgtgtttgttttttggtcatgttttatattccatggctcccatattttctctatcttaatagatagagaaataataattatttcttaataaaaattaatttcttaataaaaataattcatttttaaataaatttagttatgctacatcagtgatatacagcataactttggattgttaactagagcatggagatgcttattcaaaaaacaaaactggttttgggatttaggagatgtaggcgttatctctagttctgatgatggtgggattttcatggggatagtgttgaatctgtagatcaatttggagacaattgccagtttcacagtctatgaacatggtagatctatttatttaggtctttgatttatatctttaatcttttgtagttttcagcagaaagttcttgtgtgtattttgttcgatttcatattttttaaaagtacttctgtgagtgatactgttcttaaatgtttccagttcattgttcattgctaatttgtagaaatacaatagatttttatattctaatttatagcctacaaccttcctaaacatacttattctggtggcttctttgtagattccttctgattttctgtgtagacaaccatgtcgtatttgaatagagagaattttctttctttgcaatctgtatctcttttacttctttattttgtcctgtttgtacagtctagcaattgatacaattgataaatgacaacaggctatcccatttctttctgtattaactgtgggaacaatgtatctaaatagagggccagttttcaaataaagttaatcctcactttgcctcctattgtgttaactgaaacatgcctatatcagaactgtgttcatgctttccctggaactgaagctttgcaaaaccaggacatggttctgatatgtatgagctttagttcacagggtgctttgcaaggcgaggactgaattttttcttagcaatacagatatgctaaatctagatctttcctggggatagttttccctttgaacagtcaccaattttttaaattgggaaaatgtaggtttttgtttgtttgtttgttttgcttttaaaattaccaggcaaaatgatgaagtagtagtaagatggaaactgtggacaaaaatgaaattgttaggattttctgtgggtttactgggcatgcagtatttattggttgtttttattgattgtggttaatatctgtctttgtttcctacttagataaataagatgaaattaataattggctatgaatgttttctgtcatgtatatagtataatgatgccatatcatattttatgtttcctcaaattatatacttttattatttaatttaactgaaagaggcttacttgatattttcagtgtgtgtttgttcttacttattttagataatgtgcaaaatggctcccatggttgggaaggatattacagagcgtcttatcctccctaggttttgtgagatgtgctgcgattgcagaatgtttcacgttcgaaaggtatttttttgtcgttttttttctgctgtttaagaacatagttctagtggttaatgtactgatacatgatatttaaaagattatcttagaagaaccttatgtgtaatattttgaaatgtcaatgatgcttttgttgtcaggtctgtgctgccaattttggagatatttgcagtgtagttggccagcaagctactgaagaaatgttggtaagtattgcagatataaaggagtaaacagtgtgtgttacaaagtagtacataaagtttgaaatgcacacatttactccaaagttttattaacacaattccatgaatataaaccagaaagataattttgaatttaggagtttaaatatctgtaatctgggcatttgaattatctttttgatatttattaaaaatatggatatgtttcagaaccattgatctgttttcacctcttccatttctgttaagcaaatcaattcttacttattcaattgaacctttaattttattgcaaccctcaagaatgttgatgacatattaaatctatagcaagttagttttaaatagtacacaagatgcctatacttgatgtataagtcaccatatctaaagagtttctgaagccatctcttatgcaaaataattaagttcaggggcaagctcttgtaaaacatttaagctatgattgttgggagtgcttttgcatagccagaaatattgcataagacaatccagtatgcttttgcatagccagaaatccgacggaccaaattatcagcactttttattaatttatcagtgatctttcatgttgggtagggttttgattatcacttttgtaaaataatacatttctgtccgttttaaagcaaacataattttgactcataagaaataacttaaaatttaagatatattattatatgttatatatttataatttaagatacattattttttatacttttaggaatagacagtaaattagatgtgatttattgaaaattgttgagtataaatactaatagatcctactttttaagacaatccaacatttaaaacactgaggctgggcgtggtggctcacacctgtaatcctagcactttgggaggccaaggcaggtggatcacctgaggtcaggagttcgagaccagcctggccaacatggtgaaccctcatttctactaaaaatacaaaaattagctgggcgtggtggcacacgtctgtaatcccagctacttgggaggctgaggcaggagaattgctggaacccaggaggtggagtttgcagtgagccaagattgcaccacctcactccagcctgggcaaaagagtgagactctgtctcaaaacaaacaaacaaacaaaagaagcgtgaaagcagaaaatgaaagcgaagtaactgatgaaatctgctatctttatccaactaacaagactctttccttttcacatagctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggtagggttttgattatcacttttgtaaaataatacatttgtgtccgttttaaagcaaacataattttgacctcataagaaataacttataatttaagatatattattttttatacttttaggaatagacagtagaaagactactatattaacagtttgtgtgtttttttgtaacaggacaaaaatttctttacacatttaagtcctgttgatttttatttaattggcatgatgtattatgttaatttttagatgttaaaccacttgcatctttggaataagtcccacttggtcatagttgtataattctttttatatgtcgctggattcagtttgtcagtattttgttgagggtttttgtgtccatatcatgagagataatagtctgtagttttcttatggtgcctttgtctggtttgttgtcagagtaataatggcctcataaaatgagttaggaaatgttccctcctctactgtttttggggagagtttttgaagaattgttattgattatctcttaaatgtttggttgagttcagtggtgaagccgtctgggcctgggcttttctttgtagatagttgtaaaattcctaattctgtctcttcacttgttataggtctgttgtgtgtttttttcttgagtcagttttcatagtttgtatctttctaggaatttgtacatttcatctaagttacttaatttgttggtatatgattatacataggattcctttataatcttttaatttctgtaatgtcagtagtaatgcctcttctttcatttcctatttgagtaatttgagtcttgtctctgtttcttggccagtctgctaaaggtttgtcagcttcgttgatctttttacagaaccaacttttggtttcattggttttctctatttttctattattcattaatttccattttaatctttattctcccttctgcttgcttttagtttattttgcttctttttccagtgtctttaggcagaaggttaggttgtggattagaggtcttccttccttctttgaattatcatctggggtaaatggctttcaacccgaaaaactttatttagtatttcttgttaatgtggttctgcgaacaacaaattctgttttcatttatctgtgaatgtccttatttcaccttcaattttgaaagacagctttacttaatgtgagattgagtgtgttatgccactgcctcagacctcttctgtttctactgtgaagtcagcggttaatcatattggggttcccttgtaagtgatgtgtcatttttcgcttgttgctttctagatttttctccttgcctttgactttcagaatttttactgtgatgtgtccgtatgtgcacctcttttagtttatactacttggagttgagttgattgaacttcctagttatgtaagttacgtttttcaatacgtttgaaaagttttgagccaatgtttcttcaaatatttttccttctctcttctctccctctaatattcccattatgtatatgttaaatgtgcttaatgatggcccacatttctttgaggcccttttcatttttcctcaattttttccccctctctattctttggcttgcataatctctattgatctatcttcaatagaacaattatttgttctgccagttcagatctactgttgagctcatgtactgactttattttagtcattgcacttttcagctgtagaattccatctggttcttttttgtaatttctctttattgatgttatactctagttgatgcagcaccgtccccataactcccattacttctgtaatcatcatttcctttggttctgtgaacatgtttataatagctactttgaagtctttttttaagtctgaaatctgattgctctcacaatcagtttctgttgcctgtctcttttatccccctaatgtatggatttttttttttttgcctgccttgtaatgttttgttgagagttgaacattttagataatatgtgtagtttgatactggttgtcctcgctcccccatgggggcttgttactgttatttgcttgtttagtgactggctggaatgcttgagtgaagactatttccccactccaggaggtacagctttgggtctgcccacagccaccctggtatgacaggggcttagtgggtatggaagggcagcagcctgaggttcccttggcttctttctcctggtgaggaatcaccaccctgtgaggtagaccagtgccttttggggccccagccttttcagtgtgccacacccaaaggagggtggaagaaaggagcctcacccctcagctgctctcactcaggactggacctcagcatcaggtagctggagcgatgcagcctgtgcccgggagctgcgggagagcagaccccagtgtgcttggctacagcacactgctgtctccacctcacctcactggaggcgttacaaggagggaatggtcagctgggcgcggtggctcgcacctgtaatcccagcactttgggaggccgagacgggtggatcacgaggtcaggagatcaagaccatcctggctaacacggtgaaaccccgtctctactaacaaatacaaaaaattagccgggtgtggtggcgggcgcctgtagtcccagctactcaggaggctgaggcaggagaatggcgtgaacctgggaggcggagcttgcagtgagccgagatcgcgccattgcactccagcctgggcaatagagcgagactctgtctcaaaaaaaaaaaaaaaattagactctcagcttttttatgatgtatactacattttgtcagttttctttaattgttatcccttcaattgctgcttgctcctagggccatttccaggggctttgaattattgttttataattttcacttacttcactgagaagtgggtcagctgagctcctcacaccgtcatggcagagatcaatctcaggacctttgcatattcattcccaaaacaaaattgacatagagggcaagactcttaagccttgatattatattaatgtttttgttatatcctgtatcggcttgttagaaaagattaacatagcttactcaattttctttgtgaagctatgtatttggtcgttgttttggattggtaacatgcattagttcctgttaatttgagaatatggatatgtcagtcattttagagatatacagctgttccttggtatccatggaggattggttccaggaccccttgtggataccaaaatctgaggatactcagaagtctctgatacaaaatggcatagtatttgcatataacctatgcacatcctcctgtacactgtaaatcgtctctagattacttacatctaatacagcataaatgctatgtaagtaattgttactctattatttagggaataatgacaaggaaaaaagtctgtacttgttcaatacagacacaaccatcatgggtctaacaatgttttcaatgtgtagttggttgaatccacagaacctgtggatacagagggcaggctatatatgctgcacctgtctgagaaaaatgtgtatcttatgcctattttacacacacacacacacacacacacacacacgtgtaaatcctatgcctatttaggtgcaaaaaaaagacaagatagtcttttgtccgaacaatgttaagccatttggggaaggttataatctactgtattgtcccttctcaaaagttaaaattgaattaaaagttaattttatttctgaaattcgttaatatttattctttgagtgacttgtgggttttttagtggtttccagaacctttgtttaaagtcattagttgtttatttcttaaagtcattgaaactagtaaaaataatagcttaaaatcactttattttgaggaatagctcaaagtagaaatatttttatagtgttggaaaattactcaattacaggcagtgggatgtgttggagagttaaaattggacttcagtcctgatttcattgtaactatagggtaacactgaagaagtcattttatttggatttcagtttctgtttttgtgaaatcaaggaggtagattaatagtaggatttaattaacttattagacactgtgatctctctcctccacattaaacttttttcattctaatctaacaacaagctaaactaatgatttagataaattaagttttctatgtcctttattgggaacaagctcagagatttaacagtattcagagaagattaaattcgtgcatacagcgttaaaagtgaccttttatccttttatggaagtaatgtttccataatgtttcgtaagtaagtgacttacgaaggggagaaaaacccttagtttacacacatacaagctattcttttccctctcatgcatataattctagcctttttaaaaaatcaattgagtcattttttatgtatgcttctccaagagtaggtaaatactaataatagatatctctacatttatttgcttttgtaaaaatcatgcttactatataattattatcttaaacttgaaaaaggtattattatgctttttttttttttttaaagaaaagaaatgctagccaggagcagtgactcacacctataatcctaacactttgggaggaggaggtgggaggattgcttgaggctaggagttcaagaccagtctgggcaacatagcaaggacttgtctctgcaaaaaaaatagaaaaattaactggatgtggtggcacatgcctatagtccccaactattcatgaggctgaggttggaagatcacttaagccaaggattttgaggctgcagtgagccatggtagcaccactgttttccagcctccacagcagagcaagagctgtctcaaaaggaaaaggaatgctaaacttcagggaaattggtgtgtggcaaagtcaaggttttagtaacataccagtttcccattgttgttgcctttgtccgattgtgtccatccttccataaaacctctcattttcaaatgttttaaaaattcctgattttaaaaataatacagaaatacgacatgaagtggaattctataacttctttatcacccctcctacatgagacagtcatcaagaacaatagtatatgcttcaagatctttgtgacatactttaagttaacattatgtttctggtacgtctgtcttgcttccttctagtgaacaaattaaagtctttcctacctgaaaacattaaatgtatttatcacattttgttggctttattgatttttatgttctttgtggcactcttggttttccttattctttttgttcttgagaacacagcaggaccttctttagttttgttctatgcaaatgtttcatagtatctcatacttagattatcatggttcaaacattcaagagaggataaaaacaattgaaagtaaaaaagagcaaataggggtttgtttggggttttttttttagacagtcttgctctgtcacccaggctggagtacagtggtgtgatcacggctcactacagacttagcctcatgggttcacgcgcttcttccacctcaggccctgccgagtagctgggaccacaggcatgcgccaccacgccctgctaactttggtattttttgtagagactggatttcgccatgttgcccaggctggtctcaaactgctggactcaagcgatctgcccagctcagcctcccagagtgctgggattacaggcatgagccactgcgcccagccagagaaaatagcttgtaagaatttttcagtcctagctaaagttctgaatctgggcttcctttagaaaagcttcattattatcctaaacatacttcggcatttgaaagtagattattaaatatacataatgtgtgcgtatataattctttttcaaaatgattcctttattattgtcctttttatcttcctaggttcgccaagcagcttttcagtctctgggacctttcatatctacttttgctaatccatctagctcaggccagtattttaaagaagaaagcaaaagttcagaagagatgtcagtagaaaacaaaaataggtataattttgaaaccattttctaattttaaaaccttgttttctaattttactgcttttaaacattatttccactattctgcaacaaatgttattttttgatagtttgctatttctcttgaatataaaaattggtgaatatttttatagagctttactttaagcgcatttgtttgttaagtatctctttggttggttacatattgaatgagtagatgcatgtaacacaattagctagatgcctcgcacataggaaactctaaatggtagattatgacttttaaaaaatgtttatttagtacattatttatctagtcaatcattcattgatatctacaatatacagggtaattgttacacactgtgtagtatttgggtttttttaaatttgtttttaaggagtaaaacttaatttaggaatatgttttattgtccttttctgtcaaataatttagttgcgcatcttggattctttgtcaatggtgattgtaatctgtcagttaaaggagaaagccagtatattagccagtatatcagttttaagtatatcagtctcataaggaaaccaaagttttaaataaagcttaaagagtcggctgtgatttttatttttaaatgtttttgcattgaaaattttctattaaatttaaattttaaaaatttattataatatatatttaggggaaaaactaattcaagcctaacttactagtatgcgggaaatgtacacaaacttttacagttatgcacttgaagtaattttagtacaaatatttgaaacagtccctgctataatgcttgagttaccatagtgtcttttccctcccttgtcatgatgctaatggacattttcttctgtaggtcttgatactgtgctatttgctttcttggtgttttgatttggcagttcttctttcttctctgctgccttgttttacctttttgcccgttctcctactgtcctgctgaatagccaaacaaacctgaggtactgttttttgtaaaggaagaaaatcactcaaacctgtcttcctagcaagcaaagtctgtcagtttttttgaaaacaggtgctgccaggactttgacaaaagtgatgatggtgggtggggaatgttatctatttttcatttttgaaatcagcatacttaaaaaattacctgtttatactgaagactgttacataacttctgttttaaaatctgaaatgggtctagtaagaaactataaatttgcagagaactgtataggacgagctggtaaactttcttctgtttcacaactactcactcggcctttgcagtgtataagcagccgtagacattacataaatggacaagcttggctgtgttccagtaaaacttcactgacctcaacagtgtgcctatcaaggccatgtttgccgcctaccggtgtgtagcattactgcaatagctatttaaaggtagttcaattccttgattcttcttccattgtaatgaggtatgtcttaatgtccaggcaatactacttgtattgctgatcttcagtaatattagagcttattaaattatgttaatgatatggtaggggaaagagagcattcctggctaaggaaggagttatgttaaatattgtaaaagcttttgcatagtttgacaaactataaagaagtagtcctatatattattaaatctcagaaccattagtttgtttgccctcccttaaatagcacagtggcatttgttttaagctgtcttaaactgttgtggtattaagattgattgattgattatgcaaaagttaactgagcacctcctatgaaccagaaactgtaaatggaaagatagaacttcgttcctgtcctcaaagttctctcagtttcttagattcaggtttttcaaacaaatgtcttacaaagtaagcaagtttttggcaacatatttccaccactgtttattgtatagtgtttcatctgaccctagaaacatttactatcactttattactctttgaagcatttattgattccaaacatctgacttacacatcagatctttcactcaccctggatcaggctgttaatgcttctttgaaagtgctgataaagcctacttctcagaagcagagttgaaatactcaaatctgcattttaaaagtatgtaaaataagcattcgttatcacattgttctctgaatgcaccatgttctcttaattctccctgtttttgtacttgctgctctctgggaagcttcttgttccatccataccctcgtttaacaaagtgctgtcttagatgcactgagttgtccaggaagtacagagcttttgtcttcatcatcagtagcgctgtaatgagagcactattttaatcctatccttttggctacatattggcatctatcatccagtagcctcccggccatgcagtgtggcgtccagctcctccctttgtctccgctgggcctggcccgttggtgcacatattaatcctgaatgaattattctagggaaatatggatttgacctcaaaaatctgaagtaactaaaccacttttgctggatttttccagtttagcttaatgctaactatatgaaaaaaaattattagcacaaatttggaaatatttcatgaatgctaaaacttcattgagttaattcacagtacttggaaggtatcctggagcgtgtttgcttttatctcaggatacaatacctctttagccagatgttctacaagtcattttctccttgaaatacctgtaattaattttctaggcccatagtctctactaaggaactctgaagatattaattataaacttatgtaggcacaaaaagacacttaagattcctccttaagtaggtagtttctggactgtcctctggtgctcttgatacctacgtctcttaggagacaggataattcccattatacagagtcacaaagggcctcaattttcaaaaaaaaatttgtcttgtacaatagcatttcaaagtctgacaattaggaatatcagaattttagcattgaacagcttgattttgtattgactattatactttaccaggaaaaattagaatttagagaatttatactttcgacatttttgaagccatgcatgctgtagttctgtccacaatttaatactgtactagggaaactttgtcttctagtttccttttaaaaaaatcattctaagagttttaagtttggacaaactaacaagtttacatttatcagacaaacagttatttgaccagtcattctccgttcatttttgcagctgagaatattaaaatttaattttaacaccaaggtgagctagtgatcaaggaacttcaaggccctgtaattccatcactttaggaggctgaggcaggaggatcgcttcagcccaggagtttgaggctgcagtgagctatgatcataccactttacaccagcctgggctacagagcgagaccctgtctcttaaaaaaacaataaacaaaacagaagttcattgtatttattagatagtacatacgaggtcttacaagttttacccatttgctcttctcttccccctttctgaacaatatcttattataattttaaaattttagtttgaatgatttcagaaattttgcaaggatatcacaaagaacttcatatatccatgtagattttccaaatactgttttaccatatttgctttattctttttttctgaactctttgagaataagttttagacatgatattctttttacctttttaaaatactatgtatttctttaaaacacagatgttaatatataactgtagtccagttaccaaaattaggaaattaacattgatacaatactgttagctaatctagcctttattgaattttaccaattggcccactaatgttctttataacaaaagggaaaaatacatattttttaatatggacaaaatgggaaatacataattcataaacatgtagaagacacatttattttgcataacagcactagcttcaggagctcctttggagtgggaaaacatcttacaggttatctaggccaactcctcatttttatgaataaggaataagtgaggaatcctagaagtccttaaaaggttcagaattttatattaacgtagtgccagtgcgagagtaagaacgttaaagtctgatttcttcacacttgtaaacaattgtattatatatgcatactgtatattttgtagttataagaagaaaaataccagaatttaaaatgcagtcacaatgtgttatgttttcagatgacttacgtatgtttttgttcatcagtattttaaaaaataatcacctgtttgtgaaaataatggttttgaaaacagcattatgatgagagggaacttcgtaatttcatgagaatgtagatggtgactgtttaagtgggagctcacataggcattaacatcaccctccttttgcacagtccttttaagtctcctgttaaacatcttttattgtgtgtatttaaaggcacacagatgctttttcctgtattcatcttacaaatttacctacatattcagccatccttatttccctttcatgtttcttgggaagcaagtctcttcactgtttaatctgttttgctgtgtttttgaagcccatattctttcctcttctcagaaagacattgctttatcagttatttcatcaatctctgtgtctccagttctttcatctcttctaacctattttcctcagcctaaaaatatgctcatcattcttttatacaggaaaaatgccttcactctttgttattctatgcagttgtgttattctttattaatacttgttgcctccgcatatgtcagccccacacatctttctgagttgatgacctccacctctgtctcagtctttacctctttctcatagataatcaccacctagaacccaacgtggatagctaactcaacctctttcaacctgaacctgttagctttcttgtgaaactgtttttgttacctgcagcatgcaataagtggaaaagtcctgttgatttttgctgctgtttgaatgtgttcttctgtagtcctggagacactgcctccatcagaacatcatcacttcttacctgcatgtctgtaattcctgcctcctatcttacctctcaactcattttctacacttcctccagaatggtctttctaaaacaacagatctattaacaatttccttactacatgatttcctgtagtccaggatgaactccggaggtctgctggtctggaatacagtggttcatgtgatatctttcatccttgtcatccatcatttcctcattgctgattcctgaatgcgtcacaccttttctgccactccggcctttgcatgtcctgtttctcctttagatgcttttttcttccccttagccccataaacatgtattggttcttctaagcacaactcatgtcatttccttgaaggccttttaatcttcactcccatctcctcctgtgttcagtgtgcttgcatctgtgcttaccaccctgtctagcagcaatttgctgatatatcttcattttttctgtttgcctctaattgtaatctcaagatcaagagctgcatctcattcacatttgaatcctcaatactgatttcatttcctggctcttagtaggtgctcaataaatgcctgttaaatttaattgaatcaaataataacacttacagtcgtacttcagataatagatggcagtaatcagtggactttaatgaatttgtaccatctgtccttatcaattaaattatgtcctcattttaggaaaaccttggggagtagagatgaatattttagaagaaacagaagtaatatttacactcaagcagattttaatatattttgtgagatagcaaataagtatctttcctactactatcttaaaattgtttttattttattttccttgtgtaatgtaagcaaataggctttaggtctcagctttgcaatatgtcgttggagtagagaggtaatacaaataaccctaaaaataaaataatttaaatgttgttatgtaacttaaaatgattgtaggaatttctgtttccactacttttctttagttatttattattgaaattagcatggtgttatagaatcccaggattcttaaatgttaccttctctaactaatatatattgcttgactatctagacttatacttaacaggtatttacatctttgaacacagaacagctgatggagaaagaagcattataaataatatacataaactcagtttgtacagataatccgtaatttttaatgtttaacttgtctaaatgctatatgtaatatctttcatcagtttttttaaagtaattatcctttcatattgtttttttcccaccaaataaaacaataaaaggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaaggtatggaagtcaatcaagttatttattctgaaattgattaaaaatattagtgtctatcttaaaaaaatttcatttcagaaaaaattgtcatttaataatgtattatggactgggcacagtgactcatacctataataccagcactttgagaggttgagacaggaggatcacttgagaccaggaggttgagaccagtctgggcaacatagtaagaccccatctctacaaaaaaataaaaaattagccgggcatggtggcacatgcttgtagtcctagcaacttgggaaactgaggtgggagatcgtttgagcttaggaggttgaggctgcactgagctgtaattgtgcctaagttcaaatggtgtcaaaggatcatgcagcagcttgctctgatagttctccagcctgggcaacagagtaagaccctgtctattaaaaaaagaaaaaggtagtataaccatcattatcatgtatttctaaattctcttgataaatacaattaatctgattttcaggaaattttttatttaaaataggctcatcgttgcattccttactgtaatttatacagatttgttgattgacaaatcactctctttgaaagtttcagtcattcaaacagtgctttacagttttaaagtttgggctctgccttaactattttgcacagagactcattacctttttataagatagcagtacacgcagtcattcttttatggaaagactatagaatgtttgtcgcactactgcactgcagcctgggcgacagcaagactctgtctcgggcgtgggggaggaaaagactatagaatgttcacagcaagcatagtcaacttttgataaatgtttaacgtctttacagcttccagctttctgtttaaattttattatttaccaacttaagtttattaagtttatccaacttcaatgactccggttttcttcttttttttttttttttttctgagacggagtctcgctttgttgcccaggctggagttcagtggtgctcgatcttggctcacaacaacctctggttcaagcaattctcctgcctcagcttcccgagtagctgggattacaggcatgtgccactgcacccagctactttttttttttttttgagacagtctcactctgtcaccaggctggagtgtagtagtgccatctcagctcactgcaaccactgcctcctgggttcaagcgattctttggcctcaacctctcaagtagctgggactacaggcgtgcgccaccatgcccagctaatttttgtatttttagtagagacaggtttcaccatattggccaggctgatcttgaactcctgacctcaggtgatccgcctgccttggcctcccaccatgctgggattacaggtgtgaaccactgcgctcagcttattttatttttcttaaactatatttttatgaacaaaagattaccagttgtccttaagccggttctgggagctctcattgtattatagtacctgctagttctctgacatagactagtcacttaaatattaattgaaatattgaaagaactgctctaagtttttctttcagcaaataaatgcaaagaaatatgcatagattgctttctaaaaagacttacatgtacatacatacaagtttcttgatgtgactttgtgtttcagaagatatctaatactctttgtactgtaaatttactagctgcaattgagagacttcaatacaaataacagcataccttggagatactgctggttcagttccaaaccactgcaaaagagcaaatattgcaatagagtcacacaaatttgtggttttccagtgcataaaaccacaggtgcagtggcttgcacctgtaatctcagctacctgggaggctgaggcagaaggatagcttaaggccaagagtttgagaccagtttgggcaacatagcaagacccccatctctaaaaagattttgaatagtagctgggcatgattgcacactcctgtagtcccagccactctaaaggctgaggtgggagaattgagcctaggagtttaaggtttcagtagctatgattgcactactacactccagcctgggtgagagagtaagacccagtctcagaattttataaaagttgtgtttatactatactgtagtaagcatgtgatagcattttgtctaaaaaaaaatgcacataccttcattgaaaaaatactaaaaaatgctgatgatcatctgagctttacacaagttgtagtctcattgctggtggagggtcttgcttcaatgttggtggatgctgactggtcagggcagtggttgctgaaggctggggtggctgtggcaatttctgaaaataaaacagcgtggaagcttgctgtgtcagttgactcttcctttcatgaaagatgtatccatagctagcaatggtgtttgttggcatattacctgcaggagacatctttaaaaattagagtcagtcttctcaaacaccaccactgctttatcaataggtttatgtaatattctagatcttttgttgtcatttcaacaatgttcacagcatcatcactaggaggagattccatcttgagaaaccactttctttgctcatcctaagaggcatttgttcaagtttggtcaggagagccggatatagtgaccatgtgcctgtaatcccaactgaggacaggaggattgcttgagaccaggagttcaaggctgtagtggttatgattgtgcctacatataaccactatactccagcctggacaacataacaagaccccatctctaaaattaaaacaacagaaaacgtttgattatgagattgtagcatttcactcacgttttcaagctccactcctaattttagttctcctgctatttttaccctacctacagttacttcctccactgaagtcttgaatccttcagtcatttatgagggttgaaattaccttcttccatactccctttaatgtggatattttgacctcctcccatgaatcgtgaatgctcctaatggcatctagagtggtgaatcctttccagaaggttttcagtttactttgtccagatccatcagagaaatcactatttatggcagctataactttacagaatgtattcctgaaataataagacttgaaagttgaaattaccccttgatccttgggctgcagaatgggtattgtgttagcaggtatgaaaacaacattgtctcctcatacgcctctatcagagctcttgggtgaccaggtgtattgtcagtgagcagtaataatttgaaaggaatatttttctaagccataggtctcaacagtgggcttaaagtactcggcaaaccttgctgtaaatagatctgctctcatccaggctttacttttccagtgacagagcacaggcagagtagatttagcctaattcttaagggccccaggatttttgagtaaatgagcattggttttaacggttgtgtggtgtgtgtgtgtgtgtgtgtgtgtgtgtcacagcgcctcactccgtcacccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaccttggccttcggagctttgaagccaggcattgacttctctttagctaggaaagttatagatggcatcttcttccaatagaagactgttttatctgtgttgaaaatctgggccgggcgaggtggctcacgcctgtaatcccagaactttgggaggccgaggtgggtggatcatctgaggtcaggagtttgagaccagcctggccaacatggtgaaaccctgtctctactaataatacaaaaattaactgggcatgatggtccatgcctgtaattctagctgctagggaggctggggcaggagaattgctagaacccgggatgcaggggttgcagtgagccaagattgcaccactgtattccagcctgggtgacagagcaagactccatctcaaaaaaaaaaaattttgttgtttggtgtagctaccttagtggcttaagtaatcttagctagatcttctgaataacttgctgcagctttacctaagcactggctgcttcaccttgcacttctatgttatggagatggctccattccttaaacctcatgaaccaacctctgctagctttcagcttttcttctcagattcctaacctctctcagcctttacagaattgaagccagttagggccttgctctgagttagacttcggcttaagagaacgttgtggctggtttgatttctgtccagaccactcaaactttctgcatatcagcaataatgttgttgttccttcttctttgtgtgttcactggagtagcactttgaatgtccttcaagaacttttccatctgcatttataacttggctaactggcacaagtgtcctagcttttgggctttcttggcttttgagatgccttccccactaagcttaatcatttctagctttggatttaaagtgagagacatgttattcttcctttcacttgaactcttaggggctactgttgggttattgattggcccaattttaatattgttgagtctcagggaatagggagacaggagagagatgggtaaagaaagtcggtagagctgtaagaacacacacatttatcatttaagtttgccgtcttgtatggctagttagcagctcccaaaacaattacaatagtaatatcaaagatcactgatcacagatcaccatagcggatatagcaataatgaaaaagattgaactagtacaagaattaccaacatacaatacagaggcacagcgtaaacacatgctgttggaaaaatagcaccaatagacttgctaaatgtaagcttgccacagacctttagtttagaaaaagtacagttatcacgcccagcatggtggtgtgtgcctgtagtcccagccactcaggaggctgaggcagaaggattgcttgagcccaggggttcagtgcttcagtgagctatgatcatgccttgtgaatagctttctgcaagtaactccaacttgggcaaaatagtgggacctcacctctttaaagaaaaaaaaaaaagccaaagtgtagtatctacaaagtgcaataaaacaaagtatgcctgcactttccagggaacagaatggatgggggatgatacccacacacacacacacacacacacacacacacacacaccatgcactttatatgggacaaaacattttaacctttctttcttgtacagtctattttgagtactgttttggtttggcttgggagtgatcccaaaagggagtggctgaagtgattaaaagggttggtgaaaattgcagccgaaattctgaagataatgaaaatattccactacaactttttgtgagtgaatatgttcaattttcttaagttagcaagtaatgacctaatagactagaacctcatcctgtatgttgcttgtgtgtctgttgtcaggcacttaatatacttagatgagaaattttataaatgctgcagcataatagattatcttaaaatagttactgattgttttgtttaaaatgtttgaatttaaaatgttcacattttgaacatccaagtggattgttacttggaataaatgctaagcaatattttttgctaaatttctgatttatttggggagcaggaagaatgccttatcttaattttgaatcacctttgtaagtaaggtgcaacccaaaacataggcaatgctagttgccagatttttgaaccactgcctggtaagttgtccttttggtttgctgcaagcaagacagtgctcatttgggattattgtgtttgggagaagatgcaattctcattttcaaaaagaattagagaaaaataagcagtaataagatatgagatgtttaaatgtaactgtgacaagaatctttgtaattgccattgttttatgttggcagggtttgtgtgactgctcttctgctaaaatagcttagtaagtaagacttgccagtttgattcatgcactaccaaaacatagttaacgtttactgaaattgactccttttaataagccggaggcagctccagcaactagatagcatttctcttttcatactaacgcagaataatgtacagtagcagataaacatttttaatctcatgaaagcatattagttttctactttttctcttgaaggactaatgatttaccacagtagaaatttttttccagctttttgattgcagtgtcaaaaaagtatatatttcattgataacgtacagtgcaaatggagaacagccttgtaagaatattgcaattgtgtttctcactttgtccatttccttattttgcctgtagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgaggtaacaaactcagtaaagtgtttaccaaatgagagtagtttgaatcagaagtctttcattggggaatagttgtagctaatcacttttagtttgtatgttctgtttgttgctgattttttagctcttcgttttgcataaagtaattgttttcatcacatcctgtcctcgtgacattagtgtcatatgaaatgcctggaaaagtaaatcccacttctgtctatatgaccatttagtagactcaatgttaatgtagctcactgcagtgaaatagtcttactggaaacaaagccctttatcaagaataattaactcttcccttttctttttggagaggtgctttgtttctgatcggaccatttcactgcagcaagcaacacagtattctgagcagaagatcgggacttgaggccatgttgcggagggccagtgacattatctggactctggagtgtgagggtgggtactgatcctagcatcatcttcactgtgtacttgtagctgttctctatgatccttccctaatttcctgctgcatctccatcaagccagcattatttggtatcagtgctgcttagccattgtttatacaaatggggagaaggaatgcaccaccgattgccagaatcgcatggtcacagatcatagtggcttgaatgagaagctcaggaaagagtacctgcacacactggggatggcaggagggttcttagagctttagtgcatttctgttttgatttctgttggatggcatgtggtatagttagaaatctgtataataccactgctttggattgaagccctgactatttattggagatttgaatagtattaatatatctgcattttagaaggtgtttatgttgttgttgttgttactgtttttggctgttaacatatatataatttgtgaaattagatattaacagccaagaatagaaatagaagaaaaactgcatatgacactccatggtctctaaaacaatggaccaaaagaatcctctcagtactatttcataaataagctaatttgagctgtttggaccatttcaaaattactttcaaatattgtttttaattactctaatttttctggaattggttttcgtacacttgacaacctattcagcaagttagatttaaagtagggtaggttcttaggtatgtttataagcttttaaaaacatgaggaatttatatgtttattacttttggcagtcttgaaaggtaagtaacttagtaagatagcttaaatgaagatgtacagacaggacagctctttaagtagttattttttcctaacagaatatggactccactcttcactatattcacagcgattcagacttgagcaacaatagcagttttagccctgatgaggaaaggagaactaaagtacaagtaagtgaccaaaaaatgtgttcttttgtgggtgtgttcctaattcctcttttagagcccatttctgacctaatttgccccttctttatgatgagtgttctaaaaattgactagtgtgtcatattttccataaggaaatcgaagtagtagagagaggaacatggaagcacaaatcttcccttttctacctctgtgatcccattcttcattcagagtgaccacgatcacacaccttattatcttccttcatgtattttcatgggcacataaacatacacatgtgcctctttttatcattgaagacagctgtggtcatcccatcctacctaggtatttcctcttgttcacattgccaataattataaaatacagctcgatttcagagatgaaaatatgaaaaaatacgaaaattttaaagtgccatcagtaacaagctgcagggaaactgtgctcacggaatcattgaaatgtggtagctgtgccttgccttgctcttttcttttctcttctaacaatctgacctggtgacctctcctgtgagcacaccaggactccttcaccttcacagcagcacagcacagtgtccatgccacacccgtggtctccatcgtaagaaggcactgtgggagatgctactcgttgtagtttcactttgatgctataagcagtgctgcattcaccatgactgtctgtacgtgttgtttgcttctatgactttattattattattattattattattattattattattattattagagatggagtctcactctgtcacccaggctagagtgcagtggcaccatctcagcttactgcagcctccgcctcctgggttcaagcagttctcctgcctcagcctcccaagtagctgggactacagttgcgagccaccatgcccagctaattttttgtgtttttagtagagacagtgtttcgccgtgttggccaggctggtcatgaactcctgacctcaagtgatccgcccacctcagcctcccaaaatgctgtgattacaggcatgagctaccgtgcccagccttaggattatattattattgttagaagtagatttcccagatcaaatggtatatttattttgttattgttgttagagatggggtctccgctctgtcacccaggctggagtgcagtggcgagatcacagctcactgcagcctcgaactcctgggctcaagcattcgatccttctgcctcagccccccaagtagctgggactacagatgtgcaccgccacatctagccaatttttactttatttactaaaaatgaaatcagtattcaaaacaatagtgttttgaaacatgcttttccccacttacagacattttcagtatttcaaatctcattttaatgagtttatttccattttcattttgtgtatatggataattcgtttatgtagctcaaaattcaagatacttaaaaggcattcagtgatgttcccttctcagttttttcttctccactcatccattttgcttcctgagatacaaccagttttacctttcttttatatccttccacagctatattatacacacctaagcaagattgcaaatatgttcttcttttcctcacatatatactaataattagacatgtgcacttcaattttctagaaataattgcttaaattttcatctaaagaagacaagtttttatttttgttttgagacagagtctcactctgtcgcccaggctggagtacagtggtgctatcccagctcactgcagcttccacctccctgggctcaagtgatcatcccacctcagcctcccgagtatctggaactacaggtgtgagccaccatacctggctgattttttaattttttgtagagacggggtttcaccatgttgcccaggctgggctcaagtgatccaccctccttggcttctcaaagtgctgggactacaggtgtgagccactgtgcctggctggtttttgtttttttaatgaacatgttgcaaatcacgcagagcacctgttattctgcatttgctgggttataacaaacattgtcatctctgcctacatttaaaaggctctggtgttattttaatatgtcttttcaatttagtaattaattctaattttcctttgagctgagatgttattcattgttctcctagagttgcttttatttgttcatatatgtttcccttagcatgtttttcgtatctcttagttattagatacctgaacatttgacattggtttttctcaactatttgagatgctatgttaaaatctatatatttaaaaataattttgcccaatttatgtctaaactgctcaaaatgcatctcagctgctcagtcactgtggtttctctttctccattaggatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcaggtgagtaaagcagttaaagaattagcagaacgtgcatgtggaaggcacagtgctttgctttttgtaacctaaagaatttctgttcatgttctagcatgttcttagtgttataggaaattatgtatggaagagcttaagagtaataacagagcatgttctttttgcagtgtcagagtcccacaatttggcttcttcatttttatctaaagcattagaaattgttatcacattcaacatgcctacattcctaacttaaaatgtattattatctagagtttatatgtaaattaattgttccgaatataggatttaatttttcacctagaaatagtattataaatgcttatttgatttgcacagtagatctgaaaatatttgttgaaaccgtagtagaactccagtattactagcacatgtgaagttctgggccctgcatgccttgagcattgcagtacagacaggagaagttccgtggttcttgctctctcctcatccccacacaccacccccaacccctttcaacagaacacacaaggtaaacccttgcttcacgtcattttgtctggacatctgtgacttttgtgtgacctcttcccaggcttgatgacctgacctcccctgccagggctgatttctgtataaacaaagtttgcccctctttgaacacacctgttccttcagtgaagttgatctctcagttatttaaaaaaaaaaaaaaaaagcagtctgattaggctaatttgtactgaaatgtgatgacttttccttaaacttcttagtaattgtatttttcaaggaatcagtgctgttgactcagcaagttataagttggaagtaatcttgataggtcaagttcctcctttgacctatgaggttaggaaagctgggcccaggagaagtgaatttatccttaaccaggacccagaagaagtgaatttatctgtgttcatatactttttaagtgctgcatctggtcatggaaccacaaaggcccaatttccatagagtgctttgtcctgtgtattcgtgttttcagtctttattctacagaactgtagggttcccgtgggatgtatctttcggggcacctgggtgactctgatggctcagaatctggatgggcagtttcttctctctgctgcccccctcttccatcagaacatctctgccttcatctgtcttatatgttgaacttgggcgtaaaattttatttcaagagtggattctggggggaagggaaaggaaatacaatgtttgctctaaactgtttctctttaggtaaaattttaagttactatgtaaaaattttatgattaaggcaccatggagaaaaggatgtttttaacttaaaattattataaatgcaacacatttctgttgagggtttcttttccaaggctgtatgctgatttccctagtcttatatttcttaaattgccaattccttaaaaacaaattttattgttctgttttgtttttcttaatccaaggtttggctgtacaggaatctgaaggggaacagtaaaccggggagggtgctagagatcctttggtccatgtgcagcctcagtacgtcggcatgttctagcatgtgcttagtgctacaggaaattatgtatggaagagcttaggagtaataacaaagccatgtgcagcctcagtacgtcggcatgttctagcatgtgcttagtgctacaggaaattatgtatggaagagcttaggagtaataacagagcatgttcttcttgcactgtcagagccagggtccaatgttcagagagctacaaaaacttcacgattgctaagcattttctcctcataaatgaaaggaagataatacgtactaggcagggatttaaaatgtttctgttacacttttcgatgcataatttaggcatttaaagttagtatctgttattctgatttaattttttgaggttagtaacattcatatataaattagcctttgtatattgcctaatggttaaagtactgcgtactttgtggttagcttactaatgtgttttcatttctgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaaggtaacttttaaatttttttgcataaaaacacaacaaaattctgccgtaatctaaatctttatcttctgctatcaccaagagaggtttctttgtgtttctatgtaagaaaacacagccataagttgatgttaagatgcaacttaaaaaagaaatggtcccataattatactctcacttttaaaacagtattagatgatagtttacagacatttgtatctttttctttttcaaaattattgagtgaaatgtatgttaaaaaaaatcattagctgcagtcatccctcagtacatgcaggaggattggttccaggtcccccatgcacacccaaatccatggagtactcctgtggaacctgcgtataggaaaagtctgccctccgtgtactccagtttcacatccgggaatactgtattttcaatctggttgggacaaacaattcaagtataagtggacccatgcagttcaaacccctgttgttgaaagtcaactgtgtattaagtttggaggctttgtgtggtatttcaggcgtcttgagaatttacgtttagccctcactactttgatagaggagctgtggtctccaaagtgaatagccctgattttttacaaattgtttactcctggagtactgttgttgtttttagactttagccttgaaattgactctggtaattctaaggcttgagtgatagaagtaattgtagtcctcccttttaaaaaacactgaggctgggcacagtggctcacgcctgtaatcccagcactttgggaggctgaggcgggcagatcacttgaggtcaggaggttgagaccagcctggccaacatggtgaaaccttgtctttactaaaatacaaaaaattagctgggcgtggtggtaggcacctgtagtctcagccactcaggagactgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagtagctgtaactacaggtgcgtgccactaagcccggccgattttgtgtttttttgtttgtttgtttgtttgtttgttttagtagagatggggtttcaccgtgttggccaggatggtcttgatctcctgatcttgtgatccggccaccttggcctcccaaagtgctgggattacaggcgtgagccaccatgcctggcctaaaatttttctgattgtcccagtattgtcctttatagtttttctccgctcaattttgaatcccttaaagtgcatattaaatttaaatgttatctttctttagtcctcttaaatctaggtgtcactggcatttttgaggagtctaaaccagttgttttacagaattaccctcaatttgaatttacacaatttgattctgagtaagcggggtttttttgcagacatgttaacctgtgtaggttgtcatgtatttttctgaatgtgccacatcagggctaatgtggtgttggctcttcccatcattggtgacgagaaggctgacaactccattgtaaaatgaccttttaccttttgtggttaatagagaattggtgaggtgatactttagaactctgaatatctttttctctagagtccttcaccagtgctctcatatccaggcatctatacatggttcttacctgaatcagttaactgtgttggttgtgaaagagtgattttctattttcataattctttctgtttttttttaattaattaacttacttattttgagacagggtctcactctgttgcccaggctggagtgtaatgatgcaatcatggctcactgcagcctccacctctcccagctcagatgatcctcccacttctgcctcctgagtagctggggccacaggcgcaccaccacgcccaactgagttttgtattttttgtagggatagggtttcactatgttgcccacactggtcttgaactcctgggctcaagtgatctgccccgccttagcctcccaaagttctgggattacagatgtgagccactatgctgggccattccttctgtttttattaagtaacattcccatgtaaaaataacctgtgccttctctccttccccggtttcgaaagttattttagtattagtggggactctaggattttaaaaattcaacataatggaatccatttctgtcatttgttttgagcatcaaatttgactagtggagaccccttaaagctgcctcttgtgtcctttgatttgtcctttgatttttaagtgcatcaatactttcagtttcaactttccctttccctgtcccagcctggagtcagctatttctccaaggaactgtggtcctttttagtggagaatggtccttagaaactgagatccaggcactggaagtgctcattgctcctggcctgtcatttcttttaggtcttttcaggagatagtagctaggaggtgtagatagtagctaggaggtgtgatgcttttttttttaattaaattactaacttcatattgttatgaactgcttccaattcaataccgttttctctcttcactttatatatttttttctttttactcctggtaaaaagtctgttcttagtaacattaatgtgtaatatttagttgtggctgggcacagtggctcacacctgtaatcccagcactttgggaggccaaggcgagcggatcacctgaggtcaggagatcgagaccatcctggctaacacggtgaatccccgtctctactaaagatacaaaaaattagccgggcgtggtggcatgcgcctgtagtcccagctactcgggaggctgaggcaggagaatcgcttgaacctgggaggcggaggttgcagtgagccgagatcccgccactgcactccagcctggaccacagagtgagacactgtctcaaaaaaaaaaaaaaaaaattagttgtttgctgagttccacaacataaatgaaatagtttcagaattactccaccaataataattcccacatcaaatcaactacataatattcaggacttcctagcacattctgtccttagaacgtcccttgaagatgtatggtcaaagtagtcagttcacactttggcttttttccctgtgtgattgttttccatctgatgcacagttaggttggtttgcttccgtttataaacttacctttaaatatttatagagcagctattgggatacatttattttttttctctcaacaaatactgaatgcctactctgtgctgtcacagcgtcacacgcagggcttacacacgtggttaagagcataattactgccttaagcggggccatggcaacaaggatgtcatatgaataaagggggcaagccctgtaatcaggctgtgcccggggtactgtggggtttagcgtggctcattgataggcacaaggaacaaagatttccagacaagatggtgattcctgaaggcaaatggaattattcagggaaaaataaacttaataccaaattttaaaacacttaaatacagctactacatttcctcttcagaagaattaaccatattgcttacagtctgtttttaagcactctagtaaaagaaatactgtctgtaccttgtcctggtaaatatttttattttgttactttagcttcttcatattgacaaaagaagagaatatctttatcaacttcaggagtttttggtgacagataatagtagaaattggcggtttcgagctgaactggctgagtaagttctaacagtttattagattatgttttggaggggtatatatttacttcatttttacattttctcagtttcttcattactttgtgtagatccaagtttctatgtggtattctagccctttaacgcttcctgtaatatgtgtcttactgtcagtgaatttcctcagcttttttattttttcttgaaaatgtctttagttcatctttatattatttttatcatggtgaaatacacatagccaaatttgctgttgatgacatttagtccattcacagtgttgtggaaccattccctctatctagttctgaaatgttaacctcccgaaaagaaaaacccatgcccaataagcatctactatctatggatttgcctgttgcggacatttcatgcaagtggagtcatataacacatggccttttgtgcttggtttcttcatttaacaatgttttcagttgtcctccatattgtatcctctagctgaacctgccttcctttttgtggttgagtaatattccattgtatggatataccacattcgtttagggcattcatctgttgaggaacatttgggttgggggtgtggtcttttgtgaatagtgctgctaggaacgtttatgtacaagatttaatatttgaaatctgttttcagttcttttgaggtgaatttgcaaggccatatggtaattctgtgtttaatttcttgaggaactgccaaaacttttccacaacagctataccattttacattcccatcagcaatgtatgggagttccagtttctctgtctcctcactaacacctatttttctactaaattttaaaaatatttctaaattggccaaataataattgtgcatatttgtgaggtatgtaatgatgttgcaatacgtatcggatagtggtcagataagggcagttagcatatccatcactcgcttatcatttacagctgttctgatgggcttggaacagcacttcattgtggtatgatttgcatttccctaatgactaatgatgttgaacacttttccataagcctgtcaaccatttgtgtatattttgtggagaaatgtctatccaagtctgttgcacatttttaaattggattatcttaagttgtgttgttgagttgtaagagttctttatatattctggattatagacctcacctgcattttcaaatgatgtctttgctgagtatggaatgtggggctgacagtttgtctttcagtatattaaagatgccactccattgagttctggcttgcccacttctgactcaaaacacacgcctcctcttctgccatatagtgccggggtgtgagtccatctagtcagggtcaagctgggtttgcgttttgtgattgctgtggttacgttcagtgtacttggggcttcagtttttctcgctgtgggctgccactaccattgtcgtttgctgagggtggcagctggggtaccagtggtcttctagtgtgagtattccacccggcgtttagcggtacctgcacccctgcgtaatgggtgggacctcctatctgtgcttggtctcgggcaggacttcctacagctcctcctggaataaggagcattagttctcctctcccacagttgcagtatttttgctgggcccacagggtggacaggctttggggcccctccaccagcaggttaagccttttgctttgcacgagaaaagggcccagcagagtgcttgatgattcatggctgtcagtcagttgcttctgcctgctatgagacatctctcctgtttttcctgaccatctttcttgaagcacccatgggaggcaggtaccctgtggaagtcagaaggttgtctgggaatgtgagctccctgtgtcgggcacatctggctttgtttgagccaccccatgctcctgccagccaccatctggccctgggcagctgactgcaattcgagctgatttctccctgccctgttaggtgctagcaggtgtcctgtccatccgggctctgctgaggggcagttctctttcccatcttgggaagttaggttgtttgtgtgctttgcaaccccagctctctgatgggctcaagaaaagatcttgaagtttatgtagctttttctactgtagggtcagtgacgttctttgcagttttctgtattctaagcagaaactggtcctatttggaatttttattttgaattttgtcagaaaataagtgtgtctctttgaggatgcatatttgtatacacaggtgcatttatcattgctgcataatctatattcatgttacagttgactttctgcttattagaaatgtaaatcctcttgaacataaaatctgaaaggcaaaagtctcacatccaaggtatttcttcaaggccatcattgaagctttcaggttagcttggtagatgtcatgaaagtctcagggcccctcagatgtgatgggaaggttgctggaggacaccctccctctgttatccctagcaaatcccttccaggaaggctcctcagagcctcgacaggtacacagtggactccctccctctgcggggacttcttactgagaaacttgattgtagatggaagcttctcagcacattccaaactgtgaccatggatcagtgtgggccatgttccagttgaacatactaggaagtgctttgctctgtctcagtccccatggatgcagaactctacagcttttgttttccttacactctaaggaacttgaatagcatgtaagtgcatttccagatacacagagactggaggtaactgtacaggagaggtctgcttaatcactcctctttgcgtatgtttgagacaggtgctcagtaatccagtattacagatgatttaaatgggtaacctattttcatttgtctcgctgatttttaaacattgtctttttgtaattcctttttgtagacagctgattttacttctagagttatatagtcccagagatgtttatgactatttacgtcccattgctctgaatctgtgtgcagacaaagtttcttctgttcgttggatttcctacaagttggtatgtattgaacttttaaaattttagatcagcaaactctaagatcctagaatggaagctgttcctcatttctccatgctcaccctcccaggtcagcgagatggtgaagaagctgcacgcggcaacaccaccaacgttcggagtggacctcatcaatgagcttgtggagaactttggcagatgtcccaagtggtctggtcggcaagcctttgtctttgtctgccaggtaagcgaggccctgggcttacctgtttgtgagtttttctcctagaagaatgtcttctttaacttcctacctctctctcaccctcttccttactcttaaggaacagaaccttatagtagcctggctgtttataggatcatctgcccccattgttgggcatctggtggcccctctctcccagctagccaagcccctccttacactggcatgcaccacacacaccccacgtgcctgctgtatgtgcttgttccacaccacatgcctggtatgtgcgtgttctgctctgcacacattcagacgtgtgtatatgtacatttcacagtgcacatacatgcatgttcctcactgttcctcactgcatattacacaggcatacatacatgtaccccaccacacacatactgtgcacacatataccataccacggttcccactagagggtgctcatgtctgggacccagagcgcaggtgtgaaaatgaaacacctgtgaatgaacactctaggtctccgtagagcagtttaaaaactgtgtctgtccgtgtgggcagttaattatgtaatttttgatttgagttcccaagtacgtggaattttggttaaaaagcaataactaaaatttgtacctgtggtcactcagagattttgttagccagtagtcgagtttttggctacattgacagagaagcctagagcagctgtttctcttccccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaaggtaggtagtgactccactagaagaagcgtgtgagtagagaaggaggtctgtggactgcactggatcagcagatatcaaagcagaagtattgtctgctcagagaaaataatctggtggaaggaaatactttagttgttccggtgattctcccaagagggcatggaagatgaaagggattttttaattagccctctactgttctagttggagtttatttatcggaagcatgtatcatttttatcatttaaaacttaggtttttttgtttgcttgatattttgagacggagtctcgccctgtcacccaggctggagtgcaatggtgcgatctcagctcactgtaacctctgccttccgggttcaagcaattcttctgcctcagcctccccagtagctgggattacaggtgcccgccaccacgcccagctaattttttgtatttttagtagagatggggtttcaccatgttggccaggccggtctcgaactcctgacctcatgtgatctgcctgcctcagcctcccaaagtgctgggattacaggcatgacccaccgtgcctgacctaaaacttagtttttaaacttgggtgttgtttttatgtacaaaccattgcctggcagcgtgccacttgcaatctgcagtatgggggctggtacctacctatgtttgctctcccttctgctttctcttcattaggcaagagacagatgccccatagtatttgttttgttggaaattataatctcttcaagattaaaggtggtttatttattttaatcgacccccccgccgcctgccgcccaaaacacctcataaatatagttgcacggatgaatgaagcacagaaagaagtttgtagtagatgtcaaagaataaggataaatgaatatttttttttctcctttttttttttttgtagttggtgtttggaagcatttttctttcactgctacttaatggctaagaagtgtgatgttttcatctatttattaatttaatattccttagctgtcattgaatatcatgagatttagtcttataaaaacaagataaatctcataactctttttattctggcactttttcttcctataacaaatcagtttggattactgtttatgtttcagtgtggcttgtttgtacttgtagaaatacccagtttaactgtttacactcgtacttgacggaactctgaagtgttccgttggactggtttcatctgtcctatgcacatgtcatttccagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaatgatttaaagtggggaaactagattaaaatatttgtcttttaactagtttattagtttctctggaatctgcctgtgtccctgggtttgggttttgctcttggcagcagcaggtgcctcttgggtgctcctcctgctcctgcctgcagccctaagagcaggtgggtgccgagtgtctggcacagcttggatgccgcccactgaagacagcagaggggggttgtcttgaagctcccgagacacagtcaagcatctctgagcctcgatgtcttcgtcagtaaaatgggaattagtaaaacctgccctgtttctcacagggttgttttgcaggcaaatgagttcctgtgtgaaggtgcttttgtaaagtgctgcgtgtataaatgtttgatgttcctgtaagcctggtttgaaaaccttggcctgtcggagtcccctggtgcttctgtgagttttggttttatttagttagccagcagggactcctcagtaagtcaaaataagttcctttgaacttcagtgtgggatttgagaataggtgggctgcttcctgtctacactattacaaataagcctttggctgctgcttctcgcattataacccagatatttacacactgcaaatataagtgtaaacagattccactgggaaggatgttcaaatgaatagataaatgcataggtaatatgtgaagtgggtaatgggagtggggctggggagtagccgtggagggtgtggggtggtctccgaaggcctctgaaagcagcatcagcagagatcggaggaggacctggccgcttgatttagcctcgtgtgtgagctgcagattgtctgctattatcatatatttttggcccccagtatttcagttctgaaaattgcattagaatcatacactagtagcatttttttaaagcagtggctatgctaacatggtgtatttgggggtaaagaacttgaatttggctgggcacagtggctcacgcctgtaatcccagcactttgggaggccgaggcgggcggatcacgagatcaggagatcgagaccatcctggctaacacggcgaaaccccatctctactgaaaaaatacaaagaaattagccaggcgtggtggcgggcgcctgtagtcccagctgctcggaggctgaggcaggagaatggtgtgaacccgggaggtggagcttgcagtgagccgagatgatggcgtcactgcactccagcctgggcgacggagcgagagtccgtctcaaaaaataaataaataaaagaacttgaatttaagttgcgctatagcgcttgtaaagttaaaaatgcacaagccaattcccactgcagccttcgcacagcctgtcctaccaagactacacagcactgtaaaatacctcaatggcaatgaatacaaaagacacctgcattgacagctttcacatcctaccatcaaggcactcccagtgtgaagactttctaatggaattcagaataagattggagtgttacccatttcatttcaactcttagtagttgccaatgatgccttctgtagcggctctgaagaaggcgaggtgaggtaggcatgttcttggcagcaggagtcaacctgtatgcgacaggtgtcctgggtcctgtctcacgtgtggcctccacttacacaggatctcctaagggaggaagctgggattccaaaggcagtataaagccaagcacatgtggacagtcccccacgagatgaaagtggaaacagcaaaccaactagtattcacaacttctcctttcataatataaaaatgagtaagatggtaagctgtctttgagggtatttaatattgggtggctaatcttagacgatattctttgatatcgtaggacttgtgagtgacgaaggatgaagaggaaagccttactttctggaatagcttcttagtcactgcctaaagttcattctctgctcgcccccaatctccccagcaggcccttccacgtgggggtgtagttgacatggggccccactttctgcccggcctggcttgatctggggtcacagcactcatgagctctgctgtccctcgcctcttgggagaagcgtgcttgcgagcttgtgacagatggaagctcagtagtgagttcctccatccttccctgatttctcccaatctccagggaacagacttgctgctgggctgttggagggctggctcgaggagtagctacatttttggtcttggagatagttctgcgatgctttctagaactctcttaactccaagttggcaagtgttgagtcactgagaaagctgccatgccagcatcctgagaccctcttgtgatacagctgcctgggtgattcttcagcctcggggcgggcgtggcattggttcttctcagaggggaaggaaggtgttctctccaccccctggagttcagtaattgagtctgaaataaactgacagtaggcaggttaacagaagagcttagatgaatttttcacgtgcatgggagcatcacactgaagagccgatacctccaaacccagtgagatggagaagcttctgtactccctcacaggggacagggaaggggatgggggcaacttaggggagggtaaatgaacttagccctcggaagaacaggtgacaccgcaacagagtatccaggtgtgacgtgtgagccttcggttccctggtggatgaggttcccccgggaggggttcatggcagttgaggtccttctggaggatctgtctttgggcatatgaagatgtccagagaaagcccctcccagcatttgccattccacaactcccctcagttcagtgcagcatagattgaggtggcatttcctgaactcctttgctgtcatacctggtttgttcaggtcccatgtttgttgttataggggtgacttatttctgggggagctggtgccaaaacaccagctgtgcttagtgtggggaggaagggccaggcaggtgcttggtgggcagcacagggcaggcaggggcttcggggagggcagcaaggctgtaaactgccttcaggaactgggacatgtttctgtggagggttccagaaggagatgaaaagcaatgagccagcaagagggaaagtcccagcaactcaaagccaagcaaatggcctctttttttttttttgggacagagtctcgctctgtcgcccaggctggagtgcagtggcgagatctcggctcactgcaggctccgcctcccgggttcactccattctcctgcctcagcctcccgagtagctgggactgcaggcgcccgccaccacgcccggctaattttctgtatttttttttagtagagacggggtttcaccgtgttagccaggatggtctcgatctcctgactttgtgatccgcccacctcggcctcccaaagtgctgggattacaggcgtgagccaccgtgccccgccgcaaatggcatctttaatcctctgactcaaacgagagaagaaactgagtctggaaataaatgtgtaaaaaatggtgtatgttgctgtgttttctgattcctgcctcaagcctttccaagctggatgtggacctgcaaaaacagggccccagggggggatggcagggtccagggagggtgcaggcctttcctgcacgtgtgtgcatgtggggtgcatgtgtgtagtgtgcacacgtgttcatgtgtggtggggggcgtggtgtggagtgcatgtgtgtggagtgtgttcgtgtgcagtgtgggggggtggtgtgttatgtgtggagtgcctgtgtgtagagtgtgtggtgtgtgtgggggtggtttttaagtgacctggagggctcagggcctagggagtgaatgtgtctttttctcactagaaaaccagttcctggtgtaggtgagggtgggagggaagcccagctctcactttcctctaccagaaattccaaaatggaggtaattttgtgatctgaatatggcagttttgaccatgagaatattttgactaaacaaaaattccaaccataaatttttatgaaaggtattttgtgcagtgagctctactaagccagtttaattctttatccattttctatagggatttaataactaactatgtgtgtgtgtgcgttttgagacatatagtctcactctgttgcccaggctggagtgcagtagtgcgatctcagctcactgcgacctctgccgcctgggttcatgcaactcctgcctcagcctcctgcagtagctgggattacagggtgcctgccactacgcctggctaatttgtgtgtgtgtgtgtgtgctgcgcgtgcattttctgcttctaaatttttcttagtagagacagggtttctgaccttaggtgatcacgccatgccttggtgtccacaaaggtcctgggatttacaggtgtgagacaccacagccggccaacagttttagttttatcttatagaaattattttcggtaagaattctttttctggccgggcgcagtggctcacgcctgtaatcccagcactttgtgaggccgaggcgggcggatcacgaggtcaggagattgagatcatcctggctaacacggtgaaaccccgtctctactaaaaaatacaaaaacaattagccgggcgtggtggcagtcacctgtagtcccagctacgcgggaggctgtggcaggagaatggcgtgaacctgggaggcggagcttgcagtgagctgagatcgagatcgcgccactgcactccagcctgggggacagagcgagactccgtctcaaaaaaaataattctttaattcttttcctagaaaacttgacaaatgatcaataatccactttcagtccatgtgatgttttgcagcatggctatgagtttaatttctaccatgtctttcttttagggcaaattttgctgatttagagttgacaagattacttgcagtttttagtaattttaccatgattatttcaccccatctgctttttagtgttaatattaccaataattgttgctagttggatacaagacagctactgagtagtattttcagtagttccatgggaagagccaccacctcgccagaggctcctgagccgcgtttgggtgcgggcccacattgtcctgctgttcccaatccccaggagatgcccggccgtggacaggagagcgcaagctggtcctccagcaccgtgaggaattcagcgtggacaagaggaagttccgcagggaacatcccacaggcagatgctgaggggagggagagggagccaggagggcatccacaaggaaaggggagccctagcaagctcaggctagaataggggcttgtcccactggctgggcaaaaggccaagggataacaggggtggacactgtaagactgctggcccaccttcctggatggtcatttactgagattttcctggtttttctgttgtagcttttaagtatctagtgaaatgttgttggacatttagaaagtttccttttttttttttttttttgagatggagtctcactctgttgcccaggtgggagtgcagaggcacaatctcggctcactgcaacctctgcctcccgggttcaatcaattctcctgcctcagcctcctgagtagctaggattagaggtgcacggtgccgcgcctggctaattaatttttgtattttcagtagagacagggtttcaccatgttggccaggttggtctcgatctctggacctcgtgatccacccgcctcagcctcccataagtgctgggattacaggcatgagccaccgcacccggcctggtgcctgttttccaaaagttaacatgtggctaagtcacctggggacttggttcaaatgcagattcagattccataggtctggggtggggccaagagacctggccttcctgagactgaagccataatgcagtctgttggtgtaggattttatctttgccacgttaaactctttgcataattttgatatcttaacccacaatgatcagagattttaaacatttaatatttatattttacttccttggctgcaaatcagcacttccaaactctacatgtcaaagcccacatgaccactagtggtcgtcatggcttgtggtggtcacggcttgtgggggtcacagcttgtggctgtagtggctgctgcggcatcactgccaccctgggggcagccagggtcagtcatggacagggcacagctgccccagacccatccgcttggctcagtcttttactagcaagccgtgtccctttgcgagtggtaggtggcctgcagggatcagtaggaggctgtacgcttgattggtgaatctccccacaattttaatttgaggcaaagagccaaaccttgtcaatgctgagtccttccttcccctccccagctggacctactcgatcccttcagtttcttggattctgcccgacattcacctgctttgggtgttctgtttccctcaaataacaaggactccttatctgtgcagcactcaagatcacagtcacctttcacagcgtggacagagttcacgagtcaaaatacaggacactcaattcaactgcagttgcgtgggacatacttacagttacactaagaaaacatccatcgttgatctgaaattctgatgtaagggagagtcctgtaccttccatggcctccctacagcaaggtcagcctaagtgggcaggtgtgagcctgccgagctctccaccatggctccctcttcagggagttccttcctggcctcgccagcctgtggtgcagtatgcgtgaggcagaactcaaccctcctcattcgagagaacttcccattccttctctccgactgctctctgtcattggaacagtcttaacagtagtgagatgatatgagggtttttatccccacatgagaaactcaagaactgctggtgtgacccttttcagaaggctagagctgcccttccaaaggggagcttcttgctctaattgtagctgcagcgttcagcatcgccttctggtacccaggctctggccccacaggcaggggccccgctggcacctccatatcagacacagatcacgcctgctttccctcccagatgcagcaattttgatcccgcaggaacctctgagcccagggtacccccacaaacgcttcattccctcagtctcagggatgtgcgcgacagtgggggcaatagtgacccatgcaggccatgtcactgctctgagcctcagtctcccgtctgtaaaatggtaggcaggcagtcgggccacagcttattctgtagctgagccttgaggctgagaaatgaaacctgcatcttaaagaatgctacgttctttcttccccgactcatctctgcactataaagtttaatgttaataacatgatgactaagtcacggatcatgtcctgtagggaaaatgaattggagtatgacgccaaaagccctatgccaggtacttactagccattatttatctaagcagcctttggaaatcaagattatctccaccattttgccaatgaaaaaactgaagttcaacaagactgcttttgaaggttatgaagaaaacccagactttcctgcctacactgggtgcggtggctcaagcctataatcccagcactttgggaggccgaggtgggtggattgcctgagctcaggagttcaagaccagcctgagcaatacggtaaaaccccgtctctactaaaatacaaaaaattagccaggcatggtagtggtgtgcacctgtagtcccagctacttgggaggctgaggcaggagaattgcttgaactgggaggcagaggttgcagtgagctgagatcacaccactgcactccaacctgggcaacagagtgagactctgtctccaaaaacaaacaaataaaaaaagcctttcctgcctaaagtccacgttccttccagtacccgcactgtttgtctagaagccagtttctagcacgagacccgggaacagctcagcacgatgtccggtcacagcacttgacacttgagctaggcggtgggagcagaggtcggatgtccgagatctgctggggctgaactgaacacctgttgaatcatgcttgtctagtaacagcaaagtcaccagaatgcagagaatgagcatccatcactttgcaggttcggaggacccggcatgtgacgggcagcagtactcttcctgctctgcaaaagagcccctacatgtggcatttaagggctttctgccccctcctctgcccaggcttgctatcacgtctcctgggtctcctgggatctagtctagaacattccagggggcactgcccaccttccctaaaagctgtgggatcttatgctgaagcctctgcctgctaattgactccggcttttccttctatccctcatgagaaccatgggccagggctgaggctgaacacatggaattgggcacgggtccccatcgagagctccagaaagcccaggctgcatcttgctcagcctggctggacgcagaaggtgtgtttgttcttaagatatcctaatacataacaagcaatgtgctcttcacagaaacagctgcagtgaaaaaaaaaaaagatcacacagcactagagcccatcttgggaggtgacctcaggtctcacacctcagtatctccagatccccaatgctaaatgtaccccatcagggcgtttgagactttccatcaaggagaatttagctatataaatttaacattatagatttaactacacaaaacagagaagtcagctgtttgtctaagctttcaatgacagatattttaattgtggaatttttaaagcaaacaaagcaatggaaacttcatttttattctagaccagtctatcccagacatgctgattatggttggctgtgctgagtcctcatttaccgtatgaaatgcaaatgtctgtcaattgcaatgcctggggccaagccaggccagtggacttgtgtgcagttcccaccggagccaggagctgctcagacagcagacccagcccagtccactgggttttgcaaacacaggctccctctgcagcagcatgggcttgtggaagggaggcatgccgccgccagcatgcatgccaggggtccggggttctccccgtgtctgcagaggtgaggggtacaaagtgagctggaaacaaaacactgtgttcccccttggccttgaagaagtgcctcaaccaactcctcgccagctgcagagtactcaatctcctcacagaaagaatgtgtacaaaaaaactagaagcttttctttttcccaaatggctgttgaatttatttgcttgatcaataatggtcctggcaaaaattagttaaccaatgctgagacatttgtaatgaaatactaattttaaaaatccatgacaccttgatagaaattagagtttacacaaacaaaaaaggaaccttcgatattgccagcagctataaagtgaacgtactgagaccgacaggacagcaagaaggcatttgcacatttatatctgacacccgaccatactttcagtcaccagaatatcttctctccagatttaaaaaaatagtatgctgatttctataacaaagctttttttcgtacaaaaatcaaataatggccaacgagtcacaacagtgcaataggtagaggattaaaaactgcatcaaacaggtgctgaaaataaatactacctaggagaaggaggtgagagccctcgtgtggggtttgttttcgaccccttgagtgtgtgtggggtttgtcttccgagccacgagcctggcctgtctcgcggtgctgttcactctgacagagtgcgcctgcagcacgttgcctccagggcccagcctcccagaagcctcagagcatcagagcatccgtctcatcggatggaccagaaacaagaaaatggggtggggtgaatcacagctatcattcaaaggaaaggaatttttttctattgctcaatcttgtcaattgggagtccaccagtaggttcactgagatgatatggataatttcaaacttttgtt

SEQ ID NO: 1979 - DNA, 3857 bp, Homo sapiens
ctcctccccgccgcccctcccgcgcgcgtccaccggctccccggctcgcgccgctccatgtagccccggctccccgggcggccgcggaggagggggcgaccacaagatggcggacctctcgctgcttcaggaggacctgcaggaggacgcagacggatccctggactttgtctcacaagatgaaatgttgacgcccctggggagattggacaagtatgctgcaagtgagaacatatttaacagacaaatggtggcccggagtttgctcgataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttgatgtggagaccaaagtgtgccctgtcctcatagagctgacagccccagatagcaatgatgatgtgaaaacagaagctgtggctataatgtgcaaaatggctcccatggttgggaaggatattacagagcgtcttatcctccctaggttttgtgagatgtgctgcgattgcagaatgtttcacgttcgaaaggtctgtgctgccaattttggagatatttgcagtgtagttggccagcaagctactgaagaaatgttgctgcccagatttttccagctttgttctgataatgtatggggagtccgaaaggcttgtgctgaatgcttcatggcggtttcatgtgcaacatgtcaagaaatccgacggaccaaattatcagcactttttattaatttgatcagtgatccttcacgttgggttcgccaagcagcttttcagtctctgggacctttcatatctacttttgctaatccatctagctcaggccagtattttaaagaagaaagcaaaagttcagaagagatgtcagtagaaaacaaaaataggaccagagatcaagaagccccagaggatgtacaagtcaggccagaggatactccttcagatctcagtgttagtaattccagtgtcatactggaaaacacgatggaagaccatgctgctgaggcatccgggaagcctctaggtgaaattagtgttccactggacagctctttactttgtactttgtcctcagaatctcaccaggaagcagctagtaatgagaatgataaaaaacctggtaactacaaatctatgttacgaccagaggttggcaccacttcacaagattcagctctcttagatcaggaattgtataactccttccatttctggaggactcctcttcctgaaatagatctagacatagagcttgaacagaactctgggggaaaacccagcccagagggaccagaggaagaatctgagggccctgtgcccagttctccaaacatcaccatggccaccagaaaggaactggaagaaatgatagaaaatctagagccccacattgatgatccagatgttaaagcacaagtggaagtgctgtccgctgcactacgtgcttccagcctggatgcacatgaagagaccatcagtatagaaaagagaagtgatttgcaagatgaactggatataaatgagctaccaaattgtaaaataaatcaagaagattctgtgcctttaatcagcgatgctgttgagaatatggactccactcttcactatattcacagcgattcagacttgagcaacaatagcagttttagccctgatgaggaaaggagaactaaagtacaagatgttgtacctcaggcgttgttagatcagtatttatctatgactgacccttctcgtgcacagacggttgacactgaaattgctaagcactgtgcatatagcctccctggtgtggccttgacactcggaagacagaattggcactgcctgagagagacgtatgagactctggcctcagacatgcagtggaaagttcgacgaactctagcattctccatccacgagcttgcagttattcttggagatcaattgacagctgcagatctggttccaatttttaatggatttttaaaagacctcgatgaagtcaggataggtgttcttaaacacttgcatgattttctgaagcttcttcatattgacaaaagaagagaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgcagacaaagtttcttctgttcgttggatttcctacaagttggtcagcgagatggtgaagaagctgcacgcggcaacaccaccaacgttcggagtggacctcatcaatgagcttgtggagaactttggcagatgtcccaagtggtctggtcggcaagcctttgtctttgtctgccagactgtcattgaggatgactgccttcccatggaccagtttgctgtgcatctcatgccgcatctgctaaccttagcaaatgacagggttcctaacgtgcgagtgctgcttgcaaagacattaagacaaactctactagaaaaagactatttcttggcctctgccagctgccaccaggaggctgtggagcagaccatcatggctcttcagatggaccgtgacagcgatgtcaagtattttgcaagcatccaccctgccagtaccaaaatctccgaagatgccatgagcacagcgtcctcaacctactagaaggcttgaatctcggtgtctttcctgcttccatgagagccgaggttcagtgggcattcgccacgcatgtgacctgggatagctttcgggggaggagagaccttcctctcctgcggacttcattgcaggtgcaagttgcctacacccaataccagggatttcaagagtcaagagaaagtacagtaaacactattatcttatcttgactttaaggggaaataatttctcagaggattataattgtcaccgaagccttaaatccttctgtcttcctgactgaatgaaacttgaattggcagagcattttccttatggaagggatgagattcccagagacctgcattgctttctcctggttttatttaacaatcgacaaatgaaattcttacagcctgaaggcagacgtgtgcccagatgtgaaagagaccttcagtatcagccctaactcttctctcccaggaaggacttgctgggctctgtggccagctgtccagcccagccctgtgtgtgaatcgtttgtgacgtgtgcaaatgggaaaggaggggtttttacatctcctaaaggacctgatgccaacacaagtaggattgacttaaactcttaagcgcagcatattgctgtacacatttacagaatggttgctgagtgtctgtgtctgattttttcatgctggtcatgacctgaaggaaatttattagacgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttgtccaaataaaatttattaataagatctatagagagagatatatacacttttgattgttttctagatgtctaccaataaatgcaatttgtgacctgtattaa

SEQ ID NO: 1980 - protein, 933 aa, Homo sapiens
MADLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDSVPLISDAVENMDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVSEMVKKLHAATPPTFGVDLINELVENFGRCPKWSGRQAFVFVCQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTY

SEQ ID NO: 1981 - DNA, 104514 bp, Mus musculus
  misc_feature (1)...(104514): n = A,T,C or G
tccgcggaggctctgatttgctgtctttgttggagagagggacagactcctgagaggaaaggaacagagggaggaggtaaggtctcaggtgaggtggggatatctctctcatacttccatttatttccccactttatgttgggtggagacagttgcatgctgggaacgaaggcaggctcttcatcagaatggttttcacatgcctgggttggatttggtgtttgctttgttttactagtctgcagtgctgggcttagggtgaagaagaggaggaagaggaggagaaggggatgggacggaggtgtgtgcaccagggacccacttctccagcacaactgaggtgctgttagtgcttaggagctatgagaacaacgtgagctaatccacatatagacggtcgccaggacggagcaaaagaaatacacacagttgcacatcttcctgtgggtctgcgcaatgcttccagaacattccaggagatggttgtttcctgctgtctctgtaggaatcctatcattacgagttttggtcccatcctgcgtccccattgtgggaatgttgggatgttcttatgtctcagcacacatgcgtgacaaaccccagacacacgaacgatatgccaaggatggcgctaaacaccgctacagcttttcagactttccaaactgtgcctcagcaagctggtatcaatttactaaaagtttccacggattcagccccaatagcatcatctcctcatggctgccactttgatgggcgagcatggcatcttgttgctctcatttcttttttcttggatatttggtgagactgacaatttttcacacacttgatgtccctaggtaggtctttcataaactgccagtctgtatccttggcccagaacttatttatcattgttattgatttgcaaaagctctttatatagcaaagacagcagccctctaaagcagagaccctaatggtatcttctctggcttgttgcttcttttttatggtattttattttatctgtgtgtgtgtgtgtgtgtgtgtgtgtgtgacatgcatgtaagcatgcacccatatatatctatgaacaggtcagaagagggtaccagtgacttccttcagtgtttcctgccatattgccttgacccagggatccgtttgtctccatcctccaattctgaggttacaaacacacactgacaattttttccgtgggtgctagggattcaaactcaggacctcatggttgccggacaagcactcctcctcctgagagagctccctggactcccactttctctgccttatttctgctgggctttctccttcatgacttactctgtccctctgaggttcacttggtcaccaggcagagggcccccttgtcatcagccctgcccaccccaccagccctggccctctccagcttacagcctgaggcactttctttgatttgctacctaatgaaaagccctggttggaagtggctcatcaggttcttccagaattccaaaatgaccccaacccaataggctcctacccctgctggctggggtcacaggtcacaggtcatcacgccccagtgacccccaaatagggatgactccagccccctggtgataacagttgatgccagggactggtttggctgctggtgggagcgtgggttaccacatagcactggaagacagtgaactcagccgagtgtgcgagtgggcgtggagcctgtctgacacagagctgccgagctctgcctggcctgaggctcccatactctgaggtgctgtgtttttccttcagagatgagcacagcatgactttccttagggacatgaaaccaagattgcacttagctagtaagctgtgacacctgctccactcactcagagccattctctgtgctgagtttgtttgatgataccagaaaaccactctgtgacatcagcagcctctgtgcacctggggtgagagtccagcagcacaggatggatgggagagctgttaagagagagcaggaagggagctggagaggggatccgggggcatgctgtgaaaagcaccggctgctctttcaaaagacctaagttcggttcccagagcccaaaaacccagtttacaggcatctgttgcatgggctccaagaatggaatttcctcttctagcctctgagggcaacacacacacaggcacacagacacatagacacagacacacacatacacacatactcacacagagacacagacacacacacaggcgcgcacacacacagacacacacacaccatttttttctttcgtgtatatgaatgcttgtctcagtctctataacatgggtgcaatacccacagaagccagaagagggcgtcatatccctggagcaatagttatagccaggtctgagcctcctgagatgggtgctgggaaccagactcaagccctttgcaagagaacacatactcttaactgctgagccaactgtagccctgcaagccattaaagataaaaataatcaagcccaggtgcctccagcatccaagctctgtgacctcatggaatccactttgcaactctgggcctttgtctcttcatctccagggtgaggctaccattgcccactgcctgcctctgcgtgggaaccaaatggtgtaggaccactttctcctacatacatggctgtggtctctcctgccccaccccccactccaccccttcccgccagccagcagggtcttgatggagagagaagtctatttcaggcttttggtcctggtttccgaaccacagccacggtgggggcggggtgcagggagccgacagccaccgtggtggaaggagcctctgcccgggcactttttgatctgctctaactgccgctatagaaaattagatagaattcatttctgtgatgaaggaattaatgggtatggagagaatcgagttcgggaggaaggcttgaatccaaggaagggaataaaggcttgaaattcaaatgaaaaattacgatataagcataaaggaaccctattttacacctgtaagaccaaatgtataaatatgaaccaacggctccctctgggagacggggattgtgcttctaattcacctagacaaataaggcatgcatcccttccacccacacattccaatgaaggctgggcaccaggcggccccagaggcccaggctggctgcctccttcctctgctgggcacctgcaagtcaggtcggagcctccagaaactacaaaggctttgggcaaggtcatccatccccagccttcccaggtcttcaagtcccctactccctccatgcctccagagcatacaatcctttgccatcaggatgcatcagctaacttcctgcctgcctgccatctttcctgccttccttccttccttccttcactcattggagtgtccactccaggcctgatattgggtatcagtgaaggggaaaccgattctttttggaatcaaagaaatctaagttaagaatcctttcctaccataaccttgagtcagaacttagcctactcctcactggagaatgcccagggcaggaacaggtatatccagaggtctaggacaactccgaatctttctgcttggctctcgattgagcatcctttgttctataggtcacatagctcaagcatggtggtagaagatgggcccaatacccaactgccaggcaggggagggggggaggcaggcaaggggaggcagcaagaaggaggcagcatgtattgagtgccagctataggcagggcaccaggctccaacccaaccaccaaactcagaactgactggtaagctgtgtccccgcttcaccatgcacagaaggcctcgtaccttcctgctgctccaccttggatcctggctgcagagaatgtgggaaggctcagagcaaatcactgacccctcggctctttcttgaacccagatagcctgcctgtgagagcaccattcgttcactcagtgaggatgcactaagcatctatgatcgcagttggaagatggcaatccacagaacaatgccttccgtctgatagagcttccaaggcctttgctccagctgacaggagtggagagactgcctccctctccaatgaaccaattctgaaacaggagggaagcaggaactccagaggccaaaggagcccaattccataggctcccccttggcaactggccaatctgtggtggagaacaggaagcgtttgatcttttcattccccattcttggtcttcctggtgccccctaaaaagcctggggggctgagggaaagtttccctgggcttgaggccttccctggctcacagctcacagccccaggctgcaggtcagactacaccgggctcactgccccctttggtttgtttaatgaaaacactttgagagcgccatagatgctcggccctgataaggtaattgtccaagggcaaggtctacaaaccattaacacccagacttggtgcaaattgaacttgggggagggacctaaaggggtcagagccagcagcctggtgccatctgacacttgctcttttgtcctggctactgggagcccagagaagtcacttgtgcaccaatgcagactgtgctcacaggctctttgtacatgtgtgcacacacaggctcccaaccacacacagtgattgtgcatacaaagtcaccaaccccactcagctgggggggggggctcccactcctggctctttccctctccaggagtcaaagggaaagagaggagacatgaccaaagaaaggatattcccagatcctagtgacagccttggctgtatccctaaagaccaaggggaaagcagagggcaggaggggttcatctggacaaggaggaggaagccagggccagccatcttcaatgtcaaggataactggtgccatcctggcacctcctggctccctcccccggcttcatctgccctgcctttcatttctagaatcttaggaggtgcagactctgagaaccggcctgagggaaaggcagaagaggaagaaacagagaagggaggagaggcagtggagagcagaggagaggagacagaggagggagggaaaagctctgggagcaggagcgggacctgtggagaggaagtgaggtggcagggtggaagagaagggggagagggagggaaagggggagagagggaaatgagaaaaggggaaaaagaggtggctagaaagccagccgaggagccctcagaccctacctcaaggcatctggctctcagtgtgtggttctcagctagagaacagcaatctctatgcaaattaattttattggagggggcattaaaatgtaagttacaagaacaattgggcttcctggtcctccttgggcaggcacttcactgtatcgccccccccccctgcaaaggacctagtccctaaaagatcctttccagttctgcaccagactctcacctgggggcctcaggaactttgggggctttgttccaggctactctctgcctgtccccttcccacacccacgctctggtctcctcccaacacaggcattccaggtggtggctctggcccagcagaggctcaggaaatatcaaaggccccaaatcaaagccccgttttttttttcttcagggtgtctttagcaccctgtaaagaaagatgctgcagtgggtatcactttctgaaaatgctcactgtatctgagctgaagtaaacagtatctacttctgagagagagagagagagagagagagagagagacagagagagagagagacagagagagacagagagagacagagagagacagagagagacagagagaggcagagagagagagagagagtaagagagtaagagagagcgagcgcatgagcactggggtaccagcagtggacactggctgggggtccaggcctcagctggctgaactctcatgctttctatctgtcctgttcagatctgagcagccagggccaccgtcccccagttgtaccccatcccttcaaacagtccagactgcccccctccccatttctttcttccctgcttaatgcactgtggagggctctgctaggaacatgaaaggaagaccggtgctgttgttgcagctctttaaaagagggagagtttgtgtgcagagattccagacgaggctgggagaggtagactaaggagacagctgcccaagagggacagcactggaacacaagtggcggagggagtgggagcaagggggatgccctataccttgagaccaaagagaaggagggaagagaaaagatgatggaggggagtggaaggagagacaaggagaagggaaagaaaagggggaggggaaatgggggagggaaaaggaggcaggagattggggaggaggggaagaaggaaggtaggaagaaggagaaagaggagtaagaaaaaagaacaagagaatgagggaagaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgggggaggtagggaaagagagagagagagagagagagagagagagagagagagagagagagagagagagagagagccggcagggcaagcactggctggagctcacagctggaactggagccctgagaacctctgaggcactggaggccttgggagttgattgatgacttgggagggggtaccctgggacatgggggctagccagggggaccggccaagcaggagagtttctcccctaccccagctgcaaccacccatccccaggtgaacccccctttcccctgctggatgtgaaatcgccatttcacccctccacacttcttaattgttgcaaaaatcatttgtgaaattgctctccaacaggcgagaatggccacgctcattctgacagacaagcccacttcctcccctctgctgtctgccctgcctaggctccagggatccccagcagctatgtgtcctgtgcagggcctgggtagtgagcctctgtgtcttccttcctggtggacagaacggaagatcatctcaaggatgctgtggtcaccaaggatgctaagggccccccagcaacaccctttctgtaccaaggttaccagctgggtgtctgccccacctccaacttcgctccagttacagggttggtatgaagaaactaggcctgacagcccaggtgccaggcacttccagaaggggagccagtcaaaatatgcatggctccccttctcaaactttgctttcagccatgctaagacagcattacaccctccccattgaggagcccacaattaatttacccaagattgacccaagacaggcctacacagacctcacctgcacataaaaacccaaatttgccagtgaagagctaccaaaccaccacacaaaggagagtcgctaaaagtctgccataccaggagggtgttggtgggggtagagggatggacagacgacagacagatggaagactgaaggagaacacattaaatatgtgtaccctatgtttacagaaagacatggatatatacatgcttgtatttaaaaaacaaaacaaaaccctggatatctacctcaggagtcaaagcagacaagggtccccaggaacttagcatttctcgcccccccccacaacctacagggcaaaaactctgtctccccacctggctggtaggtgtgactcaggccgcagagtctaaaaccacttggcctctctcctctccccattcaatcctgcaagcatatatttaacaagcttttccacaggtctcccatccccggaagcccacccccacccctgccccacaaagaagtctgatgaacccctcagctaggagaaagggtcagtagcatgctgagaggggcaaaggtcacaggtgaggaggaggggaagggagaggacacactgaggccagccagcagagagcacccccaggccaagaccagactgaccccctccaagaaggctgggcagggcatgagctggaggactggatttattttattgtatttcacctccagggctgggccagagaggtcctttactggagtgttggagatgtatggggggggggggcacaaaagatctgtaatgggtggcatcctaccctgctgggagggcttttcaaccctaggaatctatgtcctaaggcagagaccactggttactgtggcatcagagaacagaattgtgggatctctgagagagagagagagagagagagcacgcaactaattgggccaccacctccccagccctccagtggaggagtagagttggtggtacccagctttatctgtctgtctcccactcatctcccatctgactcccagatccctagccttgctgatgtcgcctccaggacattctgagtccactagaaagggctcctaggtggtggcctaggagctggaggaggagctggaggagtagctggagaggttattccccagggtttggcagactcagtttgccagcatctctggggatgtatattttgctgcgtttctccgagctgcaggaggccaggccaggccaggcgcaagcagtaaagccctgacaggtatcagcgaagtcaaaattcttccggggatgtcaccctactctgttccgcccagggagggagtagttgtcaaggaatgttcagagctagtgaactaaaaagagaagggacacgtgcggtggaccctagtccaggaggccagagatagccggagcggacagagaagatcccagcccaaggccggctttcctacacagcgggcagacagctgaaagccgtccggagcacagacctgccagcacatctctggacaacacttaaaagaagttaccctctccctccctcagagcacccccagcccacgccatccctggactcagagtttcaaattatctccctcccccgcgaccccctgaggaaaaaaagaaagaaagaaaaagaaaaaaaaaaaaaacgaggtcgagttggagattaaaaaggaaggggaaaaaatactcgttggagacttcttttcgttatcggtcccctctccctcccgaactggccccctttcctgctcatgaataaaagaaaagtccgaacctatcagatctctctggctgcagcctgctccctccccttccctgccgttgagcacttttgcacaacttacccagctgatcgctcgcgccccctcgcttttcctcttgtgttccccaaccctgtcgctcgggtcacctcccctccagtccgaaacccgagcaggagcgcgtccccgttccagtcctccgggggacagggtgtgagggccagcagaaagaggcgctgagaggagggatcgaggggaggagggagtccgagccagagaataaatatataaataaagacccaaagaaagccactccgcaacctctgggctcaggaacttcggccgggagcgcgggagcgggtggcccgcaaggcgcagctggggacagggagcccggcctgctcggcccacggcagccggtgtcattcggcttaacttctggccgagcccggcgggtggaggcggacttggggttggagtgtttgtttgtttgaacttccttgtcgccaccttccactcctcccgcccccacctcacccccccccgcgcccagcttctggaaggggcgcgtctgcaaccgggtgggggggggtgcagaagggagggggaagaggctagtgggggggggagggaagaagaggagaggaggatcgcagcaggggtgaaaggaagagacgccaagaggtttatccagccgactctggattcgtctccagcgtgcgcaggaatggcggcgctgcccggcgcggtccccaggatgatgagacccggcccggggcagaactacccgcgcaccggcttccccctggaaggtaagagagcgcgcaggaggcctttacagggtcccccggaggacctcggagatggcaccctccaggggagcgagcagcggggcttcctgggctctgctgggtcccagtctccgcgtgcgacccgggaagtttctagagcggacacttgtcagtttctgcgtggactccgctgaccctcggcccgcgctccgtgggtcaccggctgccggcctttcgccgcaggatgcgactccccggggaattcgcatctggtccgttttgcgctcgggtaaattccagggtttcccactcttctctgacacaacagagttcccgggtctctgcgcagcgccgccggctttcttccctagttttgaattggtccctcaaagtcgggatggggtccctccaaccccttttatttcgaaataccaacaagcgacactctatttccactccaccagaccgtccgcttcctcccaagcaacttactaactggcttttttttttcccggccccgacacaaactaattaaaaacaatgcatagtgccttatttcccgcaaaaacaaaaacaaaaaaattaaaaacataacttttccctacgtctttctaaagtctgcaaatgtcccgggaaagaaactcaagaccaaaagagggtacagcaatccaggggactgttttgagtctctagccactcggggatgcagaggggaccggccggcggcgatcggccgggagaggagaaagggcccctttgcgcgccccctcccttttctatttaaacctatggaaggctttcagccagtcaccgaagggtcttctagtttcctcggctcagacagcccatggtgtctcaggagcagttagaaacggcgtgccaattttattttttagccgcccctcttgtcattgtgtgggccccacttgtgggtgcgggaggatggggagagaaggcgagaaggggcggtctggcagccggcgatctagggagggagccccctccctcgggcagcgagaagccgccgggtccccgaattagacagaggcgaagagagcgggctgcgtgatcaagtgcgcgcgagcggccacgcaggcgggagagcgcggcagccggggatttgccggagtcctctcctggaacgaatgcaagcaaaacaggcggctaaggacgcgcaaaggattaggacaatatttgcccaacatgacgcagaatactgaggagagccgagtgccggtcgctaaagaggctcttgaatataaagttgggcgttcgagagctctccagcgctaatggcgtaccccgccacggagaccgagggactctggctcggcgacgcacgatttctgattaaatctgagagtggtttcagatacctacttttacaaagaaaaattggtgaaggaggggggagcgggaaagtaaagagggggcggtaggaacagctcagcagaccgagcctcttctagcctccccctttccaattattccgtctgcttcctccgctcgggccgctgtgaaatcgttgtaatcttctagatctctgtagccgcgagtccccaaattggggggatcgaggctggattagtgcaccgggtgtcccccgaaccttctgtaagaaaattgtgtagactttgcattaaggcctacctaagttctcccttccccagaacacactaggtatgcctatcttcctgatgcacgcgcgcgcgcgtgcacaaacacacacacacacacacacacacacacacacacacacacaagtggcccatcttagttgcagcaaagactgctgggacaattactgcatttctgagaccaagttggggtattttggagcttgtgatcatcgtggagtgtgccttcgatttgcccccccccccaacgaaatgagaacttaaagggtgttttaaaaagcctgggaatctgctaagggacggtttgtgttcccagacgctacacagacagctttatatccccagtccttaagctgtgcagactcccgctgccacaatcctgggtgctcaagccagagctagaaatgttgggagtcaaatagcctcttaacctaactgatccaatagttcagtcctaatggccagaggtgtaggactgacctggtgggccacatcgccctggctgtcagcctctaccagaggcaacaaacaggcctgtgacccccaagctagcggcccagaaccatttgcagctgctcttaggatctctagtctccactaggttccactctgtccttcctgccatttacatcacccaaaggtgtatcctcatttcctgcagtgtagagggactttgggggggggggacaaacaatccaagtcccagaagccaggactctttctccttgtaagagcctcccagggcttcaagtagaccttggagatcagctgttaggagtcttgggttctcctcccccacactaactgcattctgtcctgtactcactattttccctccctccccacagtgtccacccctcttggccaaggccgggtcaatcagcttggtggggtcttcatcaacggtcgacccctgccgaaccacatccgtcacaagatagtggaaatggcccaccatggcatccggccctgcgtcatctcccgtcagctccgtgtttcccatggttgtgtctccaagattctgtgccgatatcaggagactgggtccatccggcccggggctatcggaggcagcaagcccagagtgagtgtctttgcctctaaggctggcagcaggccttctctagtacacagaccttgattgtcacctctctcaatatcccgtgtcacctagcagccctagttgtctggaagcttcccacggaagcttttccttagctctgagatacagtccctattatttgaaaatttgaaggatcggttagctgagctctagattgtctaagactttgaagcttcactggaatgtccctacatctgcatctccaccttagccacctttggcattgcctgagatgatggggggccggtggaggaaccacagggttacggattgtattttattttatttcttattgctgcccccactgatgtcattctgggaaccttgaaaacccaaaacccatcttaggaggaagggagtggccaccggagaggccagcctggctggaagcttttgggaggttgatactaaaactattttccttctcccatcccatctctctgtccctgctctcccacctccacctctgaagcaggtggcgactccggatgtggagaaaaagattgaggagtataagagagagaaccccgggatgttcagctgggaaatccgggaccggctgctgaaggacggtcactgcgaccgaagcacggtgccctcaggtgagaaggtagctgagccagtggtggagctggccaggcgcctcgatggagattcagagggtaggcctgggggtggggtgtggatagagaaaagggatgagagggtgacaggcatctgggggatacaggcttatcagtgaagcaaaatccagaaggatggaagggagaggggaagagaaagttggaaagggagaggttcggaagaaggaacagaggtgggaagaaaaggagagaggaagggaggtgggggatgctaaggaagttaaccttgaaggtgaggttctcttgagctttggggaaagtgatctcggttctcttgagctttggggaaagcgatctcaagaaagaaagacctgccccaggagagctggtgcacctgggctcccatccccttagtctgaatcgaggtcttcagaccacactgtggtggtggtggtggtggggaagctgccggatatgtgtctgactgtaccgttgtgtgcagcaggcatgcagggccagggcacacctgcctggctggagcaagggccgggcaacaccagggcagtaggcttgtggtgagtgtgtgtaggcacaaggtaggctcaggcacctggtgaaggtccaaggattcaaactgagaagcacttgggggctgcctacgcaggcttacctggacatacatgctccaggagtgagccgggtttctaaagctggaggaaatgcaagcctgaagggcttgggagctgagaatgggggttgtctgatttccgcccccccccaactcctcggccccaacaacttatactctcccttttgcctttcatttctgaggtttagtgagttcgattagccgagtgctcagaatcaagttcgggaagaaagaggacgacgaggaaggagacaagaaagaagaagatggcgagaagaaagccaaacacagcatcgatggcatcctgggcgacaaaggtaagaacctaccgtggcccgagacgccggagaccacgttttttccccacgcctctggtgagaactcgtgcggattaacccctgccacagctgggaaaaagtcgcagatcgccgagcggcccggggttttaaaggctttagggtgttcgggtcttttcctccccaccaccgcaagtcctaggagtgagactgccgggtagcacaatcctgtgcctcagctgtcaccccctttccccgaccccagcgcgcgcgcgcgcgcgcgcgcgcacacacacacacacacgcacgcacgcacgcacgggtccacagcctgtgcggcctctggagctggcattttggcgtcgatcaattatttatagaaaacttgggcaagcgtgcgggaggcagggaggagggcgaggaaggaggagcccgcccggggctccctaaatgaatttgttaaccagccccgcacacgctttctaaacggtcccttgaaaccccgcctgacagctgaccgaccgctgcaatcaataaaaattagccagagccgcacgggctgtctctcagtcccgcatggccagggaggagtgggggcacacgggtgctttcctcttggcaagcactatgtgtcagaggctggaggccaagttcccagatgccaagggtcgggggattcacccaacaccgctgtccaaccttaactaggcttctctgtgcggaatccagcgctcagctttctctttcaagtgcctgcaccccggcttggagaactgggatgggtttctgtttctggatggggaagtcttccttcgtcacccctcccgaggaatttttcttgtctatatgaaaatggggccctaaggggtggtgggaatgggtatgaagatttcagaatcccaaagactgaccccggagaagagggagcctggaacacacatgccagggaggcaaatgagtcagaaagacaagtaactccgcagaaagagcagggcggttactaaaaaccccttgtagtctgagaatacttccagagttttctgcagagtcccttctcagtacccccagtctaggtctctctctggttctctggtgtgcctcccaaccctgaagatgaacttcacagacaaagtcccacttctaaagacaacacccagagatggaggcccaccagcccagttcaacggaaaggattggggaatgagcaagcaagtggtaggctgttgatattcttgggaccccttctgaaaggactgctatcccttcagggacaaaagcacacacacacacacacacacacacacacacacacacacacacacagagagagagagaggagagagagagagagagagagagagagaacaggagctggtatcccactgtgccaggcctgccagaggggcctaggctctgccacaggagatagcctctggccgctgccttggccattatgcccagagccctgggactccttcctggaaacccaggatttatctcagtttatcagaaagacaaattagtcttttttttaaaaaaaaaatattagagtatactggtagatcctaattttgaataatctttctaaggtacatgctacacaccaaacacctctaagaggaagcagttgggatatttgagtttgtttagagattgcttgcaccgtgtgtaccaagggggatgtgtcaaattcagtgtgtgatgaacggcaaaagtcagtggcttttgagaaaaagaagggaccaggaaaggggacaaaaagaggattgtgttttgggggaatccctctgccttggagaattcacaaaaccagtgagccagagtcttcgcaggagagaggttttccctgccagaaacccagtccgctcccagtctccagggctttagagaccaggactgccctgtccagatgagactagctgggaacacaggtgtggaatgtacaagactgtaagaatgaactggtttgaagggggctggtgtcctgactgatccctttgctgttggggtgtgagtggcactctgggacactggatggccttgtgagttcctgcatctttcaggtggctgtgggcctatccatgagcctttggatccgggagtttgcagcttgaccataggcaattgtggaggggcagtggcaattcaaataagggaagggtttgattgtgggtaggttttgggtgttcagcatgaaccctggcctgtgggttggcagacacgtggagatatctctctctctctctctctctctctctctctctctctctctctccccccccccttcctccttccctctctcggaccctagacatcagtttcacagtcaaattaaagctgaaaagctccatccagccctcacccggggttgagtccagaacccgcccagatacccccccacgagtagaacaaggggaggggtacacactcacaactttgttttggcttcttgctttttgacaaatgctttctcccagggtcgcccttctcatggcggggagccaccaaagaggggtttaagagcgctcctctttaagcgctaaagagagatccctccctgggcccgtttcttcctatcgtccgcttggcatttaataatgttaagacttattagagctggtaatgaaaactgaggctgctgaataggaagctatgttggagaggggtgtaatagcttccaggcatggtaagaaactatttatccccaatcagtcttcactctcagagtttgaagcacaaacgttaagttgaagggttttaaagcagattaaattgagcttttatttctccgcactttcatctctgaacggctcactcctgcttcccttgggctgatattcatgagactgtgggcttttttttttcttcctctttccctcttatcctagttaaggctgagttattaggattgctgcttgtgagaattctcaggactgctgccgatagggctgtggccaagctcagcttacctgaggaaggaagggggtagtttgcacctttggtggggagaccctctcctcttcatccctctccccaggagtcaggggatgggtagagctggactgctatagatctgaacagagaaagtcgcgaaagagatttcccacagacactgataagggagtgcaaagaaaggtagggtggttcttctgtagtcacagagatgggcagggtggagagagggatgcacagtgacaataggtacagcaacacctgccccatagccaaagcctcaggcatctgactgcgcatttaagttgaagctgccgctgaacccatcagacacaggactggttggtccctcgggtacaaagcttagtgggttataattaatatgaaacagttaaaaagttaccaggagggatgagaagttctttttctgtgtagccaggaatacctatgggtgtcggagtcctgtgcaagaagagagctcaggggtgagaaaggctgtcagaaaggctgtggagggctacgcagaagaagaaaaggacggggttaggacttcagttttccttagagagaattgaaccagagtctggctcaggccaagcaagtagtctcccccactgagctacaacagctcgggccctaggtttgttttctttgcattttccccttaatttatttgaagaaaggtaaacttacaggtgtggagtggaataccaacggggaaggaccagagaagggggggggagcccgaagtgtcggttttagacacttgtaaacggaggtgggaaacaatttaatttggcagcggcgatggctgctaatgcggttttcggtcgtttgccgcaccggaggaagctgttttgattgtgtgtacaaggacctgccaaatttaattaggctccgggggagcgaatgaataggggaaggggggcagggctcctcacagcccgcactctttcttcgtggccccccctccctggagacttcacacctggaagggtcaatgtttgggggggggcataggtaagaagagacctgggtggggccttggagaagagggctgggccgagagggtaccatgagcgtccatttatcaggaggagatctgcattgatttaaacctacaacttccctcctctgtaaatgtgtgtttagagaaaggtaattgacactccaccaaatcaaaggattaccccgggttggcaatctaatcaaacacagtccaggcaggatttgagtctgttcagaggaggatcagcttcgcataatgggggctccgaggaagatagggggtgtcaggcaattcctcggctttaggcagcgctccgctttggatgtggaaggaacagagcgagagtaggagggggcctgggaggcccccactgtccagtgggggatggtacgcggaaggtcccggggggagggagctcctagcgagggggcgagcccacactgagctgacaaggcgccctcccccgccccccttcgccccccagtcctccggaacccaagacaagagtgaggaggagggatctgagactaagcgacactacaatgaggcgataactgttacaaaggcgaacacgcgctcgcacgatcgcagccccgcatcccggggtaaataaagtctgcaaacggcgcttcagataaacgggtgcctaaatctagtgtgacgggctagaagagaagagacagaaggagataaggttggggaggggcgatgaaggagcgtaatctaatagaagacattcagaaaacaaactttataaaggggagaatcagcgagtgcggagcgcggaagacgtgcaggcccttgcgggccgtggggcctgaatgctggggatgccgccgggatagtggggatgcagaagccgggccccggggggcgtgcaagggagagaagccggggcgtacaggagttgctggagactagcaagtggagtcccctgctgagcgaacgcgcgctctctgtgttcacctccgggcacgcacccgccgcgccagggccgtttcaaggcgtctgtacctaaaagattcgcgtgcaccgagtggcagttaagggaattagatatttaccagtttgaaataagcctgactaagaagaagggagaagagagagggacacacacacacacacacacacacacacacattgaaaagatgaggctggggaaagacttcaaacgaattcatcatttggaacggtgaagggagatttaccagacagtattgggaagttatttagatattaataacacattttcctgaggcgcgaccacggcagccgtctgcgctgctctccgagctatttggctgggtaaaatatgggcgtctcaaatgttgggaggcgataaggcaatcgggccaaccccggtcctgaatctgcaacgcaggggcgttaaacccggattaacctcccccacccgccccctccccttccacagctttccaaattttttgagtggaatttacatggaagggttttaaagcacacataacagtagccacgaggcatcgaggtgcttttttgagacttttacttttattaaggagcctttttttttcttcctgaaaacagttgttacacattacgttgcatatcaatactacatactgcacagagagggctcactcagcaaaggatgctctttgtaaagttgaggccttcggttagtctatggccatagaccaagttaaggcgacctctccgtccgcagccccatttggggtatacaaggatataaacacataaactgacagcctcgagacagcttgagaagagggctctagctttgaaaccccaaagggaagtttctctctggggcttcgaaggcctgactggagggggggttgcattccgggaattcctgaaaaatagccgcatcccctcccactccactaatggggtaattaggaagcccagttggggaccctgggtgattggaagacgggatgccccctaagtttctgttaccctgggccctccctctctttttccatacccctaactcccgctgaccatggggagggggtggaaatggggtcaacactttctgaccctctcggttgggactggccccactggggtcaggccgcgggagggaggaaactcgccttcccaaatctaatcaaggcagaacgcgacctaagggggaagcagcgccatttgtagctagatctctccataacttcaaacaaagtggggccggggaggggcgagaccgggattccaagggggaaagagcttaggggaggaggggggcactcaacatgagaagaggaggggccagcaggaggaagagaaggggtcgagggcaaaggggaggtgggggccaaacgaaaggatgtggggagagagatgtgaaggccgggtcaacaacttaagccagggaggagaggagaaacgtccggcagaccccagcaccctcgggaggggtgaggggcaattgtgtgagccccaaatccagtttccaagcgccccagagcgcgtgtttagtcctttggtgcaggagctgagttgagctctggtgggtttccagggaccaggaggccgccgcaggtctcttaaagtccagggctaccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccagccgcttaattagaggcgagcgcgccgagcgggtggggcggggacccgggcggcgcgctgtgacccagcgctgggcctcggccagcggcgcagcggagtgcgatcctccccgcctccagccgggtgcgaggttcgcgccttccccgcttagctgtcccagggctaagttcttgggtctgagagtcctcagctccaggttttgtcttcagagccaggggtatgggaagcggggaacattgaaaagcgagaccgctttgcacgagaaagcaaagtgctgcctccgttcttgttccatccgccggttctcctcggctgagtgttcgcgaccatccgccggcttgtactcctaggcccggcagctccgggtgaccgatgctggagcaccaaggctgggcagaacgcaccagtccccagcacattatgcttgcaacttgggacgcgtcgatgaatgtctctgcgcctcgattcccacggatagagatttacacaaaggttcccatccttggtatgggagtccagacccatttgaaagtcaggtacaagctaaataaaactaacaaaccaaagcccagctcttcttcgctggagcccataggcgcagaattttaaatattgtgcaaagaggtgcctctgcttcttgaggtaacaccctgctcagaaccccgcagctccgtttttgacaaccccagtattctcagaagggccccagcgtccctgagtggagctcagaatgaaggaatttaaatgaagggggagggtgggaagtgagcgctagctgtctggcctcactgcactcctcttcttcttcttcttcttcttcttcttcttcttcttcttcttcttcttcttcttcttcttcttcttcttttttcttcttcctcctcctcctcttctttccttcttttctgtctcctctctgtctctgtctctctgtctgtctctgtctctctgtctctgtctctgtctctctctgtctctctctgtctctctctctctctctctctctctctctcacacacacacacagtcaaaagatctgagaaacaagtagtttctaactagttttacttaaaaacagaggcatcctcccacttttgtaattggaagggccctttcccagacattaaaaaaattatttgtttgttcacttatttattagcttgtttattgtctggagttgagtactcatatgcgtattagaggacaacttgcgggagtcatttctcacttttcaccactgtgacaaacttaggccatcgggcttgaagtatttttactggctgagccttctcacaggtcccctcacagataagtacacgtgtgcctccccttctgtcctacaacactaaaggaaaaagagggtaggaaagagaaaaatcttcccgagaagtaattgtttgtgaatctctccattcgttctttagaacttctgttgagtgttatgtgttaagtggtgagcgcctaaattatatgccgggacaccaggacgctccccttctgtcgtcgtgaagttctggtctggtatctggaacagatgaaacagaccctctttcccagagtgcgtttgtgcacctggatctctgggagcaaggtgtgtatgggtatttgtgaatggtgtgtgtgtgtgtgtgtgtgagagagagagagagagagagagagagagagagagagagagagagagagagagagagagcgctcgcgctttcaggtcagcctgggagcacacagtggaactgccactgaaagttgcaagcagcccccaagctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagtctgttgacttagagaagtcaagagtcttgcacacacgcggggcaaaccccccaatacaacaacaacaaaaccaaacctggaacagccattccatagggcgagtgcccaggctgaccactgagggccttggacagtgagcctcaccactctaaactttggcttgctgggggacagaggggaaggtgacatccactgctctgccttcaggaggcccctcctttgtgagtctaggaagcagatgtatcctgaaatcacctgagcagtgttctccttggctgtcagaggccaccactctgatgctgaagtgggggcaaggggaacggaagcccgggaagactgtgggggaggacagaatggtagagcctgaaagagcctgctaactcagagtgagatttttttccgagactccatgcactcttgaccagtggtcggtgggctccgtatcagagggaagtgcaaaaggtgacactgtgcaaaaccagagcaaaccacaggctaggtaaatgtcaccctcagctgccccagcatccactaggggccttggcacatggtgtgactccacaactattccgtaaggtgagcgaggtggaggcaggccccgcacggatgcccatgcccttcccacctacaaccctgatccaggaaacacaataggctcaggggagctgcccagttgctaaagcagatgctgagagatgggtgggaagacctcagtagaggctggacaggactcttctctctctgcctctctcctctaacccagggcccccttgagacaggggacatgtggtccctgcatggctgcgccataatgtgcctgaatgcagctcctcccacctaagcttgtcatggtagaccttgctgggggaggtgcctcctggggccctggttgtaggctcctaaaaatggagctaaatacttcaacttagtgcttattattaggcagtggggagccatggaaaggattttggctgaggggtgatggacagagaggagaaagacagggacggttcagatgtcatcagtcatcatcgatgctgctgtgacccagaagctgggaaagatgagcgtggagagagagagcaggaggctgggtccaggtgtgggagggagcaccttgctgctgatggagggaggaagaagactttcaatccctgagtcctccctgcagaggagactccatggagccagcaactgccacctgggggttcctcttcagactgggagggtacagactcggacaggtccctgagttcagtgtgccacaattcagaaagggagacaggaatgagccagagagacatggtccacttcacttatgggtagaggagcaagataaatgggcaggggactgggcattcattcggaagccatgaggtaaaattggccactttcatgtctctgcagattctttgtgttgtggcacgtgcttaaatactccacgggggaaactgaggcagaaggtgtttagaccaagagctggttggtggggaggagagagctctcttctgaatttgctagaccctaatgcccttgactctcagtggcctggagggagagccaggcctgctcatctgtttggactggacaactgaggcccaccaccctctcctgtcttgcatccattgtctcacatcttcctcagtttcaggggatgctatggctccagtaggtatcattactatggtgcacttagtgtagtgtatcagtgtcttgggacccctgagaccggacagatgtctcaaaagtgtatcttgccaccctattgggggggggggaacgacaataaacgtcagggaaatgaagctcaaaggccaggctgccacaggctagcaggagccagaggtggtcagagtgggccccttccagtctagtctctagccctctgtctcttggtctgaaccgtggcagggctcggcccagtggttatttcaagttgtgatggatggccctggcatctccaacactgggcaggtgtgcccctggatgggaagaaatacaaggctgactagcccaggctgatgggaggcattctcgtgaggcctggctttgttccagggaggagcaggcgtcgaggtggctctgttggaggctgctccagagagggtggaggggaagctctgtgtttcttggaatcagagcctggggctgtggctattggtcctcagagataagataataatgcttatctggtgacaagcgatttgtctccctttctagttgcctgattagggaactttctctccttttaggaagggtgtctgttttaggtggggcgtctgcctcaaaggtttgcccagcttgctatgtggccaggaaaagcagtcaccctttgtgcttcaccagccatggtggggagggggtgggtgctggctgtgtggcacatgagaatggtgtcccacgagaggtgctagaaggatggggcagaatgtgaagaatagaggttctccagccggcaaggcaagcctgtgtgtcccagagatggctgccagcgttgagagttactagcctagtgtaaaacactggtgtatggatcaacagaggtccagagaggggaagggacttggtaattgtcacagggcaacctgaacggagctacactctccagactgctaagccaggtccttgccaattgctggtgcacacctttgatcccagcactcaggaggcagaggcaggcagatctctgagtttgaggccagtttgagtctacagagcaagttctaggacagccagggctacacagagaaactctctcccaaacaaccaaaacaaagctaggtgctccgatggaatattattccagtgttgctgggttcttttttttttaattaattaattaattaatttatttatttatttatttattatatgtaagtacactgtagctgtcttcagacactccagaagagggcatcagattttgttacggatggttgtgagccaccatgtggttgctgggatttgaactcaggaccttcggaagagcagtcagcactcttaaccactgagccatctcaccagcccgttgctgggttcttaacctttatatatcacttggccctgttgaggatctgtgcctcctaggtctcaagcctgggatctctctgaatctgtggtggctttcacccccacctagccaatgaggatgaaagtcacacaaccaggaagtgaacggatgcagaagaggtgtctggcctttaggagtgcttggttgtaatgaggggcataccagagcccgtgtggatggagcagatcctgaggctggttaggtgggaggattcccaagccaattgctcgttattcaccgggggcgggggctttggaataaactcacatagaatttccccctcttgtgcatttaaagatttgccgccaagtgatacatgcttgtgaaatctattaacttatttttcttttctcttgtgggacagagcctcatgtatctcatgttagctgaagatttaccatgtagttaagaagggccttgaatctccgctcttcctgcctctaccgtcccaagtttacaggatcacacttaacacccgctaaggctcgtacagtactgatggttggacccagggcctcattcgtgctaggcaagcccatatgaagcttcaaatagtaaaagtattaactgggactggagaggtggctcagtggctaagagcactagctgctcttgcagaggacccaagttcagaatccatagagtggttgacaactatctggaactccaattttagggactcggatgctctcttccaacctccacagacccccatacacatgtggcaaaattggcaatagacattaacttttaaggattcacctctagatccatggggaaccccacttcagggttctgggcagaaccatctggtatttctctgtgtggctgtgcgtatctgaatgtctctcatagactggcagctgaatgagggtataaagtggaccctgtcaactttgtggctatcgaggtgttggggagcgaacatgaccttgaaccccaggttgagtttccggttgttgttgttgtgtgtgtgtgtttcctctgagggaggatctttggggtttgctttcttccccgggtgtttgtgatgctcaggaagcacactgtccccaagctgtgtgtgcacactgtccccaaagctgtgccctcggccctgtcagagatcagtgtccctgtccctctcaggctaggcatcagaacctttgcaggtgttcgtcccctcaaagcaccccccacacccctaaaagcctcccctcccctcccttcccactcctgcacctgcctcagcttccggcctcccccctcttcaaagcagcaggctgggctttacctgcccgcctcagagaaaaacagccaagcctgaaaggggaagtggtattttaggcacttaattagacccaggacaagaatggaggctggcgctctggtcaggccagaagaggctcttgggattaacacccaagtaaccttatcaaggtatcaaggctccctggtcccctggcagccggcagccagcagcagacatcagagtcctgggcagcagaaaggctgtggccactgggctggtgtcccaggaaccatactggcaggggttaggtgtcacagcggtgtgtactgagagaagagcccacccccagctgtcaatcagttatctttctgcccttcctcatggtttcccctgagatggtggagttccggagctatcgtttcattctggctagagatacaagggatagagatgtgggtgggtcagggctgagagaatgggtttggaaggacagggccccactgcaggcttacctgctggggaagctgacagtgggctggtccacaaactagggggactttcaggaagccaggatgggtctgggagtgggaagaaaaccagggtgggaagcagagggtgggggtggggaggcggtaggtgcttttcggagaaagttgcagggcagaagtggtttgacctgaaccttgagaggagggaggcagctatgtattgaagataccaagcaagcaagcaaacaagcaagcaagcaagcaagcaagcaagcaagcaagcaagcaagatgatcccatctgtaaccccatacccagcattgtggagactgaggctgggggatcacacaggttggagacctgcctacattatatatagtgagaccctgaccctgtcttaagaaaacaaaacaataaaaacatctaccacctactccgactttacaggagtgaattcttcaggtccttcagataacaccaggaggtaggaattcatcacaaagcctacctacagatgcaaaaaccgagacagggtggtcacactggggcagggctggctgtctcagtggacatctgtgttcaactggaccatcttgaactaatgtgagggacagaataagccccatctcatttaaccagagagccttgttatagcttggctggtataaataaataaataaatagctcagagaggttcattcattcagttggtgtcacactcaactggaccatcttgaactaatgtgagggacagaataagccccatctcatttaaccagacagccctgttatagcttggctggttcaaataaataaataaataaataaataaataaatggctcagagaggttcattcattcacttggtgtcacacagccagaaaaaggcagagccagtaattaatataggtcttcctattgtggcattggcttttgcacaggcgtgcaactttggaacagtgttcaggagttcacagggacctgtggcgcatctccaggctccccatcccgcccccatccactgcttcccttcctggccctctccccagacccatcctggacttctgaaagtccctcccagtttgtggaccagctagcttgtcagtttctccagtggataagcctgcaacaggggtccttggagaatggcttccctatctcctccagggaagggtttccactttagggaagactcctggagattagtagctggcttctttttctaatggagttgcagcccccagttggtgttaccgacttgctgtttgtgaacctaagtcaagacaccgcagtggcctgggaacatgttgggtgggtagatgggggcagtccctctcaagatcattttttattttcctcttctgtgggttttgttgccctcgatcctgtcccatgtatacctgacctatgccgggttgtattgtgttggattctctctccttgtccagatgatataatcctggggtctctggttgtgtgtgtgtgtgtgtgtgtgtgtgtgtgtgtacatagcctagtggtagaacgggcgccagctgagtgctgtgtacatgtaggtgtgtggctgctgttgttgccacgtgcaggggtgtagctagagaacaaaagaggtgtgtactcatgtgactctgcggagcccactctgctgggcgcaggcttgtagatttgcccaccgccccattcataaagaggaaatgggattgaggggcccagccatttaagcaaggctggcttcagaacccagtctctctctctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctcccctggggaagaatgaaacaataacaaatttaaagcccgatagggcccactgtcatcaagagggccggcggacgtgtgtgtgcactcacaagcatgccccctcctcattcccgcaggcctctcagctcctgcccgttcctgggcccctagcccagccccatcacacgagggcttttctttctggggattgcaaacgcgccaaagattaacgccccgcagctggctgtagccccaaacaatggcaagacctaggaagtgaaggaatcgccagaggagccctggccagtgaggcgggtgggtcacggtctgcccgcttgactccaagtgaccccgaccgcctgcccttcccccagctccagctccagcctccaggctgaaagtagaaactgtctgtgtcgagaaattctcacttaaaagaccagactgctctgcacaagtaaagctttctaccagagattggggcgggggggggcagttagggaagagggggggcacctctccagatggggcctggtgccagaatcccagctgggtgcagcgactcaccctgttctgcagtgacaagacagactgggataatcccagcacgtgccaggttgaggtagaagactggacagggtgtttgagactagcctgggctactggagggaaaggaagcaaagtgggaaagcccggatggttatctgcagtaattttcaagtcggtgagagtgagacttggggccagggcatgtatgtagctgagagccccagcaccaaaatagatgacatgaggtggcagagcctgctggcttaaggctggaatgaagttctgggtgcatgcccgcattagaagatgacagaaagagagctacaagatttagtcactcagcccaggtcacaggcccgtagaaagagacagaggaatcccttgaccccagcctctctggctctgggttcaagactgatatctcttcagacatggtggcgcacgcctttaatctccacacttgggatgcagaggcaggcagatctctgagttgtaggccagcctggcctacaaagagagttccaagacaaccagggctacacagagaaactctgtctcaaaacaaacaaacaaatgattggttgtgtgtgtgtgtgtgtgtgtgtgtgtgtgtgtgtgtgtgtgtgtgtgtgtgtgtatcaggaagagcccatcaaggaaaggcctggagaactgaccatgctgggctgggctggctggtgccttcaatgataattccagctccccaacggagctgcctatgtcttccttgaatttgggcattattggtaaaaaaataatgataatttttaaaaaatcagctcttctctttctctggagctgttctggagccttcggactctttcttggtccttcccataacacacaggaaaaaaaaaaggcagacagacagacagacttctgtctgggagaacactgaacctcccttctagtagccagatgtgggtctccttggaacagaaacgagggctgtggcaggttccagcccgtgactggggagctcagaaatgcaggtggtgaatcccctccgcagatgaggccacttaattatcacgcaatcaatatgcaaacaaatgccaaactgggtttgaatcaaatttctcattggggactcagtggagggggagaggcaggcagaaggggggcccactggggtggactgccaaggaggggactggctgatagagaaagggatatctatgagactcaggcaccccggggccactcagaggcccccagagtctcctgagtctggcatggggccctgcttcccattgagcctagctgggggtctgtgcctccaggctgctggcttcaggagggttcggaggcctgtcagctgaagtctggcggcctctactaattcatttgactcggaaatctcaacttgaccaggttccccctcccctctttaaaacaaactcattaaacttgtcaacactcattaggcctgtaaaacattgaactggagtcactggggggactcggagggagtatgtgttagctatgtgtgagcgtctgggagctcgcactccagagctgagccaggccctgggagacttggctctggcttggccacaggatcagaagtcacaacggtttgttttcttgcatctgcctgttatcaaagacagaacaattcctggagtgagagcccccccccccaacccccgcctccgccccaggagctccagagtctaacttcaactggagtttgcatttggctatctggtctatcagagtggaacttagcttactggacaagcactctgctgtagcactatatccccaaactgagcctgctgcgttttggagctgctgtgattgcaaagagctcttacccagaaccttttatctgaacttcagcttcctgatgtgagccggcctctgcagtatttccctctgacttagggaccccaagtctccccaaactaaaaagtgtaatgaagaaacagggttaccatgaggggtgggttggcataggagcacgtctttggtcctgcagggatcttaggaagagaattttttctttgacacccccaccctaccccaatctcttctacctgcttgctgccctcagcctcttgccacatagtgtgaaattcccctccctcgagggttcctgatcccagtcctttgacaaaaagtatagatgtttggaggggaccttaatctgaagttggggaaatggcggggtgtcttagaatgagaaaccacatttagcaagtctttcctagagtgcaggagacctagtgtgacaatacttatcacagggggtggggaggtgggatgggatgggtcatagaaaaggtgactttagaggacagctaacctctgtgcacccccctcacctcacttttttttaatgttttaatttaatatctttttttaacatttttttattattaggtattttcctcgtttacattttcaatgctatcccaaaggtcccccatacccactcccccaacccctacccacccactccccctttttggccctggcgttcccctgtactggggcatataaagtttgcaagtccaatgggcctctctttgcagtgatggctgactaggccatcttttgatacatatgcagctaaagacaagagctcccgggtgctggttagttcatattgttgatccacctatagggttgcagttccctttagctccttgggtaatttctctagctcctccattgggggccgtgtgacccatccaatagctgactgtgatcatccacttctgtgtttgctaggccccggctcacctcacttttaaacactgcctgctgcagaggcgcctaaacctctcaggtctgcaaatcactgctggaagaggcctgcagagtccagagatggcctccctgcctctccggtccgctcaggggccggggaaaacagcatccaggcgatgaatagtcgttttgtctgggtccccttttaggacctgcgatgtgttctttttccctttaaagtggggtgtctgcagtctcaggctctttctccctttcccccttccccctcttattgagaatgctccctttaaaaaaaaaagacgccagccttctgctgttttcctctctccttgaaaatgagaacatcagccattgaagtgggctgatgaactcttccaaaaagtttattaagggaaggttagacaaaagcccccgagcctgcaggcaactgagcagtcagtatatatactgagcccttttgtccccccagggccaatgcttgaatgcctctcaatggccctcttcagagtgacaagatcaagccagacaacggcttgttaaaaggaactgctagccgtttctctctggctgggcgcaaagctgcgtccccccacttcgctcctgcattaatgtacatctgcacccgcgggaataatcggcgggaattctgttggttttgtgtgggtttttcttttctcttaaatacactctccttctcctcctcctcctcctcctccttctgccctgcccccacctgcccctcccccagccgtcccctacagctgtcctggaggcgtgagtgagttacccggctctgctgtctgtgtctagggaagagtagccctgccctggatggctatttctggagaggcaggagggaacagggttccagagcccctctctcttttggtccatcatcatggatccttccatgccccaggggatgggaggtggaaacttaactacactgtcagccctgtagccttggagactaaggtggggaatcctctgacccatgtatggatggaaatccaggcaggtgatcaaaagtctgggatattccccagtcctggccaactcagtgtctatgttcaagagctttgaggtctagtggcaagtggaagctggagagggcagggcacctgttctaaggggcagagatagctgaatgtcgaaccctaggaagctgtacagggaaggctgtgggggatccacaggagtgggacaggaagagaggagatgtctagggatgagccctggatgttgacagggttggacactgggcctgaaagcctaacaatggtcacctctgccctcttcatctgggctggtgtgtgtgtgtgtgtgtgtgtgtgtgtgtgtgtgtgtgtgtgtgtaggtgtgtgtacatacatgtgtgtgtccatgcgtgtatatcctgtaaactgcctctctagtgggtttcattgtactgtcaggtgtatcttgttctgtccggatgggacactgcaatagacaagtgttcagtgagtactccttgattctagaaccttcctgagatccagagggtcagctgcttcttctggggactgaggctcttccctcccaacctcagacacaatatgtgcccccccccccttcagaacagtcctctcctgggaatgctggggaattgactagcctcccctggggaggagtcttccccttaaggatagagatagcaggaaggagagagaaaagaccttggaccagcagcctgagccggagtcctctgattccttgtggccttctctgctggggacccccactctctcacttttcccttatccctgcagtggaaaagcccccgtcccaggccatctaggcctgcggatggcgcagagggcttagatggattggatcattcttctatcagggcagctttagtctcaccccacctttgctgtagaccagggcaggttcaaatcctgcccctgctgcttgtcaatggaatcactgtgacccaagtctttatgtccaggagaaagaaaatactatagatagacagacagacagacagacagacagacagacagacagatagataaaagtttaggctacgacaagtgttcaggtatccaggccagtcctgtctctgctctgttcttgccccagctccctttatgttttgtggcttaaggatagaattgggagaaaggaaaacaggaaatccaggtgtgtgtgtgtgtgtgtgtgtgtgtgtgtgtgtatgtgtacactaggtaggtgggggaagggatagccactgtcatttaagaaatttgcctctcacccctgtccaccccactgaaagataactacttcacggacgattcaagccaaacttccctgaaggaagggctctgacccatgacccctgtaacctgtatttagcaccttcaaaagccccagagagctgcccagagagccagaaggagggaacaggggccatcagcaggccaggtcctgagctcaggaatccggagtgaaaaaccaggaagaatctcggaggcgctgtctgtcctcgcctgtgagtggccggccccaggggtcagtgtgtgtgcaggggtggactcgtggaggatgagcaggaggcagagagagttatggcagctgtccctacaagagaacatagctcttctctctggttatgttggctgatttgtaaaaagcgaaccactggcattgccctctgtctggggttgcctgagagctgagctcctcccatgggcttagctagtagtgagggctggtctgtgttgggaaggggcaacaaaaaggtctgtgcccaggcaagtccgaggatgggacagatgcagttcttagctcaaggatgtgagctcatgacatacacatcttggccctgttatggggatagacacgcaagtgtgttccctcccgttctgtgtgagctgtctcacattgcacaggtggtgggtggctttctctgcctcttcctttctctctcagtctctgtctctggcagtttgagacacggtctcattctgcagtccagactagcctggaactcgccctgcaatccaggctggcagagaatttctgatcttcctccttcagccatccaagtgctgggatgacaggcatgagtcaccacctggcttgggtttgcctcagttttctactctcagacctctgggctgggaataaagctcgtgtggtacgagttggaggtacacgcatgaggatctgcgttcaaatccccagtgaccttgtaaaaagtcaaacacggccctgtgcaccttcaaccccagtgctgtgaggggtgcagtggagggaggaggattattggggttcgctggccatgggtccagctccagattcagagagacacgctgtctcaagggaatagagtggggattgataaggagagatacagtgatccttctgtggtctgtatatgtgtgtgcacaatgtatgcgtcagagacagagacagagatagagagacagagacagagacagagagagacagagataaagaaaagggcaagttgtggtctctgctctcctttcctgtttcttgccccagctttgcctgtgtcctacccaaatctctatgacaccgttctcatatttcaggtaggaagacagaggctgagggggcatggtttgtcccccctcactgtcccttcagatctctttggaagctgacactgggcaggctcctgccttagctcagctcttgctctcctcagacatgaatcaatctctctctctgtctctcgctgtctctctctgtctctctgtgtctctctatctctgtgtctctctgtctctctctgtctctgtctctctctctgtctctgtagcaggggtggtatctgtcatcttacagtaggagaagccacatgttgagttcctgacctggcacacagtgggtcctttagagcataggtgctggtgtctaagaggccttggggcccccatgggcttcctgtgtgcacagagcctaggctcccacagcctggctagcctttgaaggtcagtgcagccctttattaccacaattaatcacccagggacaatggtgctgtcatgccctcagcctggccttcaaggggcaggggtgggtggagggcacacgaggggggtttaagcagctgcccatttgtttaggggtggagaacactttgctagcttgcactgcagccccatgttggaatcggaagagtgttctcaggggaggggcagtagtcaggctggatctagggggaggttttgttttgttttgttttgttttttggaaacaaacaagttggtttcagattgtgccagagtcgtctgatgtctgctcaggggctgggtgtcagcgatgggggactagtggttagtgacgccacctttctaggtaagccctagaactttggtgtcccaggcccaagatgtgtgtgtgtgactggagctaagtctcccaccttctctgagttttgaacttctcttccacaggtgaaaggtaaccagtcccccaggaatgtgctggggacacttgctggtgccttccaattataaacctctgtgaagtgttaggatttgactgtgccttccttctgttcactatctatccattcatttatccatctgtctatccatttattcactcatctgtctgttcattcattcactcacccatccatctacctatctatctatccattcatccacccatctatctctccatccatccatccatccatccatccacttacccattcattcatctatccatccatccatttattcacctcgtttcattcattcatccacccatccatctatccattcatccatctgtccatccattcatccatcatccatccattcattcacctgtccattcattcatacatcacccactcatccattcagtatttatccatttattcctttactacatactcattcattcattcattcattcactaatcatttgttcattattcattcattattactcattttcatcattcattcattcattcattcattcattcattcattcattcattcaccatccactctcttgccctgtgaaactgaagcttcatgtcagataattctgcctggaattttcacagaagaattgagcttcttaacatctacaaacctttcagtcaaagtacacagaaagtttgtttgcccatgcttactattgctagacttgagatgtgggtagtttgagaatctgatattctagatgtttctctgtgagaagtgtgattatctccacctatgtgtcccccaagagtgggacagtgccatgccacggttggaatcttaactggttaactgtgtacctgggacaggatttctaggggcttgggatacaaggttcctttctccacactgcctgggccaggcctcctcatttccttctgctgctcttgctttgggcaggaggagctgaggtcccaaggtttccatggttgccttttggctcagtgggccagtgccattgtgttctatagagggtaagccggaagccacagggccattgtgatggctagtctcgaaggagctgggatttgggtggttttaagtttgtatggtgtgtgtgtggtgtgtgtgtgtgtgtgtgtgtgtgtgtgtgtgtgtgtgtgtgtgcacatgcatgtgtttctctgtgcacatgactgcaagttccagaaaaggtcagacactttggattgctctggagctgttaatagggggttttgcgctgccctatgtgggtgctgcaaacagaactgtggtcctctgcaagagcaatggactcttaactgctgagctatcttcccagcttgtatcgtaaaacagtcttccattagcctggagtcaccaagtgggctaggctggctagtcagcaggttgcagagatctgcctgtctctgtctccccagcactgagatttccatggagcacctccatgacaggcccaccctgtcagttctgggcattaaacgaaggtccttatgcttaaaaggcaatcccttcgctgtcccctcagcctctgggctgaggcttactgagtcttcaggaatatcctgggatatggaggggaactgttccctattcagtggacagaggaaagactcctgcagtctctctctctctctctctctgtgtgtgtgtgtgtgtgttagcatgcacttgcatggagtgtgtatgacaacttttgggaatcataatctggtctctttcactgtgtggggtctgagggatcaaactcagttcatcggagttagcagcaagccccttttcccaccaagccatctcagatccccctcatttctcttattttgacacaagttctcactaagttgcccaggctatccttgaactcactcactctgtatgtagtccaggctggccttgaacttgtgaccctcctgcctcagacttctaagtgcttgaatggcaatcctaagccaccaagtccagcttacagtttgggtctacactgatgatttcaggatgatcaccagagcctcgtagatgttagctctggtagcatccagaccctctcattctcagaggcagagaggctgtgtcctcgggaagatgacctgactgtcccatggcaatgcaagacactggtggtggggcaaggacagatccaaccatctgagatcatgggtgcttacaacatgggaaaggcaaacaaaggtaggggagggtgttgggggtgcactagggatgaaggtgaggagggccatgtggacaaccagggatgaagccttcacagtgctcaaatgtggagcggaacgtcacagcttataaagtttcttcaaggctgtaagacacctaagcctccgtgaaggaaccttgtccttcttctctcttacggtgggagaaactgaggctctaagggtaacatgaactgctcagaccacacagtgagtggtggatgtcaggtctgggtgagctgagggcttgggaatcacacagccctccccccccccatctttaaaaataaagatgagccccacccctgaaaagtggaggcaaggaacttcctgcccaggagcctcctccagacaggaccatgagccctgtgtgggtagagaggccatctctggatcctgatgattctgcacaaggcaggattcacagtcctttatcccttccaggctgtagagtcagctgaactctagctctatcccgaatctgcttcctggggaaaatggcattgtctctgtgtgcatgcctttctttatgaagtgcttgagaggggacccgacctctagcacatacccagcctggtcacagcaggcagtagatacacgctaatgaccggagcgctattgtcaggctgactggggaggagaggttgtcagttctctgctctctgttttgggtccccaacaacatagccatagcttgtcgttcatgggtgaccggaagtggtcagggagaggagcaggtgtgcttgagcctggccaggactggagagatgggggtgggggtgagcgggctccactatggaaatggggctgttttgaggaagagcagggagctgcggcttctctactcaaggcgcaccagtcagactcagcttcaaagaaacagcttgatgacttttgcagcctgccctgtggctcatccctgacatcttagcacccataaggggaggcaggaggatggcacattgcaaatcagcctgggctacctagtagtaagaccctgcttcaaaatcaaacagcaacataatttaaagtaaactaggtgtggtagcagcacatgcctgtaatcccagattttgggagatggaggcaggagagtgaagagttcaaggccagcctcggctacagtgagagcttattctcaataaacaaacaaacaaacttaaaataaagacaaaaaaaaaagaaaaaagaaattagtcagaaagataaaatgcttctgcattcctgaatgaaagccaagttccaaaacaaaacctgcccccacacctccacgcacgggtcttcttgctccagggagagatgctgagctttttctggtggaggggaacccaagactcccacaaaggttgttggaggagtggtggcccatgctctgcctctgccccagaatggcagatttgtgtgcacacagccccaggtgccgcagttctctgtagatgcaatgccacagggaccaaggggccctgcctgatgctggcccagcttcggtgtgactcaagacccagctggcctctgactgtgggaaatattgggggtagggaagggccagtcaggccactgcagaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaactcccaaataaggctgagctcagttgatacagtgctcccaactcctgagatagggtccccaacgctgttccagatagggcgtggtggcacacgctcagcacacacttaagagatggagacagggagatgggaagttcaaagccatcatcagctacatagtgagtttgaggctagcctgggctacgggagaacctaactcatctacacacacacacacacacacacacacacacacacacacacagaggcagtcaaaaagaaaaaggctcacaggcagtttcagctatggagggtgaacaggctcactatacatagtccagcagtcgctgtcacacacagccaaacccttccaggtgtgacagtcctcacacagaggtgacaagcagattagaagagacaccagcttgagagagctcccctggcgtcgaataggtgcccatcaaaagcttgccgaccataataacggcttccacttctgaaacatcaatcaggtacccaccctttgcctacatttccataggcttttctcaggagcagagcattccctgggacacccccacgtacacacccacacaccaggagcagggttgcctttgtcctgcttttggggcactcgaggtgtgtctgcagctggagcaggccctaggctgggcctgctgggacatatctaggcaaccttcagcaaacagtgactcagctgcatggctatagctaagtctctgcccaggctagtgccggcctcctcaggtttctcccccaacaagtcagggcccaagaggatggggcagactcctgtgtcagctttcccaaggggcccagggagggactggggttccttctctccttgcttaaacctgtttcttctgtcctcgagggttctggtcccttggggagtgaggtagccctgcttctaggcttccaggggaaaacggaaggaggctatcatgctttagagtccattgtgggtgagcttaggacttagtggacagtagtcacagcacagacgccttcattgtctggtaaggtgtgctggctttcagccttctcttcggtagcatcccaagcacacctgggattctctggcaacaaacagagtcagggaaggcttgatgatcctggttggccctgaccactcatttgctgtgctgtgtggctttctgggaatcctatcccctctctgggatccatcttctccttggtaggactcttgatgtggaaagaggtcttgaacaagtagacctctgggttcagccccttagtcagcactcagcacagaagttcaagaagttctgtgtcccgggacatagctttgcccctctgggatgctttatctttgcagtagttaaacagaaagaactattctgccaatgcctctaaattacctggggctccagagctaccttctgcgtgctctgatggtccttggtagggtggtactgccatttggagccagggtctttcacaaggacattcgagatccttagccacccagaggacctcttacaaggattaaataagatactcgttacccagggcttggttggcaaatagccttaatcactgcaaaaaccaattattccatgggtgtggttgagtctatctccgtttgccaagccctgcctgtcctgagagcaagacaggagagtctgggagccagagagtgtgacacatagagtggtgtggctttaggtgaccctgcttggggcacctggacatcctgggtgcccagcatctgtctcccacctgtattctaccctacccctttagccggtggctgtggtcccacccacctaagcctgctctacttcagcaagctctccttcccactggcatcccttggatcaggtttctccatctcgaaattcctgaagcccattcgtctccatctgcagcaatagccatccactccctacaccaccacacgcacgcaccccacccccaactccacccactcccacctctcctaggcagccaatcatctgtctatttttctatcatgaccgaagccttcctggcccggctttggagactagagggtggtgctgaccagccagcgaggggagggccaggggctgtgcacgtggcagccctggcccatggggatgctatccacctggctcctgagcccatcaggccccacttaagaggatgtccctcacgtggagggcccgtccggctagagatgccttcagaaatggaaatttggtccatttgtttatgatttactccctgacccttaacgggaacccgatgggaccaataaaggcttccagcgtgcccagtgcccagcctcgggagggctggagcctgtccagttctctggaggccaaaaccatctcagcatctcaaagtggagccgactgctctactctcaccccaggccatcccaccactcaccaaggaaagattcctcactgctccccagatcagcctcgggggaggggggcaccgggcctgtccatgctgggggggggcaggaggcagaggattctgttttggaggcagagggaatgcgcaccagggtgaggctattctgagcacaaggtaggtagagaggaggccaggacggaggagaaaaatccagttttcaattttcctcaagaggaaaagtgagttcgcaggggacagaataattttccagcatgccagccgtaagtacaacctccttgagacgtggcaagttattaacgaggagaaagaaaggcaattgtcaaacctcttttcgtttagcagaactgcacaaaaacctcttacttccaggggaatctaattagagtgtggggggcacagctagagagggacagaggcctgggttggcctgggaggccccaggtgcctgtgcaggaggatagcatggagcaaacctcttcattcccagtgccacagagtgcgtggggatgcaaggtctggatgcgaatcctgaagcttggctttgccagaaatacagcataggaaatggccgagcttgctactccatgcctgttttcatataggctagctcatgcctagaattcccacactggatgggaggtcaagtgtgtgaggccagactgggctactaggcagtgggctattttgtgttttgatcttgttttgccctgtatcctaggctggcttgaattccccatgcaagcacaaaatgatcctcctctttcagtctgtgtggtgctgaggattggactcaggaccatacccgtgctaggcaagcaactccatcagctgggccagatccccagcaagcacagtgtgggcttcaggcttgtgtgcgcgaagagtaaaaccctgtctccaaagggaagagaaagcaacctccacagaatcgaaaggaacacaggcagacacacccgtgcctgggctacccatggtgggcagtgcaggtgaggctggacccctcagtcccgccacacacagcaccggccactccatgtccaggatgcttcatccattcctaccgatgcacctgtattgcctcggtgtacagagatctggtcctcatcagctccctcataggccatccacagcaagcagagagtggctctggggcagagaagagaaggtgctgtaaggagattagaggcagtggcccaagcctgagagtgttctacactttcatggcctgtttggtactctcacttcgcaaaggataatgaagcaagtagaggtctggattcgagttctgaccgatagctgtgtgatcttgagtaagttcccagtccttccttgcctctcatccttagactgaggttggcctgggtgaccatggggatgggatacagttatgagtgcacagcttggcacctggtggggcatctcagatgctcggccttcacacagtagcccctaggtctccagccagttctctcccctcagcttcttcaatgcaaacattgtgtctttgttcacaatacccagaaggaaggatttctgccttctgagaaccagtgtgtctttggaatttaccacctcctggcatcttaatgccactgccctacaatggctggctgcatttggggaaaatgacattatttcttttaacaagattcagctaactgagctcagagcagtaattgctgcaggttacaagtaacagattttatctgtttaagtgtgtgtgtgtatccatctatgtatctatctatatgtctgtctgtctatctaatcaaaagcacatcaatgtagacacagaacagcctgagggagcagcctgggttttaactccctcagcaccctgtttgcagagctgtttgactctagtgagagagtctaatgggtgtgggagtccccaggtagaaggagttattcagcatccaggacagagacactgtgtttgcagggggaacaggagtgaattgaacatctggatacagatgggggttggatggcaggtctgcatgttggtttccaggacttatgtcctcagccctcttagagcagtcagcagggaccaggcaggcggctggtgccacataaatccatctctaatgagattcttgtgcaaggagatactaacagacgggccaacaaccatgctggcttaaagagcaaactgctattggcatctgctgggactttgcaagttagggcacccatctggacatgagaagaaatcattcattcattcattcattcattcattcattcattcctgaccttaggtcagcttctttcctgggcatcaggaataaagccacgaacaggacagaaatgagtgtgtgttgtcagtctgtgacaacatatactcatgtgggtcctccaaataatccaaccacagaattggtctgggacaggtacagtcctaactggaccttgtaagggcttttatgggcctctcttgatcgggcaacagatttttgccctggaaaatatcagggttgcctctaactgcagagcacagaggggacaatctggagagtgaagagtggggactcaggtcagagcctagatgtagaggaggggtgtgtccagaggggcagcctggagactggggtatgtcaagaaccctgtgatgcaggggtcaagtggcaggagcaggcttgaagaatgacacacacacacatacacacacaaacatatacacatacatacacacacaaatatatacacatacatacattatacacatatacacatatatacacacatttgcacataaccatacatacacatacatatacatacacacacaaacatatacacatacatatacatacacacatacatatacacacacaaacatacacatatacatatacacacaaacatgtattatacacacacaaatatatacacacatacacacacaaacatatacacatatacacataaacatatgcacatacatacacatatccacacaaacatacacacatgtatacacacaaacatgcacatatatacatatacacctgcatacaagcatatatacatacacacatacacacacacatatacacacatatgctcacactgcaatcacttggtaggtgacttccaagctctctgctccagtttccatcttcacggaaggggtggagggctgtaatgactcttccctctctgcagagaagccccaccttgtgggttgctggggtcggttcctgcagagccctgtctatgagtggccctcaaagctgccagtgagcggtcctcacagataagacttgggctctaggctgcaaatgtacattcttaggcatccatggacccaccaggtaatcccctgtgggaagcttgggacacttggttgctcgacagcaggcttgactggatacagttttagctctgaaagccttccctgactttgaacccacaccttgcacttacaatgggctcaggtctttttgcatgattcctgaggagtcccgactgccctgaacacaggggactgaagattataactatcttatgaactcatgggacatttcaggtccaagccagtccttagtcaacagccattccttcttcccttcggttatgccgttaaggacagacagaacccacagaaggcagctggctcttcaacaggcttatactggtcgcttttgcaaatcaatttccccaactctgagaatgagcgtcacctactcagaaagacgggatgttagaattcgcacaaagccaaagacattagcacccggagggactgtgtagcctacccacccccttggcaggaagagacaggatcatggcatattgcacctggcccaggtgacacggtgtgtcagagtcagctgcctacctcctcctgaccttggtgtcactcacagctagtcctagaggccccttgcatctggctggtcactggccagagcatctgtcccctcccctcctgctctctccccagcaaagtcttctgtggtaggggtgggggttgggggctgaccctccatcaatccaggctgcccagccttctccagctggcctggctcggctgttcccaggcagagcaggtccgcagtggaaggtggtggaaaaatgtggacaaatttctgatttgcaacactctgggaaagagtttattgccattgtttgaggacgaatgtgtaaataaagcaaggcgaagatggcgggggaggccgaggagaggcagaaaacgagaaattttatgggcataaggagcgtactctaatggtgatttctgaggcattggaccatgttagttacttagccaaatgattgccaagacgctgggcgaggcagctcatttcttaattacagttacgtcttacacggcaggcagacgcccctaccctgcactgctcagtctggagcattcgctgacctgaaactaggtcctgacctagtgggtgggtgctggtgagcagccgagagagtgggagttgtctcttgcctctgttagggcaaggagggggactctggaacttctgtctgtgccctttgctctttttactctttgctcttgtatcttgtgtcagacaaatatttgcctcggggccccagggtaaactaaaatctctttatcaggggcaccagtggtgacagcagccacagttattaggtatttactatgtatcaggtacttcatagcccttgtcttaacaagaccccctctgtcgtcagggaagaggactctaagaggttgggatcatcagcttcttcaattggcccagagggataaagtcactttcctacatgtgtaaaaggctgggtatcactctgtgcctcttgagggtcacactgaagcaccacctgcactgtgggggagagccacagcagcagatgtcaagaactgggagatgcccagtaagacacttggggttagagcccgaggctgccagttcttctacaataggtgaagtnnnnnnnnnnnnnnnnnnnntgtagccctggctgtcctggaactcactgtgtagaccatgctggcctcgaactcatagagatccgcttgactctgcctctgcctcctgagtgctgggattaaaggtgtgtaccaccactaccccgctctgggggtttatttatttatttatttatagccccagacttcttgactgagctgggagaggcgtgggcaaaacgcaaagcccaagtcccaaagtcagttcccatattggacttcttctgtctcctgggcttagcactgaggaggatcggaatcagggacagtaagggcccagaaaggtctgacttcgtggcattgaagcctcgctgcctctcctacaccatgcaggcaggctcgcctggcgggaagggtaggctgccctgtttctctcccgctggctttgaagcctctcctcggctctccaagcttccctgactctctcaccccaacctagcttcctgagagcctgttcttcagtatctcgctctgtaatatttgtgtcgttttggttcacttggcatctcctctccacctgtgtctctgcaggtgccatttgcatctggagatgggtttctgtggaaagaatgaagtggaggtgactgtgtggctgggtccttgaaaagcaaggagaggataatgatgcattcatttatttggccattcattcattcattcattcattcatctatccatagatgtactctttgctcttgtatcttgtgtcagacaaatatttgcctcggggcccaagggtaaactaaaatctctttatcaggggcaccagtggtgacagcagccacggttattaggtatttactatgtatcaggtacttcatagcccttgtcttaacaagacccctctgtcgtcagggaagaggactctaagaggttggggtcatcagcttcttcaattggcccagagggataaagtcactttcctacatgtgtatagggctgggtaccactctgtgtctcttgagggtcacactgaagcaccacccacactgtgggggagagccacagcagcagatgtcaagaactgggagatgcccagtaagacacttggggttagagcccgaggctgccagttctacaataggtgaagtgggaagagaggtctggctggtggcttgctgagccgctcactctagagctctgtcacacaaaaggcaaaaggcaaagaaaaaaaaaaggtctgggaactcagcctgggataatggcttcctttctgcttagtttccctcaacactgtcatctctgaccttttcagtgatggctggcccagcacctgtggctgggaggaggcagacagagcccacccccaccccccagcctgagccaccatctctggttcctccaatttctctagagaccttgtcaagcaagccttggctgctctggccacgccctcatagacaggactaagaagtcaagaagtggtgtctaccgtggctctctgatgctaataggcggcttatgtgaactagtcattggaatgaataacagccgggagttgacacaggtttatgatcccaggactggcgaggttgaggcaggcaaatctctgaaagctcgctggcccagcctggcccatttgttagagctccaccccgtgccaatccaagccacagaagagtgtaaagctttggagttcagcccacgcctgtctccaaggctctcagattattctacactgctgccacccctccccacacaccaccttagccacttgaaacaacaggttaaagagactgagttcccagttcctcgggacccttgaccatgtgtctgcaggcagataaacctagttttgaactcagtaccctgactctgtccttggctcccgggtcggtctttctcccacttgtgacataagttcggttcccaggtcagtgcagaagaaagaacaccagatctaccctggaaaacattactaaattctgatcacgtgtaccattcaaagaagtactacttccttcttcctagctccgccccttcctgtcaggggtgtatagacagcgccctctagtgcctaagaaaagtattgtgctcttagcacaggctcatgctctaaataccggacatggaccccatattctctgatacaggtgatctctccaaggatcagaatttaacagtacaacctgaagaaagtaagtgtgacttcctagctcaggaagttttgtcaagttgcaagtaggtgtgagtttaactctagctttcctgaaaaagactcttttttttcctttcctttttccttttttttgggttgggagagtaagacatcaaaagactgggggccagtagtcctgttttcatctgcaccttgagagtgccccaacatttggaggagcctataaggaagcaagggttctgacagcctagggtccttcagacatacaagagagggtatcttacctactggaaggccagaatcccctgaggtaggagatggtccctgccagattggtgcagttcacccatctccctagacaaggggtagatacagcagagttcctgaggtgggctggactcaggctgtggaaaactccagaatagagtcccactccattgcctatcccagccaccttcttgactgtggctgtgggtacatccctgacactctaacctcaccacagactcttagctctgtgatgtagtcttgacccagatctcttaggatggggagagaaggcctggtgatggtgaccctctctacacaggaagacccatcagctgcttctgagctctcggctccctcccttctccccaaaccggtgggtgcacagcctacctgggacagggtgtctgagtgagtccttgtcactagggccagtggtcagatttggtcaggacagagggctggggcctgaggctgagttttgtgatgtgaatgtccaagaggaagatgagttcaacagatgggcaggagtggggtgttctgtctcctggcaggagtccccacgggtctctgagtcatgcgtggaccagttcccgcagaccagcctagcccgtgcacacctggtgagccggttacagctgagcactttgcacagaggggacgcaaggatgggagggcgcctgccactcctaggctggcggcccccagctgagctgtaaatgacttttccattcgctgaggcctgcgcccaggcctgcttggtattcagggacactgggcccatactcgccagctctcgactctgcccgaattacttgattaaaacgcatatcaactattatgtgattcgtttctgcagcacagctccacgccagggcctatgttaaactgtaataactgggaagggaggtggagggagaggggtgcagggaacagagcttgggggacttctgtgatggggtgtggagtggagagaccctgtgcctcttggcttccactgcctggtggtgaggaggccttggggggtgggcaccttcaaaaaccatcactaccctcgggatttctccagccaaaaaggagagggaaaggcctgggggttgggggggtggagcagccactgtgatgtcaagatcacaggcgggcttctcaaagcagctactatgtcaggtgtctacaccaggtgtggagccagggttccttgcagccccttgctcaagcgctccactgggcaccagtcaaacgggccaaccttggccttctggcgttccaaccagtgggaacaatggtttcctgttggcagtgtgaagggtcggctgctcctgagcatggagatgggcacttaagaccactctccaggctgtgaggatcgaggatcggtgccgacaccctatgtacctgctttgtgccaggcaccgtctgtatcacagtcaaggatgtgctggcctggcaggatgagaagccccatccacagacacggctattgtctcctgagactgtgtgcatgttgttgtgcatgtatgtnnnnnnnnnnnnnnnnnnnnttcccattgtctgtctcccaccgcaagcctggtctaggccatcctgggctttgacaaaacccagcgacactggtctctgcactgtgctccggtttccctggcttttgcaggtcatgtagcagcagccttgatgtctgctgtctgtctgtcctgtgcaaccacccacccattcaccggtgcttccctcttggactacaagtccccagcacagaagggatgcctcctccatcagactggaagcttcctgagacagactgtttcttcctaagattggcgaggtcccgctcttccttgcttagtgtgggcctcctactcctctaagcagagacaggattcaggaacccagagagggctctttactgtcctatcatttttagggctatctccagatcagcggttggtccatgagaccccagctacagggaagcaggggtcagagctgggcaggagttgctccctgacacccaccccaaatctgcaggttagcttttctgtgtctactttccccacaatgcttcaccacagaggaccagttctctcaaacagcaaggacctgtagatcctgctttgctgccttcagtttgggctcgggtgagttggtgtctctacattcacagagctccacagatccctgctcacaaaggacgagggtcgaggagtcgggaaggaagccaaaccagaagtcagtagtctgtccagaacgctgcaatctgaaaagcagggaggaaggggtggggagggggcatggccatgatagagccccttggatttcagccctcagctggcagggttggtctctgtccatggttttgttcctggcggttctgatccccattcacctagctagtgtctgagctctgagtccagggtcacctgaagggacattccctggtgcctgctcctgccatgtttgctgaccctgacctaaccactctcctggcccccatcagaacacagagttcattcattggcgtgtttggctcagagccccaggtgtgcgcgagggacgccccaggtgtgccccaggagtgccatgtgtacccacagttgatgctctcaccggagttagggtgggtgggcagctggcaagctggcgagaagagaacaggaaggggttggctttgatcttaggtgtctagccattggttctttggccatgatgcatagtgtcataatcagaccagcccggcagtggtcatcaaaatacagagtccccagtgaacaagatacagtgtggcacagggaggggcagagctgagtgggagtccagcccaagccagggtattgaccaagagtcttcctctccctgtgtgccacctgctcctggccctggatgcagccctggggcaagatgatccctttgtgctttttgatgcacagagcctttgcacatgcttatcccttacatagggcctttgcacatgcttgtcactcagcctgccacacttttcccttgagtctggatgacttttaaatggttatattttgttgttgtgttgttgttgttgttgttattctcactgtgttgtgagaggggtgggggtgggggtagggggcctacacctggagttacagatagtcataaaaaaagaactgaacttgggacctctgcaggaacagcaagtgctcttactacccaagccttctctccagtcctaatacttaattgaatcatggctgtaattaaattgtgattcaccaaacttatgctatgtaatcaatttatacttaatactattcaattttactaatcatgcttaacacgttgtaaacaattttctctttcaagatattttaaaataaatgatctcctatgnnnnnnnnnnnnnnnnnnnntgtgtgtgtgtgtgagagagagagagagagagagagagagagagagagagggagagggggagggagagggagagggagtgggagagggagagggagagagagagagagagagaaaggcctagactctccatgtaactaatcccctgaagcagctgagtgtgtgctggtgggcaggcaaagacgagagtgtaggctgaggggaggcccagacactttgtgtactgcctttctgtgatgtcgtctctccgtaagtagtgtaagcaggcagcctctgaggctctccagcttgtctcaggctgggcactctaggcacagagtcctaccttgtctgctgtgtgcttggcctattcaggaggagggtaggtgcttgggaatgtgtgagtgaatgaaagagtgaaagagtgaatgaatgagtggaagaatgagtgaatgagtgaaaggaggaatgaatgagcaaaagaatgagtgaatgagtgtatgaatgaatgcatgcatgaatgaatgcatgcatgcgtgcatgaatgaatgcatgcatgcgtgcatgcatgaatggacaaaaaagccccaagaatcccaaagatggcagcgaagggaagggaaagataagcaaagggaggagaaggggaggccgaggaaggaagagtcttgtctccctgcaccccccacccactgcagttctcatgccccaccctgttccttgctccctacattccccagggctactgggcttgttgtaaagatgacctgctggggtcttctccaccaggccagagaagggcatgaagttcagtggaggtgtaaagcgggatcccttgccccgcttagccccagcagcagggacaactgattaagccatttctgcagcctcctccccagaggacccagtgcgcccagcctgcctgtcagcctcttgctgaatgaaagacactggccccagcctttaccttgcctgctctcccaaaagcgaagtggcttgttgcctgctggcttctgattggcttggtagagacagacttcctgaccttcacaaacacaacagcgctcctatgtcttggagctcgtcacccttcaaaggcttattacaattttattttacatttattgaccttgggggaggggcacatgccacagcaaggcacatgcttgctggagtgggttctctccttccgccgtggtttccagggtattgaacgtaggtcggcaggtttgtgcagctttatgtgcccgcccccttgacccccagccatctctatggcccctgtcctttgagcatcaagtcttaggtcagaggcatgcgtggcagtgataaatctaaatgttcacctggaaggacccgccttgaaagcagtggactactttgggcagaacatgtttacccagtcttctaggctgggcatgaaggatattttccatccttcactgctaagctatggtgtggtaagccgtattctttcttggggagacaccagatccccattgtagtgttcagaggacacaggtgtgaccctctgcccactgggctaccccaccacagggaaccgtctggatgagggctcagatgtggaatcagaacccgacctccccctgaagcgcaagcagcgccgcagtcggaccacgttcacagccgagcagctggaggagctggagaaggccttcgagaggacccactacccggacatctacacccgggaggagctggcacagaggaccaagctcacggaggcacgcgtccaggtgaggagaagtgggggtgctcactggagtcaggctggggtggagggtgtcatgtgggcaggtcctgagtcgagtgctcactccaggtgtgatcctgggaccatgcacacgctaacgcatgccgtccctgaaggggcagcacatattggttgattgacttacagattgacagagagagaggtacagagcccgaagggaagagagatacagggagagattagaagaaagaaaggtgagggcatgggagagagaaacagaggtggggaggggaaggcacaaactctccaaacctccctcgaggaggaaaatttcccagcagggttatcctcagtcagggaatgagtttcccattgcttcaagtatgcaaggtgtgatctgggtagattcaaaccatctacactggacagggtcacccaagaccctatacacctgaagcacacagtcctgattcagtggctctagtgacaggagaaagagcccaaactaaagtttaggtcttcatcagggacagcagtgggggagggtggctcatcccatctgccccaggctgagccctgggagtctctcctccagcagggcacagattagattcatctctgcacctggctggacaagggctaaggctatggaggagatgggacagggcagaacgattcaatgaatggcttgcatgacaacattgtcctgggctgtcacctttatggacagaggaggtgggtctgtagaaggctgcaccatactgtgccatcctgagaagtgcccccaaccccgcccctggcatccccatggccacaagccacaatgttgaaagtgatggagccgcaggctcatgtgtcaggttgggatggtcactggccccagccctagtcacaggtacagaggctaggattcagagatgtgacccatgggacacagctagactgtagcagcgtggcctgcctggcacggaagccttacgtccttcctgtgcccaagaagaggaggaatctgactcagaagctggaactagaacacaataagaaaagtctcagaaaaaactggccttaaacgctccaagagcgggtataccccctttactctcccacccttaaggggaagagggcgggcacggcagccagctagctcatctcatcccctcccctgatgacactggagctgcagactgcctccaccaccacccccactctctccttgatccttgcagctgttgtcccaggtgtactcctctgggcttcctcactgcctggtctggcagcctcgtggcttcccaccaccccgagcctggcagctccttagaaaatgtcctggttgtcaggatactgctttcattggctcaggggactggggaaacaggtgttatgcaaggtccaaacagggaggggcctggaaatgcaggaggccaagccttggcaaaccacaggaaggctaccagcctcctgttccctgggcttctctctagccacgcctgtgagctccctaggaagaacagagcagagggacaaaagcaaaaatttaagaacggacagaggctgacccaaaagccaaagtcttagtcctatgaaaggagtctggaagcatccagaagctcagaggccctggaggcggggcaagagctggcagggcatccattcaagttcaatagagaggtctgaggaggaggctccaggtagagagtctgcatccttgccactggccagctgagtctcccatggcagcttagcttcctctttcaaaacacagtttgtcccaggatctcaatggtcaccaagactcctttgggttctgaggtcctactagcatagtagatgcccagggagggaatgagaccacagtgtatggaagtgtttggacaaaaacacagtgtccccatggattagcgtccctggcgaggggttcccaccgtggggagcggggcagagactcaaggtcctgggtgctgtcgtgactccccaactctgtatgtcctgcgacttagcctctgctttgaagagtctgtgccttgagggtctcccagccctgagatatctcagctcactgtgtgggcaagtggagtgcttgcagattggcatggagttggaatctgtccctaaatatcagccctgtccccagcatcctttctgcaaaacggagactatggcaccagggtctgcttgcttctagggttgcacaattaattgtaaagcaaaaggatgttagagaccaatggtgagcatgtagctcagtagatagagtgcttgtctagcatgcacaaggcccttggtgtcatccccagcgccacataaagtgggtgctacatacctgtaatctcagtacttgactatggaggaaggacgatcagaagtttgacatcagccgggcgtggtggcacatgcctttaatcccagcacttgggaggcagaggcaggtggatttctgagttcgaggccagcctggtctacagagtgagttccaggatagccagggctacacagagaaaccctgtcttggaaaaccaaaaccaaaaccaaaaaaaaaaaaaagaagaagaagaggaagaggaggaggaggaggaggaggaggaggaggaggaggaggaggagaaggagaaggagaaggagaaggagaaggagaagaagaagaaagaagttgtttaacatcatccttggccacatatcaagttatcaagtttgaagccagcctagacttcatgagaccttgtcttaaaaaacaaactaaggtggtaatggctcacacctttaatcccagcactcaggaggcagaggcaggaggagttctatgagtttaaggccagcttggcctatatagggagttccaggacagtcacatagagagccctgaaccacctttgttctgtacttcattcatttctcatccatttactcaatgagcatttattgagcacctctggagttctcaccctgaagggcatgaggaacacaggcctctgtcctagatgtcccaaacctgaggggaggtggagagctacacagccaggagcagataaatagaatgatggacctcctttgaagaggcaggaggctcacctacccatcttcgatgcatgggggtgatgccagaggattttccagccagaagtgggaagggttctcttgcagcagtgtgtgtatgtatatgtgtgtgctcgcacatgcatgtgtgcatacgcacatatgtgtacatatgtgtgcatatgtgtattgcatacctgtgcaggtcctggtctagcagggcttgggctatgtgccgtctcctcttggagggcttcctggaggaggtggaggcttagaacaagaagacgctggggtggagcacttgccatgggaggagctcgaggctgagtgtctccaggcctctcctcaccctgtcctgtgcctgtcacctgcttcctgtaaaacagggatcattctaaaagccctccctggagagtggtgagggggccctgactctgaaggtccctgcaggccttcctggtggctcagcctcctctccccttcaggtctggttcagtaaccggcgtgcccgctggcgcaagcaggcaggagctaaccagctggccgccttcaaccaccttctgccgggaggtttcccacccaccggcatgcccacgctgccaccctaccagctgccggactctacctaccccacccaccaccatctcccaaggtgagtgtctgctattcaagtacgtggagtcctgattttggaactcctggtcactcggggctgaagagcccagctcctctgtcctcgcaccctgggctgcaatgggccattgagaccccctcaaggaaggcagatcttttgggcacagacagttcttccagtagcttctaggatgccacacagcctgagcaagagaaatgccaagggaagaaggtggaagggagggagcccaggatacccaaggcccttgggaagtaaagatttccttctctgggtttctgaatctcccatcttgatcccaccctagcatacacaaaaaacctcttaatatctgctgcacagggctgcctcctgaagggcccagaggttggcatgctggggaggctaagtatccagagagccctgcccgtgattcttaataagaaataagccagtgcagaggacagcggggacccagcctcagaaggctgcacagagagagggaccctaacagagcagaatagcaacgtagtagctgggcagagaaacaactcgagtttagtcatttcaagcatggttcattcattgatcttggctctggcccaacccactgagcctcagtctcccgactcctctccatcccctcccccaaagctaggactcaactcagcatgacaggtacccacaaaatgctaatagggcgagtctgggtggatgatagatgccatcaggcacaccttacaatccagttagtgcttattgagcatctactgtatgccgaataccaagtaccaagactgtgcaggttgcctagaggtcacctagatgccaagtaggtgtgagtcaagccctggcctctctgatgttggggtgcctgggaaccagctggtctcagctcaagtcacttgagaaggtggtcccttccctccagagggcacgactgggtggagtttcaaggcggcttttgctacttgctaaggacctctctgggtctctcctcagatggaggcagcacagtacacaggccccagccccttccgccatcaaccatgcatcagggtgggctggctgcggccgctgcagcagcggacaccagctctgcctacggagcccgccacagcttctccagctactctgacagcttcatgaaccctggggctccctccaaccacatgaaccctgtcagcaatggcctgtctcctcaggtaggtggcctctctactccacttgggggatctcattgccagattcctgctggcccaaacagaagggtttaggtaacccggactggctctcttccacggggtggggagaaggtcactaagaactcagaggtctctggaaacccctggctgctcgggaccctgagagagtttgagcgggaagcaaaggtctctttttccttcccttgccttgtgtctgtgattatggctctgggttgatctgccgctttctggagatgggagacagttggtcactctctccagatctgcagggactgattgcaggatctgctcttggctccacccgccgttctgagctcaatcccaggcacattcctacagtgatcaggaggtggctggcatgcgtgtttgaatctagaaccaagagtccatcctagctccagtcagcgctccatgcctccctttttatcaggccatgaccaaccactgggaggacaggatccctcctattggtagaaagaatggatgcagaggttttgggccaagatctttgcttaggttggaccttagggcctcaggtttgctagtgtgcaattggtggctggttcaatcacacatagcctgatggagtcatggctttggagaaagatggaaagataacacaaagctcggggtggtacttggtgatttgttgagcagagctgatgtttggagtctgggtgatgtgatgggtttgtttctatagctacaacagtctcccaagtgcccctgggaaaaggcttttattctgcatcccacctgccactccctcttcctctcatctgcaggagacagtcttggcatgggaaacaaactgatgtgaacagctgtgttgtgcgggagaaggtgcagactttgggagaggccgagagcctcctcctgctgctccagggccagtgcacatctgggagcctcagcttttcccatttacagtgtctgtcctttataccctacccacgagaacttgctgtgatctgtgtgtgtatagtctggcgcagaatagagtcgagcagacattagttttcttgtcctcctattgctcaggcaatatattaatagttaatatgacaaagttattgtgataaaaactcgttagctgaagagcaaaggcgggcacaggggagaaggtgagccttggttggtggcccttgccttgtaagcacagagcagagcacagatccttagcaccaatggaaagagccaggggcggtggggcacatacagagtcccagcactggggaggcagagacagaagaagcttgctggccagccagcctaatggacatggtgaggtccaggctcagtgagagcagcggtgtctcagggaataagggagaaagtgactaaggaagacagtcaacagcaatctctgtcctctacacacatgtgtgaacattcatgagcaaatacacacatgtgcatgcatgcacacacacatgcatttgcacacgtatgaacagacacacacacttgcacacactcacacgctcacacacaacacatccatgagcacacacgcatgaatacacatacacatgcatacttgaacacacacgtaaacatatatatgtatgcacagacacatagacacagacataaacagatgcacacatgcacacacacacacacacacacacacacacacacacacacacacacaccacagctcctggtgggattatacagacctcagaggccctcaggtcgagaatgaagccatcaactcattaggacctgtcagctttgggctggctctctcaagacatcctaactctcttgctagtacctagcatcaggttagcctctcagcctccctgaggttggaggtcatgatttctgttgcattgttgtcactggtagctggctagcctgggctaactttccagagctgtcacaggagaacaaagaagaggtttcttctctccaagtggggctcagagatggggttaaaggtgaggagggaaggccagaagggggaaaccaacctattgatgggggagctatccccagggagctggagtataggcaggaagttatgtcttctgcctctccctggaagtccctagattggatccagagcttctgtccaggcgagacctggggtggcttccaccatgagcagaagtccatctgtcctgggtctctaggctcagagggcatgatggatgggctctctccaagccctgccttcaggttcccaccaaaggtataaaggcaggtgacagcggcataggggacatgaaggggaacagctgcagggatgaagctgccctcggggaagaggcaagggcaggcaggccagcaaatgcagggttttgtgtgtgtgtgtgtgtgtgtgtgtgtgtgtgtgtgtgtgtgtgtgtgtccactgagggtggcaaggcaaacctctgaacatgagagtcaaagtttcaatatttcaaagccccctttcaactcagagtttactctcatcctcctggctctggggttttgggagggatctgtggggggagggggaacaattctcagttgacctcccctgtcctctgtccccaataagaaactcccccaaagttcctctaagccctctgtgggtgtgtcacctctgcacctctgaggtaggttcatacactgctacccaggatcagaggtctggtccctccctgtcacttggatagtgtcagctttgcaggttgtgtgtttttgttgctccaaaagccaaagggatttctgtgtgcagcggaagctaggagatttagggatggggccggcctgtgtaccttgctggtagtccgtggttgcctgtgagaaagaagatttcttcccacactttgactaccatcccttgtctctacccaatcttggaaatggttgcctctgtgcatcagggactccctggagagacctgacagggcttcataagaaaaccttttgttccttaaagttctacgaggttcccattcgggaggtggcacctcagagaaccaatgtacctagcacaggctgtacaccaggtactgtccctgcacttgggacaaatcagtaaaaaacaaatggggaaaccctgccctggggagacacctgaagccaccaggtccatagtgagttgatcacaagaggactaagctctctgcagtcctgagacggacactgtttcggttgctatttgtattttaacccatgtatgagtcaggattcaaaccctatacctcaggaaccccagatcctgacctctcagctgtatggaaggaaaggttcctctgagccaggttgtgagttaagaacaaaacaacaacaacaacaacaacaaaaacataacaagacagagctccaagcaccttaggtgggaggctctaagcagagcagaatcagtcagcaaaccttccttgaggcttggaaccttcaagatccccacccatggacccccaccttagagcacctgacagtaagtcctcctactcttgcgccgagaccttctgatggggttctgggaaagggaagccggtccagggacctcatttctgatggctgtctagttaaggctttgcttcaggctgagggccagctacttggaaaatgactgaaaatagttcctgagaaactgggtgtggcagtggacacctgcgatctcacccagaactcgggaggtaagagcaagaggatcagaaattcaagggcatccttagctacataatgaggtgaaggccagcttggtttacaagagacactgggtcagggtgggggaggaaggcaagtaggcaagtagcctttgcaagggtgagtcccctgagtccttggcagtgcatatgggtaaggtgagtagtgacttccagtcctttccaggaacagcatgaaagacccacagggcaaggaagatacaagtctgatggaagtgtcccagtctgaagacaaagcaggactcctggcctcaggagaagcatggcagagacacatttcttgtctcaggtgccctgatgtaatggccagagcattgccctcccttgttgaggtcccagtggcacgtagtgacagacatcaagagactgtgctaagctgccaaactcaagccagaaaccaagcatagagtcaggagcagtattctgccattgaagtgacctcaggctgctggcagggggcctgtactggggcccctttgggacaaacttgtaagacctgtggggagaagtaatccctggtgttcctttcccacccagcactgttagacttgggagtggaaacaggtctggagagggttagatgtagccaagatcccatgttagatcttgaatcaagggtgcttgctgctgtgttatggaaggggatgtggtcagagctcagcctctctcttcaccccctcagtcaccatcgtctttgtctccctccatatttacagcctctaagtgagcattacgtatgttcctgtgatcctttgtggttttcccttccttggctctctcttggctctctcttcctttccttcctgtgcctacaataattattcggcagcctgatgggctgaagctggggtagggagtgtgactcagaggcaaagtgttgctggccctccactaggcctggatttgacccctagcagtatagatgtaaattatatatacatatacatatacatatacatatacatatacatatacatatacatatacatatacatatacatatacatatacatatacatatacatatatatatacacacacatatacatacatgtgtgtgtaatttataatataattatatatacatgtgtgtgtatgtgtgtgtatatatgtgtgtatatatatatatgtgtgtgtgtgtgtatatatatatatatatatatatatattaattacagtggtcatcaacacaaagttaatgctgaatgcagaccaggcttagaagtggcaaactgtggtacctgcttccatccttagaatcatggcagttgtcttatggcctccatcccacagatgggatgactactttatccagggccatccatccattcaaccaaccatccatccattcatttctccatcttcccatccatccacccattcatccatccatctatctgtccacccatccatcatccatccaccaacccatccatccatccatccatccatccatccatccatccatccatctaccaactaactcatctatctatctatctatctatctatctatctatctatctatccacctatccatcatcccccagttccatttctccattcaccatcctatccatccatctgctcacctacccaccaagtccattcatccgctcgttcatctgtctatcaatgaatccactcttccatcagtccattcacacatacgtctacctgcctatccacccacgtatttatcctctcattcaccctcctacccacccacctgcccactcatcccccatccatccacccaaccaatctacacatccacccatcctaaagtccgtccatatagctatctgtccacctatccactcatctaccctctcattctccacttgccatcctagcccatccacacacctataatcctctcatctattcacccaatcacctatccactcatgcatgtccttccatccattcatacagccatatattcactcctctacccatccatctgtccacccatccatccacccatccaatgtgctgtgccagtctatgacaggttctggaaagtatcagagccgggattggaacggtctgcctgcagagtccatcttgctgttgtgtctacccacaaggttggtatgaatgcccatatagatcaggttggtgcgttggtcaaggaaattgaagtccaaggccacaggggcagctaagggcaggatccaggttcggagtctgtatccacaaacagcagtatctgcttccttctgagatggggcttcagatctgcatgataattggcgaatgccacctcccaagcgtttctcaatggcaggttctcagttctgccctcctagcccaaggcctccagaggggacaaaccagcaaggtcagagacttggcacctgagtccatgtgaacacctgacctgtttgaggtcattcaagccccacaaaacctctcctcttgggaaggcattctcagagaggctaagatgctcacagaaggccacggagccattgagtggcagaactagagttctaagcaacatctacttgacctctggaactcaccactgctgaccctcaacaggacaagaggaaggcacactgggactcctgggactgcgtttcacctgcacaggagactcctcgcctctgtctcctcttacttcctccctgtccccgcccctttattggtgacattgcgtttctaataagcatttaaaatgagtcttgctggaccagggacgaggaaggaggagggagggagagacatgtaggcaggaagacggggcggtgtgggggggatcatggggtgttaaatagcccagaatttttaaaaacctgatgcaaatcattggtaggagagaaaattacgcgcaattatgccctgatactggaaggttttgcctagcccaggcaacaagatctcattaacaagcagaaaataagattgaaatggtgtgtaaaagagctgaaaaatgaatttgaatgctgcgtttgtccacaattaccccctccttcacacatattttattgcaatttttttattattcttaatccctccattcctcaaagcagattggggacatcctggcattaccggggcactgggaggaggtgtgaaggatcttctgcgcccctgaaacgagaccctttcttgccaacatcttccaaggttgggatttggaaggattggaattcatttctcgggcttagcgggttgtagggacacggggctttaaccccagccagagtctcctctgcacccccgcccgcctagccttgcttttgcctcccttcccaggtgactctcctgccatgggcttccttccctctgcctccgtggggtttctaggggtctccgtgctcttctttccttgggaagcctctctctcaggcccccataagtgggaggtgggctgcatcagaagaaacaacaaggtggatcagaacatcaagttctgattctgctgcttatcctgaggtcgtgtgacccccagggcagcttacttagcctctctgggtttcatttctcttacctgaaaggagggctatcatctctgcttctcagaggcactgtgaggactaatgggagatttgagcaaagtacctggcacacagtaggtgctgggtaaatggtcactctctgcaccctttcacctacgtaggcttcgcctctccttcactcctttcgccatccttccctgctctcccttccattttggttggctgggaaaatgctgtgccagtttcttctttagagcaatgtagtgcgttcagctgactcaacctggagagagctgctgtgcatgaaactctcctatctgtggaaagccctggaagctgcctactgtgctcctagaaggtgagctgcaagggaaagggtggggacgactcaggactctgcctctgttcctaggagcagggtaaagccagtggagtcacccccaccctccttccctgccttgtttctcaccatgactggggtcaagggtcagttttcaaacaggaccaggagtctgtggctggcttttcttggacccgtagctcagtacctttttttttttttaaagcatcaactggttttccccatacccagtaattgnnnnnnnnnnnnnnnnnnnncctgggtaggcagagcctccctccctccctccctcaccagaggagcggaccctgccagtgtgccttgtgtgctctccagccattctgcctttgtcggaggtcacccacctccgtggaaaagctgagttatttcccactggctgctgctcccgacactgccacctgctttcgtccatcagaggccaaggctctggtccctggggagagcggcagtggtgaaaacagagccctgtttatgtctctgctttcgccctttatcctgggtaaagaaagggaacaaggaggggggagggtcaagggtgggaactgccttcctaacacagaaaaggaagcccgcaggcagctagctaaggatgaggaggtggcagggactatacctgctagggtcaggacaaatggcttgtggcttggcttgcagggtgacactggggacagtttaatgattgaaggcacaatggtacaatctgctggccctttctcaggatgggatctggagagctgcagttgagttcactatagaaaataactacgtctatttaagtgtttccacctaaccctggaaaagtgtggtcagtgctgccctctgttcctgatggggccaaggccagcaagaggagcctatataaggcgccatatccccagaggctgagggaactccttataactcaggatcgtgttcactgggtgacatgtccttttcagcatctggaacatagtaggtctctagcaattgttggtcaaccccaggtctgaggcttgacagagcacagtaacaagggttccctggggggtggggggcatggaagcagctgctcatctggtctgtccttgaatccatcatgatgtctgtcaagttcgtgggacacagcacaaggggagactggggaaagagggatttgaggtcactgcagatcacctgtgctctagcaagttgtatttttcgggaggacactacctcttcctctccctgccattggagaattgatcatggacaattctggaagatttctgactcagcaggaagagcagcagagattcaggaggcaaacaggttgcaacatagcaaagattatatgacagcccataacagagatgtggtgtgggctcattgcgtgctctgggctttcaattccagcccctgtctctgctcgtatgacctcaaacaatgtccatgagcttcctgggcctccctctcctcatccccaccattcatctgcagccttagaatttagtgaggggctgggagtgtagttcagtaggtagagtgctgcgtagcacacaggaacctgggttccatccacagcaacacataaacagggcttggtcgtgcacacccgcaatcccattactcaagaggtagaggcaggagaatcggaggttcaaaaccagcctaggctacatatcaaattcaaggccagcctaggatacatgagaccctgtccaaagaaagacaaaaagaaagaaactaggcatttgacaggaacaagcccttgccgcaccttgtacaaggcaggaacataactggggttctttctacttctctcaccctgagcagatcctactatgaagaggtcttgctgggccccgcccactgcagcggggttggaaaaactaaaggctcactctctcagctcttagcctcactgtatggtctaatgagatgggctccagtttcctgcttcctgccatgaaggagttgggccaatggctaccaaggctccttcctgtttagagtgtgtgactacactcccaggaccctggctcaggctgtggggttccgtagttctgagtagcattggtgaaggacaagtcacaccctgagacagtccgaggcagatagggggagagaaaatgagggaggctagcagttaatatcacagtcaggctgggagccttgaggcctgttagtgggcttccttgaggaagcggggaatgctgaaaggccacaagaacgccagggggataaggtggggatcacattgaaggtctccaaagggctactctcttcctgcttcctgccccctgtacctagcgcccctttgtctaagaccccctgccccaccgtcccagcatccccgaaacccagcccagtgtactctcttagacatctcctcctgggaagtgtacctttggcccctcctaccgggttagctggtgagcttccagcttcccgaggctgttatcagttcttatcagcatatggaaagtgcctgcctttactaggcaagtgcttttaaatagtaataactatgattacatttttttggagtgctcacctcaggccaaatgtgtgctgagcccagtacggacactttattccatcttgaaagcatccccttagaggaggccctggaattgtttctgcatcgtaagtggaagcaggtagagatgaggagcagttcaaccaattggtacagctggttaaaaacctaacatgtggtagagcctagatccgaataccagcctgcctggccccagacacgcctgctgcccttaccccagggcatgtcataaagatggctggtgtcnnnnnnnnnnnnnnnnnnnntttatttgcatatttgttgcatgcatgggtttgtgtgcaccacagcgagtgtacgtgtgtggaggtcagaggataatttgaagggagtcagttttctgagtccaagggatcaaactccgcaggcttggtgcgggctccttccagcagctgtctctctggccctctggaaggatcttgcaaagcccccagtgggactttttgacctccgttggtcacaaaccccttcagagacagaacaatagaagttaaaggcagaaagaacgcagcctctggctagagagcagagagcaggtgagagccaaggctgggagtggtgctcacacctgcgccatcccaggcagcctttctcctgcctcagtttctcctcacatgtaaggaattatgggtttgtggatacgggcccaggttacacgtgcacagcttgtgtggctgcctgcagaaaggaactgtgtcttcttaagagaccacaatgggccccaggtcacaaggagacagtgtaggtctgagctaaacctaacgcttcccagaatccctagcgcagcacccctctgcacctctcatcttctcttcacactttctctttgctttaggctcctcactaaccaagggtcagctcaccccccacccctcctctgcccacttcaggttctctcccccagctgggacactgcccttagcaagttttttttttcagttgggactggtgtttgaccacccacagagttctgttaaagaaaaggctagaagcatggggcgggcgactcttggtacaaggcttctggaaatagccaggtgtgggctggttccctagggtgtggttggagactcctggaaaggcaggcctgactgtgacctcattcctgtgtaaattgcctgtgggtcactcaccccagggatcctctacttctgcacgttccagggaggatggctggcctttcccctttctcttctcatacctccctcacccacgtcccagcccagaatcttctcaggcacacagcggacaggaagttcatttttatttctgttcgtctccctctcaccccccattgttcccttgtctccagccctactgttccttggtccattggccccactcctggacctcgtcttagaccccacctcactctcctgcatacctgcacacaggtacaggcccctctcctccaggatggtccccatccctcggttcagaccctctcccttcctccttcccggtctcctggcaggtccgacccccacagccattgtcttcccgaatgtcttccgtgctcctccacactcttccatctctgtgttcacagaaggcctcctctcctcatcctcactccctcctccacccctgtcagcattcttcatccctccagtcaccgcatccaaccgacatcgggttgagctgggctgggtacagggtcctcaggccttatgtgggggtggggaccagggggactgggatggggacagtgatgggggcggggcgggcagctgaggcccctcccgctctgctgctgctgctgcttcggctgctgcgcctttgatccatggcctgaggccgcctgacagtggaaaatgcggggagacaaaaccactcagtcaaagtgattcccaacaactgtctccccgagataaggactcgccgggctcctcagcctgcttaattcccactgcccggcctgggatcccgtgcagcagcagcaagctgactgacttccagcagaagcagctctgaaaactaacctggtcctgggacccaggatgggaggcaaagctagggtgtggggttggtgtgggggtgggaaaccaggacaagggcttgtgcatccagtgatctgacaggataggccctcttctctttgcaattttgggaaatccaccttgttccattttcaccaaaatgcttgcctcccttccaggaacattctcttctgccagcaaaggccgctcccctttggtctctcagcctctccaccctccactctctccagcctctcttgtttccaggcttacagtattagctctgtgctctgactttctagatagttcttgttccctctatagagcaaggtccaggctgtctggtggccagtatccccattacaaagcttaacgcattacagggacctgatacatgctcactgttagggacagagcgaaccagccttgcttggcccgtcttaagaaattacaaataggcagccctgaagcagaagcctccagagagggtggtttccagttacccccaccaaggagcacaccttcttagcatgtactatctctaggaggctgggctgggctctctatccttggcaatcaatggggtctagtatggagaccaggagatggacttctgtatggtaaggtttagaggaggtccactgataggaactttcaagaaccccctccctctccccacgatgaaccgcttcccaccatggtgtttggcaaagagagatgtttgcattcgtgtggtggcaaaagcagaggtcacaagaactggactcatctcaggagtcctgacagccagggctggaagagaaagtcctgagagccagtgagcacccactcatgggtgctggggtggagtaaccacagccggtccttcacaggcagagcagataagaccagtgccagggttttccagagctgggcatcaaaaggctctgttaaaactcaacttccagatcgatccacaccaaccctgacaggtcttcagtgggcctggggaactgattatgaaagatggcatttgtcatccggggcagcccttaggcagcctggcactcctgaacactgaattaataagtactctcctggccaggcgtggtggcgcacgcctttagtcccagcacttgggaggcagaggcaggcagatttctgagttcgaggccagcctggtctacaaagtgagttccaggacagccagggttactcagagaaaccctgtctcgaaaaaacaaacaaaacaaacaaacaaaaaaagtactctcctgtgcaatcagtcagagaccctgtcaaaggcctctttcagtatgcgtgggtccccggtgtatccccataacaccagcatctcgacccccttttctttataacgtgactctgaaacaaagtatggtggtacatgccgatagtcccattacttgggaggcagaggcacggacattgtcatgagtctgagggaagcctggagcaaagcatgagggtcagagtcccccccacccccagcacctacctaaaatacctaaaaacctggatgaagttgtgcacacttgtaatccagtactgcagaaacaggctcagaaagagcccttgggctctctggacatctggtctacccagaacagcaagcccaggttcgcttgagggggctggaaagatggcccagtggttaagagcaccggtttttttctcctagaggtcacgttcgattctcagcaacttcgtggcagatcataacagtctctaactccaggatctgatgctctcttttttctgtgggcacggaatgcatccgtggcacacagacacacccatacatgcatgcatgcacacccagacatgcacacaccactccctttaaaaaggaaaaacagaaatgactgtcaagagtatctgcctggttgggctggtgagatggctcagtgggttagagcacccgactgctcttccgaaggtccagagttcaaatcccagcaaccacatggtggctcacaaccatccgtaacaagatctgactccctcttctggagtgtctgaagacagctacagtgtacttacatataataaataaataaatctttaaaaaaaaaaaaaaaagagtatctgcctggaatggcacaaataatttgtccccagacatctcagagctgggaggtaccccagaatagcttctaaaagacaccccggaataccctgtcttacttggcacctggagaggccaacaaaccttggctgccagagagacttagcttattaggctactctgagatcaggccatgtctggacagtgcctggtaagtcacatatccaaagcagagacagaggtagtcttatgggtgaggtaacaatgaccaaagagacaggagacccatcctgccatctctctgtccctccaccctgctgtggctcagaccccagctctccaggtccagaggactacttgagctaagttggcccgaggccaaatgagcaagaccctctcatcagaccagggctttctgaccagaggcgtcagaggattaaggtcccatgagggccctggcaagtgtcttatcataaaggcgacatgtccaggctgaaatggagcctcagcgcctaggggcagaagttcctgatccccacccaaggggactccttactctctcagcctcagacattccctccctgcctgaaactcttccctgagcgccctggggctcacccgactcccagacaacttcattcttttaaaaggtctctgggggtgaggtagctgctgccttggggttctgccatgctttgagccactgagaagcaggtctgataccgttgctgtatatagtgtctgaagtaatggttctgtttggttttcactgtgttgggcatagaactctgtgccttatacactctgtacaagtgtgcaaccactggactacatcctgaaccttgttttgttttgtttttttgagacaggcttttaccccatagtataggctggccctggatctcgctatgtagctcaggatggcctcaaaatatatatagctaggtttacaggaatgcgactctatgctcagcttggcaaagcacttccgtccccaatatctgtctatatgatggtagctgaacactgaatgtcagtctgcacatttggctgactctcatgaagtccaaggcaaacatgtttggggaatgtcagaatccaaaacctagctctactgtgggccagatgtcatccccctcccatccaccccaccctccaccccccgtccatgggctatctcagtaggagggacaggcttgtcagttgtcattcaccatcactgtggctctctttagaggatctccagtgatactgtgccctgaaggtgtaccagctaggtgccctcttgtgctttcctatcccagaaatcccaacttaatgcaatccaccctgggcagcagagggtgaagaaaggagggcacatgagagggggtccccagaccaaggaccaagaggaaatggcaagggagtgagacagcccaagggctattcaaccatgaggtccatacgagctctcttgaccatcacttggacgaggctggaccaggaggtgtagtggggatggggggggtgaggagtagacagagggaacaaagaggagaaggtacatatgtatggacagacggaccagagagccaaaagtacatgtgtatggacagacagaccagagaacagcacaatgagatactgaagggagaaggaagaagggtctgaagtgacatgcacagtcatggagagagaaacagagacagagagagatggaggggtgtgggagaaagagagaggactgaaggggcaatggagactaggagccaaggcaagaggttcagtgacagcggcagaggctgggagagaagcagagaacacaggaatctttgcgtatagtggcaaaggctgctggaggaagggtcagagctctccctcaggagcctgggcgggagggcccagagctcaggcaggtgcaggaggggctggagaaccccaggaggaggagacccagcattgctccgtagtaatgggggctgggaggggggggagacacaaatgggaattccagcccaccagcaccccgctgtgtggccttaggctgccctgtccgccagagcagcaacacaggctcattctgtaccccaacccgccagagctagcagtgtcccaggctccctgcaagcaccgaccccccccttctacccacccatcccccggccatggcagggactttttcagggttaccaggcctaaaccacagatggcctagccttccagcatggctgtggcggtccccaagccccccagatccaggggtgagatgtcctgcccttttgccaagtgttttcctttagttccagatgccaccctggcaggtgcttcctgtgattaatgtcaccaccccctagccctaggaccagctcttcttccccaagccacagctggctgtgggtgggcagactcctgcctgccttttagaatcctctcctggtctctcccttccctggaacccccaatggacatagggtatagactggcttggactctgtcagttcacacagagaacctcgagtcacacggaatctcttcacagaacggcagtagagaggactctggatagctggcagtagagccaagattagggggtcttggttatcttaggaggtggctatcagatttggggaccacagctagagtaaaacctgatcatgtcaatcagagaacatcctttgaatgagaaacaatgcttaccagctgagtgatcttaagcagctgactagacctctctgggcctccaaagtcctaggtactctgaggattatgggtgtgcctggtctggacctctagtcagaagacaataatttcaattatgtacagatgaatttggaagtgcagctgactccatggtcatagagaggggtgtgtggattggagttgggggtattagtttagtattctagtttctcccccacatcccccctttctctccccttcctgcataaccatattaactaaggcattagcatccctccccagccagtgagcccctatctctagctgcatctctccagcccgaggatggcaacagacaaaatctcagctcagtacccagcctcttgtttgtttgctatggagccctccatgccgtgggcacgtttttttttgctaattttgtagctgcctttatcaaacggggattcacgggcgccttagccttgataagtggattagtctctgcgctaaacaaggaggtgtggggcgtgggggggagctgtgccacaaagatgtttgtttccggaagaatggagcctgcgttctctgccctgtgaggggcatcggagacgctggaagggccatctgcgtgccttgtctcagggcttggagctgcagcttagaacttgctacagagtaaccagggagccaagaggaggggccgggacttgcagggggtgtgtgtgggggtgagaggtggggggagactttggattctttccaggcttatgatccacctgggctcagcatgctgaacatgggagcacctgcttgggcggcaagactcctgtggtcgtccctctcttcccttaccctccagcctccacttaccgaagcccttccaagagctccattgtgacttggctagggatgcagactcagctttgcagacttctctagtgcaacagtgacaaatttgcaggccctggcactctggaagcaagaggtttgtgtctgctcagagattctagaatgttccttgggggcttccttggttggtgatctctgatgaatggctatttggggtcacggggtatcatccagtcaccccaggttatagctagagaccaggggcattacctttaaaatgtatgcgagctcatctttgctgtcagagacactagcatcagggcaagttgacccgtggtctctaggaagttccaccatggttagcttagcctgggactcttcccggcttgcgaatggcctaccagatgttgaaacagagagaggaagtgaatttctgggtgactaaggcaagtcacaaatatcagtagagtcagggaagactctgaagtaggcatagtctttagaggtcaaggcaggaggcagccagaaaggtttgctgggtaggggttggaaagagtccctgcagaagtctagagatgaaataagatatattggatatatattggaccagtacttggtccaaataaacagtgaaggcttgttgagaaagtagggtgtggggaccccccccccagtggttcctttgccctggcccttgtgtaagtggttggggtgtttagatctctactctgtgttggctgaggggcgagaacagcagaggtgctttgagagagaagggacgggtggagcagactgcctcaggccctcagctggtccttagccgctcagtctcccaagctgcctccagctgagtgtgattttgctatttatttacatgtaattattgctatgaggtgcagatattaacgctgtcaagagcaatttgctctgacatttttcactccctcagtgcccccgccactcttgatggggcccagggctctcccagcttagccaccgagcacccgctcggtggcccggcccagaaccacccagccggcaaggagctgcgtcaaagagttcactgggctcttctgcaaacccattaagctttgaaattgaatttggtctgggagagggtgggtgctccccaccctgccaccggttccaccagccaagctggccctgccttacacagacaaaactggggggggggcacaaaagggcctgagcttgtgagtgcagggggcagggctaagggcttgaggctagcagaaggcaccagagaggatggtaaagacctcaaggctcattgtcagagaggcctcggcctcacagatgcctcaggctcggccccacggattcagcctaagatgaatgggtctgctcactctctcctcaccatctggtcagccagcaatggttggggatggggtgacaggaaagcagtaaggtatagggaaggggctggcctgtgtttctccctgaggacccatctaaaaacccatagggtggtgaacacctgtaagccaagtgtcaggaggtcgaggcaggaggccagcttagctccaggccagtgagagactctgactcaaaacacatggtagatggcccggcacatctccaatatcagtgtgcatgggcacacgcagagagaaggaaagggaaagccaggtggccctgggggacaggtggctctacccatgtcataaggacagattgccttgtagccagtgaggcctctgagtcactgtggagtcagaacaggatctgtgctgacccatagtgagtccctctgatagaacttaggaaaggaattgtcttttagtttacaccttctgggttcaaatctcagctcccccagtgactgagtccattgatctactacttggcttcctggggcctctgtttccttgtctttggaatgaaaactttgtaattgtttctttttaaaaaaaaaaaaagattgacgtgtgtgtgtgtgtgtgtgtgtgtgtgtgtgtgtgtgtgtgtgtatacatgcaggtgtgtaggtgtgtacagcaacccttggaagccagaagagggcaccagatcccctggagttatggggtgtctgagcctcctgatggaggtactggggactggattagagtccccactctgagagcagcaagtgcttttaatcgctgagctatggctccaaccaacagccgttttctcattaggctcacacttggctgggtcaaggctatgggatgggtgctgatgtgtccttaatctgaccaggagctgtccacagaaggctgcagtcagcatcctagcagcctgcccatttggagacatctgatgggtggaagggacgggcccatttcagaaaaattgaagggtgcatctctgagctggcgtctttccagttgatgggcaagagtgacttcctgcacatagtaggtgggaaggagtggcttcctgcacacaggaggtgtatagcaatgggagcctgtcaagtttctggggccaaatggaagaagaaaccgggacccatgggtccttttaccctgctgtggggaattgcctctgggcgagcagcaggcctaagacatcatggctgcaggtccctaacgctctgtgatgcatgccagcttgtctgcccagatactaatgaggcctcactgccaccactcagtccccgccaccaccaatcttcattcttctctctgacaattatgaagggtacccacacacacacacacacacacacacacacatacacaccagggggaactgaggcccactctcgtttccctccccctccccaccccctccttcccctcagcttggccaattaggcccctgacacctggagccgctgacaaactgtttctgtcacttgctctctgtctttcattagggcagcggaggagggggagcaggagagggaggggagagagatgggatctttcatgcttagtaaggccggctacattaattacaaaacggccatttgccgcgtgaaactctgctaattaaatttatgcaatcattatctttaaatagtcatatctttcccagcgatcggctggtcccttccttccccaacccctctgccactgctccaagccgtcactctaatcccctggctgtgtttatccccgctatcagagacgctgctcagtttcatccccttccctctctccacccccaccctacatggacacctccaaccttggccagcctaaggatctatccagggaggggtggctttaaaaaatgccgccatgattccagatccatccagatgtttctagacatctggagggtagtgctttgtcaaccaagtacaggatgtgtatctgttcttgacttccagcaagaggtcattctgtccacacctcctgtcctgtctccctcgctcctcagactagggtggggtcctctgagaatcttcagaatgggggaggggcataagcatgtcacaagacccgcttcttctgattttcattaggcaagcctggcacgtgccagggctgggcaggagagaaacagatccagtccttggaccctcctaaacttgctcattcatcaaaatgtttgttggacacctgctgtgtgccaggcacctagttggtccccaagcagctcctgcccatccaggctgctgtgtctggccaccatagaatgtaacatataagtgctgagggggcacagcagcacacaggatcagtatcagcctgaggcaggggagagtatggggctgtaggaaaactgggggctgcctctgtgaggtgaggcgacagccaataagatcagagcatccccctgctgggccttccacagtctcttctgatgctagccaggaaggccttctaaaattcccacttcctccttactccaagggaccttgcctgaagtccttcccctgtgcacacacacacacacacacacacacacacacacacgcaccaaatttacaagtgcttgtgcacacgtatgacaaacttgcacatgtgcataagcaatgtgtccatgtacacgaagataaacagtgccacgtacacaaacacaaatgtgtaatattcctgcacgcacaatcctgaatacgatagtcctttgtgcacatacatgcacacccgatgctcatgcatgcacgtggttagcagctaagcaaacatgcacctggtacatacacatgtacatgcacatagagcccacacacactcacacaacattcacatccatgtctatgtgcggacggacaacagtctatatggtaatcccctgtgtacaccatatgcacagctatcacacgtatacatggctaatagccatagacaggtatgcgtaatacttacatacacacatgtgacccatatacagcccagacacatggaggacacagccatactgtgttcttgagctgtttagttaaggatccctcagcacagggacagaccagagcagttggcctgagcctcagcttcctcatctgcagagtaggctaactgtttgttagagtagacaccggccttgactgggacatgctctgggaaccggagggcactctgctccagcacgtgaagaagaacctcacaggaggcaagagggatgcaggcatggggctgccatggaacatgggaagtgggggatggggtgcggcccatccagacacagcaatggctgctaaaggggcggggccgggagacctgggagaaatcttgtttggaagttccgactcagcacccgaagcccattacagctgtccacagggggtggagggggcgtagatcctcttagcagagaattgagaggagagggtagcttcggtagctgcctgcctgcccgcccgggtgggggatttctcacttgcactaatcccagctggggacagacagggggccagcatggggcgggggggggggcaggtgtgtgtgtgtgtgtgtgtgtgtgtgtgtgtgtgtgtgtgtgtgtgtgtgtgtatgtgttaggattggaaggggtgagagatgcaaaggtctgcacggggaagctggggaatgtggaggtgagaggctgtggtgtatggaggtaagtgtggtatgtgtgtgtgaatgtgtgtggtgtggtatgtggtgtatatgtgtgtgtgtgtgtgtgtgtcgtgtatgtaagtgtttgtagtgtgtagtgtgtgtatgtgtatgtgtgtggtatgtggtgtgtggtgtgtatgtagtatgtagaatgggtgtggtggtggtgtgtgtgtatgtgtgtgtgtgtgtgtggtgtggcatgtaccccaagggactatggctatattttggggctaccttgggtagtgatgtagccacttggtgaccactaaagtcatctggggatatttaaaatattcctgatacccagagaggtgacaccagaggatggccaagggagaagaatggagcttggagtgtagttctgttccttttctgtgctcactctaccctgatggagggtgcttggacccaggggtaccccagttaagcccattctcagggtagtctctggtccttcaagacatttttttttattgcacagctccaacaaatgctgccttccattcctggcattaaaacaggctgtgtcccatatgtccccactctgtcccggtcactctcagaagtcacctgtgatgtgttagcaaggtggtgagccaaggatggaactggaccggttggcagagaagagcaggattctctgccactcggagactccttcatggccaaatatagtctgaggatgggagtaggggaggtgcatgggagtcagtaagacacttaccaaaatgtgtgtgcagagataaagggcgttcctgatgctaaggaaggtcttaagtttggggggtcagaagagagtggtaccatttatgtggctaaatttgcctgtaccaaggtatgagtttctgagcagctgaagactaagagacctcataggcttgtcccaagtccctccctccaccccctcctctctgaggataaccaccaccatgcctgagggggtgtggtctgctgcagtggtccgtacctgctcccttttggagagtgcagccaactcctaggtgggactcattccagagcagagccaagcttccagcttgtgggcagggctaaaaaggacacattcacccaggtggctggagaagggttccctttgtctgctatcttaggttcattgccatctcagggggttctggggaccctccttgctcctctgttttaacccaggttatagcagaagcctgcagggagggaggactggctggctggagggaggtctgaacgggatcttttcccattatagagataagaagactgagtcctaggaggtttaagaacttgcagcaggggtaggggtcagggcacagtggggtccctgatttggtcttgagtcccgaaactaaagtaactatttccgaagccaggcatgggagtttgtaatcccagcagttgcctgtggatacagggctatatttacctgtgtgtggaggagttcctgggcagccttagacaacacgagacccgatctggtagggtagttgtgagttcgaggccagactggactagagtgagacattatctcaaaagacaaaaaaacaagcacccccccctccccaggctccaagagcactccagctttcttgcctttagctggtctagggcccttggggaaagggccttacttctcaaggcctcagagaaggaacagcctctaacctacagctggccacagggttctttgacctaatggcaacacccctcccatttaccttctcagtcccaggcccctctccccaccaccccagagcctactgcacggctccggtttagctatggcacctctcatttcagttttgctccccaagctgcgctgggttatcagaaagggtgcagagctccaagctcaggctccgccatcccaggccctcaggccagctcaggcacggagggaattaattacattctaccatccccttttaaagtaggggagtacatcagggcgtccacagaggagaggttgcagcgcagaggctgtggaagggaggggggccacccctgaaagcagcaggcctctccccaggggcggaagggggtgggtgaagctgggccccttattgatttagccaggttcaggctgggactgatttggggtaaggggtggggggtgggggagatgctgagggttgggaagggaggggggaagggaggaagaagagagagaggaaggtagggctgtcagtcaggctgacggacagcctagagatttgccttcagataaaaccttacagatgtggaggtcagtattgattttgagttagtaacggtaccttaccaagaagtaatacattagtgagagcaaggtcaccaggaaaagcaagccccaccgtgaggccgcggcattcctgaaggcgtgtacattaccgcatcagaccaggacttcctcaagttcaaaagtgtgcaggcccagacctcctccgctgggccctcactgtgggtaagatgcttccttcctctgtggcacagagggactttttgccaaaggtccttagggctctgtaccatcagggcttcgaagaaccccccggggagcacccacagagaagccagagacccaggcatagacgtcagagtggctgctggctgactgtgtcaagctccatgggcctctcactccctggtgcctcagtttccccatctacagattaggggtagaatacccatttgctagaggaaccgctgcagtgaccaggtacaaccttggtggcggaggtttttcctctatggtggccacctgggatctcctaggttgtgccctgtctgtttcctgggaagttgccctcctgcagatgaaatggaaaccacttgatccaggagcctccagggactcagagtcactattcacacctaccccagatgtggatttgacttgatgttccaggccaaatcccattgagcaaatcccattatgggaaaagctccctgggccgagctgtctgttagctggcagggtccatggccttcagagccatcgggcacaacacacaccccttccaacaaagggctgcaggaggccctgccccctcccgagtctccttcttgtgtagccctggctgtagaccaggatagccttgaactcacatagatccacatacttctgcctcccaagtgctgggattaagagcacccagaaacatgttcggcctaaaatatttttaaagaagagttcatagctggggggtggtggctcatgcctttaatcccagcacttgggaggcagaggcaggtgggtttctgagttcaaggccagcctggtctacagagtgagttccagaacagccagggtgacacagagaaaccctgtcttgagaaaagaaaaaacaaacaaacagacaaaaagcaaaagaagaattcattattttccattttacgtgtgtatgtgcctacatgaggctgtgtacgcaggtgcccaaagagaccagaagagggcactggatcccctggaactatagtttataggcgactctgtgctgcctgatgtcggttctgggaacttccacagtggtctccagggtgagaagttatgctctttctctgtctacatatttgattgacagctctgagagggatctgaggttattcttcagaacatcctagtgatcgacttagtatccggtacataataaacactcaataaatatcattagagccctatttgtgaattcagcgagcacttctgagctcattgtagacagtggaccagaagcaaacactgaggctgcagaggataacaacacatactttgggcccacagcaatgtcccatggcccattcattagatgataaatgagtatataaatgttgtctgccccgggcaatatacaatattgctgaattcccaaaggacaggaggaactgagctggcagagaaagttcagaccacaagaagcccttgctggagcccttcggagttcttgggtgacatcaggtctggccactgtcctgtgtgagtgtcagttgtagagagtatgtgtatatgaggtctctgaggtaccacctcctctccgtaccttcctttctccttcttcccctcccaccatcttttctgagctggccatcttggtaaagggcagtatggagagagtcaaactccttcaggagcctcttccagaagggaaggggctgatgagctgatccctagggcccagcttcctccaaggggaagcaggctctgtctgtggtgggcaggatgaccgacagtgtcatcgtctaggtgagagcgttggatcttggttgggaatcaaacatcattgggaacagtggggtctcccagaccgagatcccgagttcaccctgaagcccctgcattgcgccccacagcaggttccccaagcttgggacacccatctccaagatctgaaaggcacagatgtagttcagtgtttaggtgtctccacatcctaaaaatccagcacttcgctattgatcctaacctgacagagatgccagaggcagggtgagtctgtgagctaggcagacagacagcacaaagtggtccaggggcatccacccaacctcagatctcacttcacacctccccaaagacatataatatctttgccatcttggggtggaccacagggttccatccaacctaaaaaaagaaatcccaccagcagaacctgtggacagcctgccctgccccaccccacccttggctctggtttggaccaagtactcagtttataaagtttaggtatcaaaggtggtgttctatgccccccccctcctcaggctccccaagaaacaggtgattgcatgaccctggagtaggatcctccaaagggcttggatgagtcaactcggtccttgggaatccatggctggtgatcttagccatgaaccaggcaggccctagcctgctggatccctgaccactagctaggagatatggtggaggcatcgctctctgtggacctcactgattttatctgacaaatgggttcttagctctgccccacgtctccatagttctctggattggagacagcatgcaggtgagtggctaagaagaggtttgaagggaggggcaactgaggaggctcgtgagaacaggatcctattttcccacctcttagccaggctcaagggagggcatgtccctggcagagatcccctcagcctccagtgcaccctctgactcagccaccctcgcaaaccctttccccaggatttcagaggtcatgggatttcctggctgtccacacccactcagacacacagccgttaagtatgagaactttgttctgcccaaggcttatagaacctgtgtgtctgcccttgacccgttctcctgcccctgagtctgtgcaggacaagccactgggaaaaccacttagcccagagcctctttcctatagggtggcatctccaggaggtcaccggaggcctgggacccacagagcaggtctttgaggatatgcttatttgacccctctgggtgactgtgccctctcaccctgtagggtcatcacttacactgtcaatccctactgtcccttggagtgctcggtggcaggtcctaccttctctaaagctctttggaccccaggcagtctgggtgcactccatggcttccacagccaaaagctatctctatcaaatgcctcaatgctttcttgtgctttggggaccttcgctcattgccgagatctttctgttcatgcttccaccgggacaggggccaagacccctgatctgaaagttctgtggccttcagcctggggtgcggggatagacttatcaccagtacctactgaatgactaagcaagcaccccagtggtccaacatcccatccttcagggtgagtctgggggtcccacaggccaagcagggtcatgggtgaaggccagagaccacagggtctgacagtcacagaatggtctcaggggagctgttaaaaaacgtgggccttgggctggcgagactgctcagtgggttaaggcacttgccgacaagcctgacgacttgaactctatccccagaacccacgtggtggagggagagaactgattgccgtggattgtctcctgatcaccacccgcaggctatgatatgcacccacacccacaaaaatacataaatgaaaaattaaaagcaaaggctttggactttgacagagcagaggcgggagctcaaagtccagaaagtcgtgaatggcaccgggtcttaagcacagcacaggcatgggggcgttaaacgaggaagacgagtgagtgtgtacatgtgtgcgtgtgaagatgggccatcccagtgtgatgcgggaggcacggccctctagctactggaggaaagctccgtgattgtccagacaccatcatctagataggacactgaggaatgtatgcctcaattcatgcacacattagttcattcatttattcatttgcccctttagctgataggcccggggtgtccattagctagtgagtgtatttgttcattcatgcatgcgttcattcatttattcatcccttcagctgatagctccgtgcaaatctatctctcattcatgtgtgcattcattcattcagcctgatggactgtaggttaagcatccctgataggccctaagtgctacctacctacctacagcccgttcactcattcattcatccattcattcatccactagttcattcattcactcactcattcacttattttcttactcattcatttactcactcattcattcatccactgattcattcattcattcactactcattcactcactcattcattcatttacttattcattcactcattcattcatccattagttcattcattcactcaatctttcattcttaactcatttgttcattcatccactcattcattcattcattcatccactcattcattcattcactcattcattcactcatttactcactaattcatccattcactcactcattcattaatataactgatctatccagagccttgtatagttagtgcatttgttaatttacatatgtaaatacccactcatttgtgcattcatccatttcttcactcactcagctggtaggttcaggatgccctttatgaagttagttcattcattcatgcatccattgactgactgattcgttcattcattcattctgctgataacttcgagttcctcttatctagctggtgtcctcattcattcgttcagctgataggtccaggttccgcttatctagtcattaagttatcattcatgtctgtgggcgttcatcaagccattcatccatccagctgataggttcaggatgtcccttgtgtaattagttctttcatttctgcacttattggtttattcaggcatacattcagcagaaagtagagggtaacccctcaaactaggccatagggacatagaagtaacaaagcaagcgcctgccctgctcccggagctcttactggaaaacagccccttgggctcccacgtgggcaggaaaaacactggagatgagctgccatttcccacactaggctgtgatcctgctgaggtctgccctgggcatgtgtgggtagtgtgtgccctgacctgcctgatccctgcatgctcgtgccccggggtccagcctttggtatgcattgcctatctctcctgcaggtcatgagcatccttagcaacccgagtgccgtgcctccacagccccaggccgacttctccatctccccgctgcatggaggcctggactcggcttcctccatctcagccagctgcagccaacgggccgactccatcaagccaggagacagcttgcccacgtcccagtcttactgcccacccacctacagcaccactggctacagtgtggaccctgtggctggctaccagtacagccagtatggccaaagtgagtgttttccttgctacccatctctaagggggctgactcattcctgggcaaggcattggtcagggtggagggtgtctttttctttagaagaatttaaaatttatttcatcattttatgtgtatgagagtttgtgtactatatgtatgcagtacctgcaggggtcagaagagggcatcagatcccctggaacggaattacaggtggttgtgagccattttatgggtgctggggactaagcccaggtccttgacaagagcagccagtgctcttaaccactgagccatctctcgagtcctctattaaaattaaattagcgtgcatgtatgtgtgtctgtgtctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcattccgacttagtggcttttgttgctgtcctttggtggtactggggaattaaacccaggaaccttgcccaaactaggcatgagtgccaccactgcgctacatccccaaccctctacttactttatatttgcgacaaggttcacaaagatctccacactggcctgaactcattctgtagcccaaatggggcttgaacttgctatccttcatcaacacttaagcttcaggagggtgctagtggggacacaatgctgcacacccaagcctttctaaacaggctcatagggtttcaacaagaaccaactaaattaaagaccagattttacatttgaatgacataaaactaagtaaacatccttgagtctgctccccatggtgctaggcgcaggtcaagtgtaggacagctagcggcatgtggcacgaatgcaagaggatggctgtgtacagactgctctctgtgtgacaggcctctcaagtctccagggtctcacatacccagtccagccactgtccccttggtgtcttggcttgatagagcaacagcagactctcagatcaacagctgggcgagcctggcttggccgcaacttctggccgtcgcctgacggggccagcagcagggcaggctcagacaggatgggggagccaaaggtcacaaggctgccctcgcgccacctttcagcaaaggcctcacctgctggtgtcaaactaatcaggagggtgtgtggagagagtggggcctccagcctaagggcaccctctccagctgctgcctgctcctgccacactgacctttgcttccttaggcccccagcccgctccaacctcatggccttggcctccacggttaaatgagggccagctgtgtgggcctctacctcccatgtgcgtatgtgcaagcttgtatgtgtgaatgcatcacgggattgttacagtccaaagcgtctgcaggcacactgtgtgcaagtgatatggctgcaaagtgcccacatcttcccagataagtgagttgtctgtgtgtgtgtgtgtgtgtgtgaacgtgtgttgaatgtgtatacgtttacatgtaactgtacacatggacatacaaatggctgttctgtgtacacattgcatatgtgtatatggctttgtaggagcacacaggcacacatacatgtgagagtatatggtggcaatatacacacatgtttaaattttcttaggtgggttcttatgggctgatgtgtctatatgtgtgtgtgtgcactggcatatgtgtgtgtgtgtgtgtgtttgtgtgtgttgaaagtgtacgaccaatatgcagataagtgtggttgtgtgcacatgtatattttggcatgtacttgtgcttaaaggtatctatgattaggtatgacttagatgctcgcatgaacatgatatgcatacctgggtgtgttcatatgcagtgcctgggcatgcttgtgtatgcaattgtgtgtgtgcctatgggagtgcaggaccatgcctgtgaatgtgtgcttgggaagcccagcactacacgatcatctgcatgcaggacacaccagtgtccatggaagcctttccacgccgtccctggttgaccccctgacctagcgcatgttcccagtccaacacaggacacacatgctcttgataaaacatttgagagcagcagcggcaatgtggccggccccgggcaggcgttagtcacacccggagcctggagcccctgccctgctccagggcgcctgcccaattcggaaataaaattaaccccaaagtcagcatgggggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcagggagagctcagggctcctcaagggccatggtctccagccacttactgaggcacctcggccaccatgtgtcacccagctgtcacacacacccagcctcagctttcccacctgcagaatgggtctggggacgaggcacatcctctcagccatttccagccacactgcctttttttctgttgaccttctggggcagtccaaggacatgtcacatttctgttaaccagcagccaacacccctaagcacacaggaggccaggttctctaataagctttgaaagtcacacattctggactcccctgtgttggtcttgatccacctgtcacttgctgcctcctgtcccatgcttgagtttagcccatgcagctctgtgtgaaatacgtgcttctcagccacagagcttccccacctcctggtcctcagtttgttaggctcaaagaggtagagcagtgttcccaatgtcccacagccaggcagttgtgattcagcttccttacctcggagcacaggtgagccagcctgggaaagacacttggcactgatcgggtacacactctcccgtgtgcacgctcgtgtgtgggagtgctgctgtccatgtgcgcagagtcaaggtgtaacttgctaaatgcgtatgcagggaggggagagaaatgattgctagctggcgccccatctctgctgccacacagggctgtgtgcatggtcattctcactgtcttagtatagaaatgagacttagagaagttactagagaggggttggttggctttgttggtggccacacctgcatcctggtcattaggagccaatttcaggtgtgtttgaaacatgcacgtgacctaactcctgtgcagcagaccccgcctgcccctggctcctagggcctctctccttcccagagacacctccacatcttctggctctggccaagtccatccatctgcccatctctaaccgtccctggagtgggtgggggcaggggggcagggatggggcacatggtagattaatatggccccggtgttcccagaggccagggccatactaatgatggggctgatagaacgcaggagtgtgaaaagaattttaatagatctgacaactctaataagaatttgtgtctggaagggtcctcctctggggctgcgctctgacgagctcctgatggctgggatctgtttactggttggcattgctggcccagctcctgccaactcttgattaatgtaattggagacgttcagagcccaggcggggtgtgaggcaggagaagggagacacggagggacagaaggacatccagggttgttgacagagtccctaatgaggaatgtcaccttcctgtcttcttgtccagccttttggctctaccctaggaagaggcaagcacgccctacagttggcccgttgggtgctctggaagttgcagggggtcagcaggaaagtttggcttctgagtgcttccttgcctacctcaaggagggaaagttcctactgtgtactggggcagagtggatagaggtgccagagaaacgattctttattttgttttcctttatttatgtgtgtatgtgttcatgcatgtatgtatgcattaatgtgtgtgcagttgtgcatgtggaggtcagaggtcaggctcaggtctcacctgtagacactatccccagcatctctcactggcctggaacttactaaacagaccagcaggcatgttgtctattgagccccagggatccagatgcctctgtctcccctgggctggggtccagacaccaccatgtctggctttcctgcatgggctctagggatccgcttttcctgtttgcacagctttgtcgatggagccgtgaccatgggtgcccatgggtaactctgggctggcaactgtgctgtgcctcgggttttatttttctcaagtgggaactgtcctgcccaaggcacagaacccaccttcccctagtatacagtaagtgccaaccaagtgtgggctctgcctttgctgttagcatggctcagtgatggacctctcagacaccccatccacggaataactgtagtggtcgtgtcagggcccagcatgggacaggctgaggcaaagtaagccacagctccctgagactaaagaaagttcacctgaggtgatgtgtgctcttggtaaaccttgcctggagtggaaaaggtcaccgtgggcatgtggggtgggcggagggcctcagtcgtgagggctgtatgcacaccaggggccattgccaagatgctgataccacaagataattcccaggggctgctggtgaggcccaaggctatggagctgtcaccagcctgcctgagtctgaaagtgtaagaggaaccagctgattatagtcagagtctctagagaccttagttctacatttcaccaaacagggacaggggacagtcccactatctggcttatatgactggaaaaatacctaaaagtaccctgagtacagcattgggagcaggatagcacagggctaaatctctggggtttctgtttctatcccttcagccctctaagagggtggcttactgatccatggaccctgacacccaaggagaaatgacagtgtgaccagagctttaaagttttccttcagcaagagttggcaactccccactccccattcacagccaggcaagggtggccatagctgcctctgctctgctaccttggagcctgaggctgagtgagtgacgtcaccagcccaggaactcagcatagatcttcccctccactcacccactatgagcctggctggagaggcacacacacgattcaaagacaccccaggacattttcatagcctttaggagtggggaggcttgtcctgagccttctatgacagcgtgtttaaaaacagtgtctgtaccccagctttcaagtagataaactaacataaaggaagaccagtttgctcaaaaccatatgactgggaatgcacccaggaatggccacccttttctccatgccaccgctaaaggtcacatttcttctaggcctgcgctcacaagcaccacactctaccttcacactatgtgtgtggattctttgcctgcagttctttggttcatatgctccatcccatgatatagacaaggaaactgaggctgaaatgctatggcccaggtcacactcaaggttgggaggcaactattgagattgtccctttggactccctggtctcaccatcaagctgtgtcccctgcctcctggctctacctccccctgccctgctttaagcagaagatgccacgcttggggaagcacagagatagtctacagggagccctgaaaggcgggtaacagagggagccttgtgactctccgtgcccagctttcacctctctatgcatgggggttctgtgggggcacactggttatagtcacaagacctaaaggccctgggaggccctggacctttgcctgtccagtgccttagtcaggaaagatgtctgctagagcttcaattaggacagatccacatgcttcgcaggccagccattgtagttgcacatgacagacatctgtgtcttcctcaggtgagctcttatgcttgcaggacctgtgtgtgcataggtatctgtttacaaggagcaaggggctcacacaggtgtgtgtgtctgtatgtgtgtgtgtctcaaatgggcatgggtaggtattgttatgtatgaatattcatgctatgctcagcattgccttgtgaagacactcctttcccctacacacagacacacacacacacacacacacacatacacacacacacacatacacaccactcattttcacacgcatccccaccaatgctcacaggacttctctggagctggcaggctgtgggtttcagctctcatgttttctctcaaaggccctcttggctcacttgcaaaagccactttggctcttgtgcaaggaccctgttgtgcctcatgcatacctgcactcagggtccagaaaaggtagagagccttcatcctcagtgttaacctggactcactcagccgggttcactggccaggatatgcaaatggactgagggagggaagcttaattctctactgaaatctgggatgtgtacgtgtacttccctttagagccagaaaaagagcagacaaataataaacactgaggaaatatttgctgagagggtgggaaagagatttataagggaactatgggtggaagaaggatggagggtgttctcattttatttctgttactgtgccaaataccctgaccaaaagtaacttagggaaggaatgggttcattttacttacaatgacatgtgttacagttcatgataacaggaagtcaaggcaggaacttgaattggtcacatcatacccacactgaaaagcagagagaaacaatgtatccatgctgtctacttacttgcctttggctggcttcattcttaatacaccttagggttccctgcctagggaatggtgtcacccacagtgggctgtgtctcttaataaccaattagcagtcaagacagttcccccacagacatgtccacaagccaacctgatctagacaattcttcaactgatgctcacctcccaggacattttaggctgtgtgaagttgacaataaaaattagccaacaaaggaaagagggactgatggatagatggtcagaaggatgagtgggtggacatatagacagaagatcaatgaacagaagaatgggtagatgaatagtgtgggtggaagaacagatgagaagattggcaggtgtgtaaagggaagacaatgcatgtggatgattgtgaagaagaatggatggtggaaatggatggatagatcataaggtttgatgggtaattaaacagggatggatggatggatggatgggtgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctggaagtcccttgacctctgaagtcgtgggtgccctggctatgggtgtaggtggagcccatgggtgtcctcagtcacagagctgggagctctctctcgctcgcttggcatcaggactgcagcctctttcactggacactgagatgagtccccagggtgttcccaggggagaaagcaggtaacatcccagctttacctaggaatccagaggactttgggactgtcccaatgcaccctgcagggcatcaggagaccaggaagggattctagcagagggtagggggcacagaggcagagctgattgcccatgggctatcccagaatgcctggtcctgaatctagcatcaggaggtgcaggattcctaggctgcaatctgacagaggcttgcccactgtgtcaggcctgggcagcccacagaacctgtcactctcctcaattggtaggagaagaggtcttgaggtgacaggaggcagaaggcaggctcagacagtcagagagcaccaagttttcaagtccgcacccctggggttcggcataccatcttgctggcagctggaaacctggttccctgaaagggggcctccatcctccagaatgtaaggctcttgatgccaccggatgcagagagccttctcgggccagacaaaattgctgctccaccccagagaagatgttccagccttcttggcatcttagaggaaggccatgtcgctgtccttttcagagtagcatatttttcagtgatggctgctcagtcaggaggcttctgtcgccttacaaagcacagtgcgctctgggcactgtttctaagccaccccatcccacccccacccccgccaccccggggacagaggaagatgctaaaagtcccagcaaagaggacaaagcacctttcttaagcactccagagtcttccttgtaccccgccctctcttagagctgggtcttttgagggaaacggattgctgagccctcccccccaatcctctcctctgtggagctgtttatcatcctctatttatcaaaatcgcatccatctttaccctctccttcactatagcctacttctggatcaccctcatccagtgctggtaccccacagcactaaatccaggaaccctgggcttgatcacctgttgccacctgtacacatgaaaccacctgctggcccggcccatgtctcctgccctcagccagcaagacattcctagagagaggaactatgggctcaaaagccccaactgacttccttttgcctggggacctgaaccgacaagacaccaggggacacttgtctacatgaacatgtgaccaatgtacaccgatttctcatctctagacctattatctgaagcctgtcccgggccatgactagaatggcttgtatctgtggtttagagaagtctaataataactgagggcaaactgactctctggtagcatggagcaccaggcggatggagctcacc

SEQ ID NO: 1982 - DNA, 1465 bp, Mus musculus
atggcggcgctgcccggcgcggtccccaggatgatgagacccggcccggggcagaactacccgcgcaccggcttccccctggaagtgtccacccctcttggccaaggccgggtcaatcagcttggtggggtcttcatcaacggtcgacccctgccgaaccacatccgtcacaagatagtggaaatggcccaccatggcatccggccctgcgtcatctcccgtcagctccgtgtttcccatggttgtgtctccaagattctgtgccgatatcaggagactgggtccatccggcccggggctatcggaggcagcaagcccagagtggcgactccggatgtggagaaaaagattgaggagtataagagagagaaccccgggatgttcagctgggaaatccgggaccggctgctgaaggacggtcactgcgaccgaagcacggtgccctcagtgagttcgattagccgagtgctcagaatcaagttcgggaagaaagaggacgacgaggaaggagacaagaaagaagaagatggcgagaagaaagccaaacacagcatcgatggcatcctgggcgacaaagggaaccgtctggatgagggctcagatgtggaatcagaacccgacctccccctgaagcgcaagcagcgccgcagtcggaccacgttcacagccgagcagctggaggagctggagaaggccttcgagaggacccactacccggacatctacacccgggaggagctggcacagaggaccaagctcacggaggcacgcgtccaggtctggttcagtaaccggcgtgcccgctggcgcaagcaggcaggagctaaccagctggccgccttcaaccaccttctgccgggaggtttcccacccaccggcatgcccacgctgccaccctaccagctgccggactctacctaccccacccaccaccatctcccaagagggcacgactgggtggagtttcaaggcggcttttgctacttgctaaggacctctctgggtctctcctcagatggaggcagcacagtacacaggccccagccccttccgccatcaaccatgcatcagggtgggctggctgcggccgctgcagcagcggacaccagctctgcctacggagcccgccacagcttctccagctactctgacagcttcatgaaccctggggctccctccaaccacatgaaccctgtcagcaatggcctgtctcctcaggtcatgagcatccttagcaacccgagtgccgtgcctccacagccccaggccgacttctccatctccccgctgcatggaggcctggactcggcttcctccatctcagccagctgcagccaacgggccgactccatcaagccaggagacagcttgcccacgtcccagtcttactgcccacccacctacagcaccactggctacagtgtggaccctgtggctggctaccagtacagccagtatggccaaa

SEQ ID NO: 1983 - protein, 489 aa, Mus musculus
  VARIANT (1)...(489): Xaa = Any Amino Acid
MAALPGAVPRMMRPGPGQNYPRTGFPLEVSTPLGQGRVNQLGGVFINGRPLPNHIRHKIVEMAHHGIRPCVISRQLRVSHGCVSKILCRYQETGSIRPGAIGGSKPRVATPDVEKKIEEYKRENPGMFSWEIRDRLLKDGHCDRSTVPSVSSISRVLRIKFGKKEDDEEGDKKEEDGEKKAKHSIDGILGDKGNRLDEGSDVESEPDLPLKRKQRRSRTTFTAEQLEELEKAFERTHYPDIYTREELAQRTKLTEARVQVWFSNRRARWRKQAGANQLAAFNHLLPGGFPPTGMPTLPPYQLPDSTYPTHHHLPRGHDWVEFQGGFCYLLRTSLGLSSDGGSTVHRPQPLPPSTMHQGGLAAAAAAADTSSAYGARHSFSSYSDSFMNPGAPSNHMNPVSNGLSPQVMSILSNPSAVPPQPQADFSISPLHGGLDSASSISASCSQRADSIKPGDSLPTSQSYCPPTYSTTGYSVDPVAGYQYSQYGQX

SEQ ID NO: 1984 - DNA, 133955 bp, Homo sapiens
gtgggactccatctcaaaacaacaacaacaacaaaaaagaacgtggcagccagagccaaccctgcatttgccctgcagagcccattctgcagatgcaactccaatatccttcagaatccaactgcatctgcccagcaagtgagactctttctttctttgaaaccaacattacctgggtcaataacgataatctcgaaaacatgatgttgagcaagagaagtttcagaatgatgcctaaagtatactgttacataaactgtaaaaactgtttattttaatatacatatgtagtaaaaaatatgggccaggagcagtcgctcatgcttgtaatcccagcaatttgaaggccaaagcaggaggattactttagcccaagagttcaaagccagcctgggcaacacggcaagaccatgtctctacaaaaaattttaaaaactagccgggtatggtggtgtgtgcctgtagtcccagctacttgagaggctgagaagggaggatcgcttgagccggagaggtggtggctgcagtgagccgtgtgtgtgccactgtactccagcctgggcggcagagaacctgtctccaaaaaaaattataaaagcatgtatattcgtttcctatggctgctgtaacaaattcctaaaaacctggtgactaaaaataacaaaaaattatgctctcatggtctggaggtcagaagtcctcaattactatcacggggctgaaatcaaggtgtcaggtgagcagaacgcgctctctctggatgctgcagaagagaatccctcccttgcttcttccagcttctagtggctgccggcattcctagacttacggccacatcacccagtctctgcctccatggccacattaccttctcttccatctgtgtcaaagctcccttttcttccctcttataatgacacttgtgattgcatttaggggccaccaagaaaatccaggataatctccccatctcatgatctgtaacttagtcacatctgcaaagaccctttttcatttgaaggtaacacttacacgttccagggattaagaactgatatttctagggccgttatccaggctactacaaaatgtagagaaacgacagatgccaccttagggagtgtgcttccttccggggagagaagaaagggactgaggcagggaaggggtactcgatggtgttgactctgtccctaaatagttaatggtaaacatttattaaaataaataaataacttaaagtttaaaattttaaggcctgctttctcctagctatgcaaccctaggcaatttatttcacatctcgggacctttatctcctcatctgtcatataaggatgccaatatctactccatggatttgtatgagaattaaataatataatgaatggaacatgcctaacacagcgtccggctcattgtgagtactgagttaccattatgattattatttttttaagacagagtctcactcttgttgcccaggctggagtgcagtggcatgatcattgctcactgcagcctctgtctcccgggattctctgtcttcaagggattcttatgcttcagcctcccaagtagctgggattacgggtgtgtgacatcacacttggctcatttttgtatttttactagaggtggggttttaccatgttggccaagctggtctagaacttctttttttttttttttttgagacagagtctcactctatagcccaggctggagtgcagtggcacgatctcagctcactgcaacctccgcctcccaggttcaagagattctcctgcctcagcttcccgagtagctgggactacaggcatgcgccaccatgcccagctgattttttatttttaatagagacagggtttcactatgttggccaggctggtctagaacttctgacctcaggtgatccacccacctcagcctccaaaagtgctgggattacgggagtgagccactgtgccccgccaggctggtctagaacttctgacctcaagtgatctacctgccttggcctcccaaagtgctgggattacaggtgtgagccaccgcccccggcccatcattattatcgttgttgtggttgctacctttctgaaagtgaggagcattttctacaatgcacctgtgggtgccaacatgtgcatgagggcacacacacacacacacacacacccacatgcaagcgcatgaccctttctgatgagagaaataagtttttctgctccaagccctggtttctgaaactcagcattggtaggggcgtgggtactcaggcgagctggaaactacaatggtagaagcggggggagccctttgcaaaggtactttttgatctgctctaactgccactatagagaattagatggaattcatttttatgatgaaggaattaatggctatggagagaatcgggttcaggtggaagacttgaatccaaagaagggaataaagccttgaaattcaaatgaaaaattattatataagcataaaggaaacctattttacacctgtaagactaaatgtataaatatgaaccaactgctccctctgggaaatggggattgtgcttttaattcacctagacaaatatgcagtgcattctcacttccatctatacatttcaatgaagaccgggcacccgccagaggctcctgagtacccctagactggccacctccttccccaggctaagcaccttctggcccagcaaaagcctctctggcttccccagaactcccagaaagcaagtgaggctctctaagctgcaaaatccttgagcaagggcatgtcaaatgctgcttcctggcagtaacattctctgatcctacagtcccacacccccaccaggactcccaaggcagtatctaaaatctcacagtcatcagaatgtttcagctgcattccgtcattcaatcattcattcatttaataacaccgctgagtacccaccatgcaccagtctctgtgctcagtgttgaagatcatctggtttacaaaagagaaactgatgctgcaagagaagaaacagaagcaaaaaagagctttgaaatctaggaggcctaagtgaaaaatatcttcccggccaggcgcggtggctcacaccagtaatcgcagctacttgggaggctgaggcaggagaatcgcttgaacgggggaggcggaggttgcagtgagccgagactacaccattggacttcagcctgggcaacaagaatgtgactccatctcaaaaaaaaaaaaaaaggagaagaagaagaagaagaaaaaagaaaagaaaaatctcttccatgctatctgataactctttgaccttggactcctctctgagcctccctgagtctatttcttcctctgtaaaatagagatgctgctatctcctacttggggtagctttgagattaagcaggcttactgtcaattgtgtggcacagagtgggcattcaaaaattctagttataaacgtgagtgcccaaggtcaaagagtaacataagcttccaacttcaagatcattcagctctttactgtgcaccatctgtgttctttcagacactgagctccgtcccagaattgcagagataaatacaaaaaaaaaaatcccagtggccaactatcaaggaagtgggaaacaaggaagccagcttgcgttgactgccaaccaactgtagaccaaccatgacgctaggcgttttcccccaactcatccctgctcctcaggacagtacagatcaccatgttttgagttctgttggagcactgttcaccatgcctatatggccatgcaccctcgtggtgctccaagggacaagtctccagttaacctatgaggaaaccttagcacatagagagcaagccaaggttcaatgtgctaggataattcattcatccattcattcacccaatgatgtttactgagcatctactatggtatatagtatacagcaatgaatacacagaacaagtacccttgtccctgtggagcttccataagcttctaccaagtccatccgtatgctcctcctgcatgtgggagaggaaagacccctctgcatggagtgaaccatgatagaggagggagatccccagggagagaaggaagcaggagacttgcaagcaagaaaactcaattccatcagcttcctcgtctcaacaagccaatctaaggtggagtacaggcagcgtttgatcttttcatcttattcccatcctgcctcagccctgagaaagcctgggggcctggagggaaagttcacctgggcttgtgggcttccctggaacttgtgcacagcctggagctccaggccggccagtgctgggctcaccacatccctttgattgtttaatgaaagtgctttgaaggtcccacagatgctccactgtgataaggtaattgtccaagggcaatgtctacaacccattaatgctggacttggtgcaaattgaacttggagaaggtgcctcgacaccgtctgacacttggtcttttgttccggcaactgggagtttgggaggaggctttcctcccgaagcttccaaagggtgccaagagagagaaattcctgttacacacgccctacctcacatctctgcatgagcatatgcactcgtgtgtacacacatgcacataagtacatatgtaggcgcactcatactctcttgtgtacaggctcttgtatactcttacataggtgcacacatgccctcagcttcacatattcatatgaacgtatcccaatataccttcatcccaatccattacctttaaaccactgggaccagactggggcgggctggcaggggaggaggggtattctcttcctcctgggaaggttctttttccacttgagaaatggaaaggaaagagggattaccagacacgggcagagaggaaaaggcttttacagatatcagggaacactctgtaaagatggcttcaaccgcatctctgaaagccagtagaaaagcattaataggagaggaaactgcagagaggagaaggaagagaagtgggagaagcaccttggcccgtcttgggtctctctctaagctttagccttgcttgtctttatttccagaaccttgagaggtaaaaggctcccaggaccagcctgagaaggagatgaagggagaaatggaggaaaagaaagcagagaggaggagaaaaggaggaaggagaagaagagaaggagaaaaagaggagacataagaaacagggaggagaaggaagaatggaggaaggagaaagagggagagggagaagaggaggatgaggaggggaggaaggagaacacaaggaagagaaggaaaagaggtgaagagtgccccatgcctgtaatcccagcaatttgggagtctgaggtggttggatcacctgaggtcaggagttcgagaccagcctggccaacaatggtgaaacaccatctctactaaaaatccaaaaattagccaggtgtggtggggggtccctgtaatcccagctactcgggaggctgaggtgggaaaattgcttgaacctggaaggcagaggctgcgctgagccaagatcacaccactgcacttcaacctgggtgacagagtgagaccctgtctcaaaaaaaaaaaaaaaaaaaaaaaaaaaaagaggtgtagaggaggaggaggcgaaggaagaggaagaaaacagaggagaaagagaaaacagaaaaggaaggggaggaagaggaagaaaacagaggagaaagagaaaacagaaaaggaagggaaggaagaggaagagaaagggtgaaggaagagaggaagaggaggagaaggagaggaaggaagaagaccaggaagaaaaaagggaggaggctcactcgagagcccacttagcagtaggcctgagagaaacctggttattattactgttgttgtatctttagtgatgttgttcttgcccagttcttgagaactggaatccagtgcatactattccatttttctggggaaaatgaaaatgtcaagcaagctatcaactttcctttttgtttctattcaggtttgggcagattatttcaagctcacccctagaagagtgccacttcttaaaagaaaagcataataataaaaggtcggtgcctcttggaaatgtagcgctgaggaattccagcctccgaaacctggaaggagactcctgagagtcctttgttcctggatgttcagtttccctccccacccccacgcccaccccctcctctctcattatcaaacatttgaagactgagtaattccatttgttgatgtctttggcctcctctagcagagcaggccagagcctctgaaaatgcaaaggcccccaatgaaataaaaacccctggttttcaaggtggatttatcaccctttaaaggaatatttattgggtaatcactttccaaaagtgctcatgacacaggggactgaaataaagagcgtcctctccctcgggctgagggaagaggctgttggccacttggatgcagggaggagggagcctctttgtggcctatgtcttgggagggagcagccagagacaggccaagtttccccagctaaactcaagctggggtcttgcttctgtaccttgggcctacttatttctctcccgtttccaaacccaaattgggtttggaagatgccacttggaaacttgggaagaagaattcctattagcattgttgttgcctttaagaaaagggaaaaggaggaatgcagagatttcagaccagacggggtgagctagagataggagacaatcatccaagccagaccacactgagacgggaatgattcctggcggattagtgggctgggctgggccgggccgggagatgcaccccaagaccaagcagagaaggaggatctcttccccaaggtctttagccaacctcatctggaccaaaggatcttcccagggattcaggtctgagttacagcccagagagcaatggaggcccatacatacctcaggaaaccatggagatgggggaggcggtgacaagacagacagtcccagagaaaagccgctggggtgaagccagaaaggcaaggaggaaaagagaaagagagaccaaaagaacaaaacagatggaggagaccataagatagactgagggggaaagagagacaggaaaaatgtttgtgtgtgagagagagacagagagaaagagggtgaaagagggtgaggagagacagggatagaaagagggggtcaagggctaaaggaaaactttctggaacaagtctggcccagcccacacactcagaagccctcacaccctcccagcagcaactggaggtcttaggagttgattaagcctgcatgggggtgactttttctagacaagggggtaagcaaagggaaacaagaggaggggacgcggctctcccccatccccagccacagttcccaggtgaacccccctttcccctgctggatgtgaaatcgccatttcaccccaccacactccttaattgttgcaaaaatcatttgtgaaattggtctccaacaggcaagaacggccacgctcattccaatagacaaccccacctcaacccttccctctgcaagggcccatggaatcccggagctgcagaaaccctgggggcctgtgtcgctactgcacccactactgtgagtcttttgcagggagggtgagggaccacactgtgggcaaggtggccccagtgcaggactcctgaggttctgagggtccctggcagcagaagtgtccagctatgcactcgccccactcagctcaagatgctacatgagcactggccagaagagagggagcctcccacccttggcacaccctggaggtcttttctcacttgagaattgacctaaacacacactcacacattcctgacgcgcgcttagagccataccaaggcaacctggaggtgacctcaaagcagaaatacagacatggaccctcacttagaaacacacatttactcaaactgaccccaaacagacctacacacaaaacccacctgcaccttgacacacagacccgggcacaggcctatattcacacgcaagcacactggcccattccacaaatacagggaagaagtgccttgaaaccttccaggcagaggacagctagtgacgaatgaatggatgaatatgcaatatacctaatatatatgtgtgtgtgttatacgtgtgtatgcataagtgtatatgatacaaatacatgtatatatacacacagagaatatatatccacctatggaggtcaaagcaggccaggtccccagcaaggctggtgatgtaagggggttgctgtcttccctgggcacacatgctatggcttaaagcttgatctcccaatctctcccgggggagggccccataacttgggccaggcaaagtaccccggtgtcccccttccaattcgaaagctacttggcatctgtcttctcagttagagagagtatgagctcaacaagtttttcatcagggcccccattcccagaaggcccccccaaaatctgatgagccccttgtgctaggagagtggggagaggagggagatctgtcacatgctgcaaggggcaaaggtcacaggtgaggcgaaggggagggatggggacaccctggggccagccagcggtgagcgccccaggctaagacaaggctgaccccactgccgagagagggcgggcagggggtgagattgagggctgggttcattttattgtattttgcctccagcgtggggccagagacgctctttcccccgggagacaaaaggcctgcagttgtggcgtcctgccccgctgggagggcgtttcgcccccaggactcggtgtcccgaggttgaggctactggtcaccctggcttcagaaagcgaagaattcaggaacctctgatcaccccaccctgactcctgatcattcagttggggcgtcccctcaaacccaccagcaaggagctcagagttggtgagttcagagctgtatcaagtcttgacgggctccctccctcccatttcccacctctttgggcccccagatcctcacaccagcaccaactccctgtaaacccaactacctgctggaaaggagttataggcccggcctgggggcctgaggaggacggcggcggctggagacgtctgcacggggcggaactggaaggggaggaagaaacctgtgcctagcacttggcagacccactttgccaagcctcggaaccagatacggttactgggggcttctcagagcggcaggaaggtagagtaagaaccggacaccggggctctgacattacacagaaaaggtcagaattcctcccttcaagtcaccctaggccggttcccggggagcctcactggaggaatttcagagggtgtaagacgagggagaagatgagaaatagggcggactctggccctcggaggccagagaaaaggcgagactccagagaggcgccggacccgaggcagacattcccatacagccgggactccgagagcagccgtgggcgacctgggggccggggactcggcggatccggcccattcatcaaaggaaggcactgggacaaagttggccccctccccttctcccccagcccccaactcgccgggatcggctccctctcttttcacggcggttcaaattctcccccaaaacgaggtcgagccggggattagaaaagagggaaaaaaatattcgttggcgatttcttttcgttattggtcctccgctcccttgcgccctggcccccttccctcctcatgaataaaagaaaagtccgaacctatcagatcgcgctcactgcctcctcctcctcctcctcctcctcctcctcgtacttcggtgaacacttttgcacaacttacccagctgatcactcgcgccccctcgcttttccatttctctttccccaaccccgtcaccccctgtctcctccgtccagccctgaaacccgaggaggctccttcttccgtctgtccccgggtctcctaggggacggggctgtgaaagctggtgtggagggagaagcgagtgtggtccggagaaagaaggcgtggagaagagggagggagcgagagcgagagaataaatatataaataaatacgagaacgaaatccactccgcagtctccgggctcggaaactttggccccgagcgccagagcgccagagcgcgagagcgcggcgctcgccactctgaggctggcggcctcgattccggccgcgttcccccggcccccctccgccgcggggcctggtctccgggttctgccaggcgcatcagcccgcacaacttctggccgaggccagccggcagaggcggacttggggttggagtgtttgtttgtttgaacttcctcgtcgtcgccaccttccctccccccaacctccaccccacctcacccccctccccagcttctggacgcgtttgactgcagccaggggtggggggtgggggtagggagtgtgtgtggaggggagggagaagaggttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaaggtaagaacgcccaggctggcctcgccgcgactccgccgcccggaactcggggtccttggagaggctgcggtctccaggggacggtggcggcgccggcgatagcagagggatcccgttctcttctgggtcccagtccgggcgcggaacccagggagtttctgggacccatacttgtccgcttctgcgtgggtttcactgcccggcggccttcgtttcgcaggtcgctagctgccggtctttacccgcagggctgaaattctggtagatttggactcctagtaaatatcaggtcctggtgaatttcagctctttccactatttccagacacttcttccctgacagtttctcggctctcctggctcgctggctgccagctttctactcttgttttgaattattttttccacccccgggattggtcttccagtcctttatttcgaaccacctaccatgggtgatactttatatgcctcaactaccacggctatccatttcttccgaagccacagtcaaacactcctgcttttccgcctggaaacaaactaattggaaataataattagtaatgattttccccctaaaactttttactcgggcttccgcactctggaaatctcccgggagagaacctctaaacggcgaggtttagagaacctctaaacggcgagaggggcacggcaatgtccaaacgagaagaaagagctgattttgtaaagcgtccttcctaaacatccagcgcccgcccggggagacccgataggacgggcggcggcgaaccgggtcctggctggagaaaaggctgggagcgcacagcggagagacccgctcctgtgtttttgttctgttttctttttaaactaatggaaggcctcaacctgtcactgagggatcatttggcttctgagggtaggtagcctagggtgtcacagagaagtcattagaaatatgtgcgactttttttttttaaattactcttcctgtgatcgtttgagtccctggcgcgtgaggaaggggagaggaggcagggagggggtgggtgggctggcagcctgcgatccgggaggagctcccttgggcagcgagacggcgccgggtccctgaattagacagaggcgaagagagcggctccgtgatcaagtgcgcgccggcagccacgcaggcgggagagcgcgcaaacccggggatttgcagtggcactctcctgtagcgaatgcaagtaaaacaggcggctgaggacgcgcggcggattagaacaatatttgcccaacatgacgcagaatactgaggagagccgagtgccggtcgctaaagaggctcttgaatataaagttgggcgctcgagagctcttgagcgctaatggcatatcccgccacggagaccgagtgactccgactttgcgacgcacgatttctgattaaatccgagagtggcttcagacaccgacttttacaaagagaggtggggggaccgggagagcgagggagggggcggtaggaacggcccagcagcggagcctcttctcgcctcctccctttcaattacagtcagctccctccactcccgcggctgtgaaatcgttctaatcttccagatctccgcagccgctgagtccccaaattggggggatcgaggccggattagtgcgctgggtgtccccccaatcttctgtgaggaaattgtgtagactttgcattaaggcaaccaggcgttctcccctccccagcacacaccagtgatgcctgtcttcccggttcccaaagtcacccccacccggggggactgtgtcccatctgcctaccagcctcgcagagcctgcaggcacagttcatggatttgtgaggccaagtcgactatttaatttaggagctttggggcagtagtgtcctaaaattgtcccaaaacgaaattaggacttcgagggtggttagaagcaaggagagtcacccaagggacaaccaggtgcccttggaggcagcagccaacagcatatgtcacccgtccctcggctgtgcctcagctgttccctgggacagttccacggctctagccagagctgtaaatgtagtaatcagccaggcctttctagcccccaacaaactggatcattcatgactaccaggagcgtagaactgagcagatgagccacatcacacccgttattggcctctccaagacgcaggcaggcctgcagcccaagcttcggcctgagggacagatagtcattggtcccaagatctctaaggctctaccagcctggtggctctgtctgcagtctcatcttcatctctctccctccccttcttagcagcattcgaatcccccaggtgtgtcctcatccctcgtagtgtggcaggagttgggggacacagcatctggggagactcttgcagctgtgactcctctatccatctctgcaggagatttcctagatttatgacagttgtttctcaaactacctacctaccgaagccccagtgtgaggaccaccgggattgctgtctgaggtcttggggctcaaacaaacaaaactggagtcagggagtgtactcagtgtctgctctccatcctcaccctgcacctctctccttctgcatctcccctcccttctccagtgtccaccccgcttggccaaggccgggtcaatcagctgggaggggtcttcatcaatgggcgacccctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccagagtgagtgtctttgccacagaggctggcagctggcttcctatagtcgggggctcctggttgtggcccctcttactacctcgtggcaccaggctgtaggaaagtacagctggagggtgtcttctactcccagatgtcctcccattgttttcctattatttgaatttctcagagatggagctaagtgaggtctaggttgtgcaagaccttgaggccaatgagccattcctggactgtccccacatttgcctcaacccctgtcaccttccaagaccagaagacatcttctctcagtctttcctgagataatgacggggaccctgggggtcctaattagagttttttattgcctatccatgtcccaccccaccccacctggccagacccccagctgccttcctgggagccaggaaccggtttcttgaaaggataaagccaatctcttgggggatggggggacacaaggtaaccagaaccaccagcctggtctggggctcttaagaggtgatattaaaagtattttcctccccccatcccatctttccactcctactctcccacctccacctctgaagcaggtggcgactccggatgtagagaaaaagattgaggagtacaagagggaaaacccaggcatgttcagctgggagatccgggacaggctgctgaaggatgggcactgtgaccgaagcactgtgccctcaggtgagaaggcagctgagccggcagagctggcccagagtgtggccaggggtccagtgtggagggctggaggtgggagagaggggagaggagatgatggctgactgtgaacttactgagaagttgggaggaaaggagtacagaaaggcagagttaaggcataggagtaaatcaaaacagaatggaataagatggaaagaaggaatagggaaagaaaaaaagttaagaaaggagagagaaataagaaagggaggaagaaggaaggaaggaaggtaggaaggaaggaaggaaagaaggaaggaaggaaggaaagcaggcaggcaggtgggcaggcaggaatgggcaaaaagttaacctagaaagctggatgataagagagcccccctggaggctttttcggagaaaatggcttcaatagatggatctgtcctaggagggtggatgcccatgggcttccctagaccaccgtctcagagttatgatttctgctgtcgccaacaccagccatttgagtcctaaatttggaggtcccaaaccatactgcctgtgagagagaaagtgatctgttgtgtgtgtgtgtgtatgtgtgtgtgtgtgtgtacatgtgcattcaggcacgcagggccagaatgcacacctgagtgtgggagtggcagcaggagctggagagactccagagaggccctgggacctctcgggggtgtgggtggaagtgcacctaggcaggtgttagtgtaaggcacgaatgcatgcaagcatctgcatagaaatgcacagtctaaccaccctgtgagtgcccggggtgtgagtcaggcttctccaagtggatgctggttatggagtacgtgtcaatgcctaaatgcctgtgtgtggaagagggatgaatggatatctgtaaggaagcagggggcttcctgactttctcccaggggcccaggccaccgctcgctcctctgctccaacaacttatacttgctcttttgcctttgaatttctgaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaaggtagggaacttccctgggctgcgaggccccagcccgggttttcccacgctccggtgtgcgggccagtggttcgctcccgccgccggagcaggcgaccagaactccagcggagaaactctcatgctgcggggcagctgggagccgctcaggctttgccgacagcgccccctcggtgcgcaccccggatgccggctagatgcgaagcccgcgccttctttgcgctatggaggccgggcacggacggcctgtgagtcccgggagagcccggctgcggggctgcgcgcctggtctaccccaatactgcggggagtgcgtcctcccgggctggcgttttggctgctactctcggcgtcgatcaattatttataggaaacttgggcaagggggcgggggacgggagggagggagagaggaaggaggagccggcccgcggctccctaaatgaatttgttaaccagacccccacacgctctctaaacggtcccttgaaaccccgcctgacagttgactgaccgctgcaatcaataaaaattagccagggccgccgcctgactcagccccgcgttgccagggcggactgggggacagagagtgccttcctctgtggcgtgcgccggcagggctgggagtggaggccaagttcccagatgcccagggtcggaggatcgcagtgggggagagacccaggctccacacaccctctccccattcttagcacggcttccgcgggcaggctggagtctgagtcctgcgccatgctttttctcaggatcagctaaggagggcgtttagttttcaagcgcccggaagcccgggaaaggggattgtgcttttgtttcttgacgggaggaagtttcgagagaaggaagggaaagtttttcctcattaccccctccccttcctcattgccctcataattcccctcctaagtctctttgagacttggtaagtgcacgttaaggggcgacagggagagaaacagaaatggaagacccagagtcacaaagactgacagttaaagaaaaggccccaaacacatacgcggagaggcggcaggctgagggaatcggaaagacagtggccatgggaacccgcagactgatggctttggaaaaagtggcgagtgccctggaacctgaaagcttgcaaaaagccagtgttgtttcagtctcccttcagaggtttctcccagcacccctctcctcacgacccaagcactcctagcccaggtctctctccagttctcagaagaccctcccaaccttgaagatgaacttcacagacaaagccggcttactaagacaactcccatctacgcccagcccccacaggcgtggtccgaggaggaaggatgggtggccgggcagccccgtgtgacagcggcctggagcgaagggaaggggcggccattgacagacagggcccctagtgatgccgcagtcccgcccgggacaaaagggcgagggaagaaagggagccagctgtgccgggcgccccgctgtgcccggcctgccgaggggccacgggtctgcggcgggaggcagccctgcactgccaagcggtccttggctaggccagtcggcccagagccctgggacacctgccgggggacccagtccttatttcagttcccattggaaggagactagatggactttttgtgggttgtggaggggaggcatagaactcgaataatctttcctggacaaataatctttcctgcacaacaaacaactcttctgaggttatcccagggagaagcagaggaggtttggttttccttggagagactttaattgtgtttgcacgcagggagtatatccagttcaatctgtgaggaagcacaaataggtaaatttcctctgagaaaaaagggaagggaaggaaaggaagaggatggaaagatcgtgcggtttggaggattcctctgattccagggaatgcggggcgttccatgctggcctgtgctcaccacaccagctaacaagccactttgctggatagaggttttccctgcagcagaaccaggaagaaccacgtctccaagggtttaaagtggagcctgtgccagatgggggaggctgaggacacaggtgctaagtctagaggagctgaagaaatgaaatgatcttatgcagtgagcctggtctccagaaagtcccgcagtttttgcgtgacagtgggtgtgctgggtgcgctgattgtgctttgaatggctgtgtaagcgcaagcatctcttagtgtgactgtttacccacgggccttctgatctgaatgctgtaggccatatatctgtgcaaatgggattcagcatagatgtgcagggagtgtgtagatgggtgtgaatgggcaatatgatggtgcagatgagagagggccatctatccatctgtgagcaaattgtatccgtttcctatttgagttcctgggctggtcggcaggcacccctgtgaacccctcatctctcttccaggccccagacatcagtttcatgtccaagttaaaggtgaaaagaccttccaatctccatccgagtaatccaggtagggagaggcagagatgccccatggccagagcagggggagttgtgcacacccacaactttgttttggcttcttgctcttgaaaaatgctttctctgggggagttgcccctctcatggcagggagccaccaaagaaggggtttaagagctctcctctttaagcactaaagagagatccctccctgagtccgttttttcctatcgtccgcttggcatttaataatgttaagacttattagagctggtaatgaaaactgggactgctgaataggaaactgtgttggagaggggtgtaatagcttccaggcatggtaagaaactatttatccgcaatcagttctcactctcagagtttgaagcacaaacgttaagttgaagggttttaaagcagattaaattgagcttttatttctgtgcactttcatctctgaacagctcactcctgctccccttgggctgatattcatgaggctgttcatatttttttttttgctcttatccttgttaagactgagttattaggattgttggtggtgagtattctcagaccgttgccgataggtgcttgccccagtcaagcttggctcacctggaaagggaagtggacagttccttgcccccatgcacttagactccctcctcttcacccctttctccgaggatcaggggatagacaggccggggacccaacagggaggggatttgaggagagaagagaaaggaaaagattttcatagaatctgagctcagagagattcttgtggggaatttgataggggtttgcaatgggtcaaaccgttcctcagtgggagctgagggagtgagtgtgaagaaataagcaatagtataaaaaacaataacagcagtgacaaacaataagaacaccaaagccgcatgcatctgacagtgcaccagtttaagccaaaactgaccggatcagaccaggggctccgctttgttctctaggatggaaaggccaatgaggttacaattaatatgaaatatagggaaaagttacaagattagaaaaaagaagtagtagtagtggaggtagcatttttctccaggggacggggcgggggggaaatcctgggggtgtcaaagtccaggtggagaatttgcagacttcctgggtgtgaaagaccatctgaggtggggggaggattggcgaggacggcgagtgaggcagatttgtttctctttgtatttttcctttatttatttttaaggcagcaaacttacaggtgtggagtgggaaatgacggggaaggatcggaaaggaggggagagcccggagtgtcggttttagacacttgtaaaaggaggtgggaaacaatttaatttggcagcagcgatagctgctaatgcggttttcggtcgtttgctacactggaggaagctgttttgattgtgtgtacaaggacctgccaaatttaattaggctccgggggagcgagtgaataggggaaggggggcacggctcccctcagcccacaccattttttcggcttcacacctggaagggacattgtttacgggatcttcgaaaaccaggaaggggcgggggcggagagggacaggagccttggaagcgggggcgagggaggggacgaggatagtccatttatcacgaaacaatctgcattgatttaaaccaacaagttccctcctctgtaaatgtgtgtttagagaaaggtaattgacactccaccaaatcaaaggattaccccgggttggcaatctaatcaaacagagtccaggcgggatttgaagctgttcagagtgggatcagcttcgcataatgggggctcggaggaagatgggagggtgtcaggcaattcccggctttaggcagcgctcggcggtggatatccagtgcgaccagagggagagagggagggggcgctggaggggcgcgccgggccgggggctgggggggatggggcgagcggagaggggcgtgcggagctgggaacgtcccggcggagggggctcccggcggagggggctcccggcgaggggccgagcccacactgggctgacaaggctccccttttcttccctccatccccccaaccgaagaagagagagggggaggcgggagcagagactaacgagaaacaacaatgaggagataactattacaaaggcaaacactggcgctcgcgcgctcgcagccccagaacccgcggtaaataaacaaagtctgcaaactgtttgctagataaactcgtgcctaaattgagtgtgacgagcaaggagagaagagacagaaggagataaggttggagggggatgaatgagcataatctaatagaagacatttagaaaacaaactttaaacaagggagaacaggcgagcggagggcaattatccgccccagagagcgggggaagccgtcggaggtctgggaaggggtggaagggaggggactgggagctgcggaagagctgagtgttggggggtgcctttgggactccgtggggagccaagaggggctccccagggcgcgcaagaaaagaggctcggttcccggattgagtgaggttcccgtgctcagccggtcttggaacgcaggcacgtctgaaccgggtggggtcccccgctgcgagggcgtgcgggttttgtgttcccctcggggcacgcaccgccacacttgggctgtttcaaggcgtttgtacctaaaagactagtgtgcacggcgcagcggttaaaggaattagatatttaccagtttgaaataagcctggctaagaagaagagagaagagagacattgaaaagacgaggctgggggaagacttcaaacgaattcatcatttggaatggtggaggggagatttaccagacagtattgggaagttatttagatattaataacacattttcctgaggcgcgaccacagcagccatctgcgctgctctcggagctatttggctgggtaaaatatgggcgtctcaaatgttgggaagagataacgcaatcaggctaaccctggtcctgagactgcatcgcagcgttaaacccggattaacctccccccccccaactcccgcggccccctcccctttcacagctttccaaattttcagtggaatttacatggaaggatttaaaagcacatataacagtagccttaaagcagtaaggtgattatttgggcttttttttttaagaatgtctttctgaaaatgatagttgtcacacattacattatatataaataatattatataaaacatatttttatataggaaaagagggctgagcaaatgagatttcattccaggttacctctttggagtttctatttgccatcattctatcaccatcaacaaagttgatgaggcttcattctgtactgtgaggcaagagcacctaaggatataaacatgtaatgtacaaggtcctggccgtggccctggaagctcatagtctaagactagacagaactcacacccctgaaaagacaatgcctggttgagggaagggttcctgcacagaggagagacccccaaagaaaggttctctagaggctctggggccttgaaggccatgactaaggggggaggacacattccagaaattccagaaaaatagctcttctctccctcccattgcagactaaaggggtaattagcaaacaggatgagggttagaggcgctgggaagattaggatgcccccctcagtttttgctgtccggggccttccctcttcttttccccttcccccaactctggctgaaagaggaaaaggtggaaatggggtcagcgctttctgacctgctctggagcgattggccccggctggggtggagcagggggagggagggagggaactcgccttcccaaatcgaatcaaggcagaacggtgacctaagggggaaacttcgccattagtagatagatgtctccaaaacttcaaacgaagtggggtgggggagaggtgaggcggggaaggagtccagtgagagcgcagggggaactaccagcatgggaaggggaggggcctggaggaggaagagacggggtcgagggcaaaggggaggcgggggccaaaggaaagggtgtggggaggggatgcgaagggagggggtcggctgcacttggaacttcaacctcctgggagaggaaaagcgtctgcgggtcgctacagcctcgggaggggtgaagggaagttgtgtgcgccccaagtccagctcaaaagaggccccgagggcattctagggcgccttgggcacgcgtgccaggcccccggtttggcagccgagctgagcgagggtggattgcgaggggcactggggccgccgcggagctctgcgtgtcggctgccagtgaattggccgatttccccagtctgagggtcagcgaacggacctttccatggcttggtcgccctggtcctggaggtgcgctgggcccgagctccggtggagaccaagggaggggtggggagaggcagcggagacagagagccacagaggaggagagagctagaaaattcagagtgagaaagtctgagcgcagcagaagagaatcttgcgcacagtttgaggacgctggaaaatgcggaggcgccgagggaggcgccgagcagcaggaagaaagacaaagagatgcagaatcaccgagagactggccctgggacaggcggatcaggagagccagcgggacctagagacagcccgcgggagagcacgggccgagagggcgagtgctcaaagccgggcagcggctaggggaagataggaggcgggcgagccgcggccgcccttttgatccttcgtggcttcgccttatcagaagcgctttcggtgacatccgcacaaaggcagttcatcatattacagcacgtcccggcggctcgctgcgatcctgccgcttaattagaggcgagcgagctgggccggcagggcgggagggaggccgaccccgaggcgggaggccgggttctgcgctccaacccggggcgctgggcaggggccagcccgcgtgcctggcggtgttgggacgtggagagagggagaggccgggaactgcattcagagcgttgctaaattaacaggccggcccgggcttcactgcccggagagtgaagctcgccgccttccaatttagccgccgccccttctaagttcttgggaagggatggcgctccggccactttcccctcttccaggctgcgaacgctgcggactggagggcgagtaatggggaggcaacccagggcgagctgaaggcttagtgcaactccgggtccaggtcgcacccaccagccccccgcggctgtgttccatcccctcctccgaccgccttgctctccatccgaacccaggtgtgccaggctggagcaatctgagaggggcaaagtgcatcgtggtcgaggttctactgtccatcccacccgcaactcactagcgatatcactctagacaacccattcaacttctttgggcctcagtttccttccatgaaaaaagagaattagctaagacaaatgttgttatccttttaggggatcctggatccctttaagaataggctaaaaccgaaaaaataattctaaaaccttgccatttacatacttatatactttcatacaggcagaatttttcatctagtataaaggggtctttggggcttctagaggccacaccccattcagaacctcacatctgcgtgcttcctgatgacttcagtattctccagggagcttctgattccagcatcaggaagctcaaaatgaggacatggggcggaggggcactgagatcctgcccttggtctggtccttgctgcttcctcccctctccaaaacagagcggagagcttctcctccaccccacttggtattggaagggtcctttgggaagtgtttatatgctgatataagcacgtgtactatgctcccccttttacctataccacccaaaagagaaattttcctctggagtgtatgtgtgtgaatgtcttcattcattctgcaaaaatttttggagcacctactaggtgccaggcgttgtgttaagtgacctcaagaaggtccctgccctcatggagttctgagccaggcggtggagacagaaaataaacaagcccgcaaataaacagatgtgtctcgttatgtgtttgttgtgtgtttacctggatagctttgtgggcttccctcttcgcaagactgtcttgtgtctgggtgtttgtgaatggtgtgtgagtgtgtgtgcgcgcgcgcgcgtgcgtgcgcacgacagcagagtgtgtttgcggggctggggctgaatttggcagccagcccccaagctgacctctggagtggcccgcgtcggcgggctgggccttgcttcgccacgggttcgagggagaggcggagggaggagcggctgggctgcggagcctcttgccttcactgcactctttgtctgacaccacgaaaagaccgaagatcaaagaggcccccgagcgggacagaaaaaggggtggggcggcgggcgcgataagtagctcggaaaactccaccctaaacttttctgggtcctttccatgggacccagaccctacagaacctcacccaagtgggcgagtgggcggccggccgtgggttctctacagtcccaagcctccgcgagggcgacaggtggagagggacagctacggctgcgggctccaattcaggccgaggtctttcggtgactggagaaggtggagacagagcaacattcagaagttttgtgaggcgtgtgtgtgtttgtgcggtgtgttctgaacacttttgcagggagattgtgagtctggatcaagcctcctggtttcctgaaaacttgccttaagtctgctctggctttacctgggctgcagacttgggagttggaaggagtcaggaggagtcctaaggaagcttctggaacctcttgttcccagtggaagcctgcagaagcacctccgtctcccgcactttcttgtaaccacagccctaactcaggaagctggtctctaagccacctggcaaggcgctttcccccgcctcccgcggtcctcaccctgcagctctccttcccgcctggacttcttgagttcgaattcacccttccgagggtctaaaaatatggtagaaaaataaagtccaatgtggggggatataccccatcctccattctcctccctcccgctgcctgcaaatgccaaaattcaaaatgcccacccgttctaccttttccatgggggaagattctgaatgattgcagaatcccagcatgtccgggatttgtcggaggtcctcggagtgaaccctaagaaaagaggccttggaactttctttaataaatggggctgaacctccctctctcttcaaattaggttctggttgggactttttctctggtggcctggtggcccatacaggggacacagagaggtttgcccagagctgcctgttacaggcaattactgctgtaaatggccccctttgcgtcgaccctcttccccaaaaacccggtcttttccgtctcggcggtacctgagcctcagtttccctatctgattagtgaggataagagccgctcctggcctccccaggcagcaggaaattagggccgggaaagcggtttggaaactggtcagcgggtgcaggcgggcagagggtgggaggcgtcaggagttcgtcctcctccccggggcgccccctccccgccgccctctcggcacagtccccgctcgcgcctcaatggccactttagaaatacaaacaactttagaaataaagtaaccaaacccccgaaagcggctttgaagaggcgaatgcctggtggcgctttactatggtgtgggccgaggccccggcctaatcccgctttcatttccaccgacggccgcgggggaagcgctcccggcctcccggcccctcaggaggctgattaggccacaaagagcccccattatcccgagaagaaaaccggggggcggcgcggggcggcgcggcgcggggggagcggcccgcccgcgcccgggctattgacttagtggatgaagtcaagagcgggcacgctgggagcccgggggtggggtgggggggagggctggggccttgggcggggatcccggaggtggggtgggggaagggctggagggggaggggcgacccgcgcgggaaggggcgggggacggaacaaaacagaacgcacaaaacccacaacaaaaccgagctccgggcgaggggagccgggccctggtgcagggcctcgtctgctgagcttggctgggtcagctgcccgcgccggccagcggaggggaggggggcaaaggacctgggctccgccgccactgccgcctgggctgggttgcttacttgggacggggtggtggaggaaaggagaaagttgcagccgttggacagtctgtcgctaagtgctacatggcttgggcacgcggctctgtggctcaggctctctagtcctcctctgtgaccccagggagctgggtacagaggtctccaaaagtcatccccgctgtggtggcctgcgaatctgtggtcacagctatagtggatgctgtagaggagatgcctgaattgggcggggtggggggggagaggagaaggaggcaggagattgaaggagaaagaggaggaccctggattctgaaagatctgggtaattttgagtgaagcattctgagatcctagatgtcctcttctgcaaaatgggtccatggacacaacctcaaagtaggctaggaagcgtaaatgctataattacgtaaagtacagggcaaactgggaggctggagaaatatcactcccccatcctctcctgcctcctcatttcctccaaggcttctttcagtcactcccctatgacttgagaaataataggggccttggaagaaacgggctgtgaatccataagtgatcaccaaatgtgggcgcaggtggggtgggggcagatgctcagccaagtgcaaataaatagtatccctcctgatctacagttctagacagaagaaatagacctgctctgtgggcagctcctcattcagcagaaggtcaagagaagaaggtagaaacgcacagagccagttcctggagcccagtagacactgttctgtgtgtggagggacttccctcccctgatggcttctgtccccacaggcagaggctgggcagccttgactgacagggtagggaggtgtgggtgagtgctctggtttgaggagatggtgaaaacatcctccaggtataaaggaggtaggtgagggtatgtgacacaggctcctacctgactggcccccagtcacctcccctccccaaccacagctgttttccccacccccagccatctcccagaaaaggggccctgactccagtgatttggaagttctttgaaggcaatgtcactcttcatccattcactctactactttatttttgtctttttttttttttttttttgagactgggtcttgctctgtcacccaggctggaatgcagtggtgtgatcactgctcagtgtagccacaacctcccaggctcaagcgattctctcacctctgcctcccgagtagctgggactacaggcacgcaccaccacacctggctagtttttgtgtctttttgtagaaacaggattttgccacgttgcctgggctgttctggaactcttggactcaagcgatcctcccatcttggcctcccaaagtgctgggattatagtgatgagccgccatgcccagccattccactactatttatcaaaccctaggttgtgtgggatgtgctggggaggataacccccactgccggtccagactcatcaaaggctaagttaaggaggtaggacttattccaagggcagcggggagccatggaggatatttcagtaggggactgatggattcaccgagccgagaatgtaccggaagatgtggagataccagctaggaggtcaaggctgtgggaaaggagcagagaggtgcagaggggctggagagcagaggatgcaaggagacatggttaggagaggactgccccagctggaggtggaagaggaggaaagcagcccattcccagactcccgccactgatgcccaagggtactgagcccgtgactggctgctaggttcattcaagggaacttggaattcctctgcaggctgagattacaaagggtggagtcagactcaaacaggccttagaggtcatctggccattttacagatggaaaagctcaggtccagagggagtgacatgagtgaggccaatggaggggaaggccactctggtctgctgacagttatgtgcgggtacaggagcaaaacggactggtggaagctttgctcccaggaattaggaaggcatgggataaggacagccatgggaatgaggcctttccccatgctggcagttcatcgcccttcgtgtttaatgtgacacatgccttaaagttctgattcacagagggggagactgaggcacagagagttgattagcccaaggaagtaaggggaggagggtccccttctaacaggctctgcaggactctgacacctttgccctaagaagcctgaagggcagcaagaatctcctcttcttaccccatctggacaattgcagcccccatccccctcccccgttcttcataaaccccagattctcaggtccaggggagactgtggttcaagccattgccacacccaccccaccccgctatcacccacactcccagcacccataagcacctactgggatctcaagccctgctagatgccacaaacttggcctgctgaagggttagtctgtccaccatccggggaactgtcctttcaacagcaagggaaaataaagcccagagggaaaagaatcacagattgtggttagggttggaattcagatcctcatgtaaatggccccatgcagaggccctagcctgagcactaactgctgtgtcattctggaagagccgcttcatgtctctggcccctggtccttttgtctgaacaatggcaaggcaggatccacctagtggttttcaaactgtgttccatggagtcctgggattctcagcctcaggggccatcctttgagctgtaatactctgggcgtgtgtttagtggaggggaagcagtgaaaaaacagcctgtttccccatggatagaggaaactccggggaggcagggctttgtcctgggaagagcaaggaccacttcccatccaaggctactctggaggagggtgaggggaagaagctctgtatactcctggaatcagagccctcaggctgtggttattggtcttcagagataaggtgataactgcttatctggtgacaaatgattatcctcctcttctattcctctgattagggaactttctctcctggctgggaggtctctttggaaaaagggcagggctggtcaagagacactgacatctgcctcttcagtccctgcccggcttgctgtgtgaccagaaagcagttacacactctgtgcttcattttggggcctggtggagcagctggcttgcaatgccatcctgggatggtgctggaaggaggattcaatgcagcctgtgggggatggaaggagcaggagggcagagggcggaggacagagggctgtgccccggagtcacccaggtgcttttgcaagacatacacacctgggtactttcttgatttgggacatctgagtacagtggctttggagcaatctgtcccgatcattctgatggcctccccagcaagagccactggtctcatgcaacacctttttttatagatggagaaactgaagcccaaagaagggaagagaattgttacctgttgcatagcaaacggagaggagtcagaagagagacccagtccccaaagtattatgccaggcaccatgaagggaacattcttccaaagtttctgggtccctcagcttttgttacggtcacctgtccctactgagggtcccatctgccagggtaccatgctgggaacaatggggctggcagggcaagacctctgctttgtcctactgtccccaactcctgcttgtgccatggatggtctcccagacactcactgtcatctcagctctgggctctgagcccttatatccacaggcagcttcagtgcacggaaggacccctggacttggaatcagtaagacccaggttcctccccattgctgcccccaccatgtcccctgagctgtggcttcccctctctcagccttagttttctcatccagacaatgggagcaaatgaattaaaacacagaaaagctatgtggcacataggaagtacatgcttaaaatgagatgaaagacctgaaagtgatttgtgtgaaatacatgatccctaaaagtctatatgctgagaatttcccaagtcaaaagcgcattgtctcatcggtggctctaaaatgtatatgcatatatttttataggtttttgaaagatttattgcaaaagtaatatgtacttgtaaaatttcgcatcgtaaaaaagtatataaaataaaaattaacaatccttctctatccctagcaacagctttgttgagttgggatataactgtctagatttatacagtgatatctagatacgtctctctatctagatctacctatccatctatctgttcagatgcagatatatatttgaaggaaagtggtgtcacatctgcttaacttgggggcaatagaagcttcaaggggtgactgtgaatccgcagaattaatttatcagtggtgggtatgagtctggagagagattccgagtgttccagagctcagggtcccccaaaggttaagcatcctgagttggaagatttgcaggtgtttgtcctctcaaagttccgtccctccccaacaccctccctccaggcttcacagtgccacccctccccctctcccctccccgccccccccaccccaccgcctcttcatgcacctgctgaggcttccggcctctgctgcttcaaagaggcaggctgggctttacctgcctgccttggagaaaagcagcctggtttgaaaggggaagtggcatttcaggcacttaattagacccgggacaagaatggaagttggctctcaggtcaggccaggggggattgttgggggattaacactcaggtaaacccatcaaggctcaccggccccctggcaggaggcagcaagagaatcccgggcagcagcggaaaggctgggccggctgggcccacagcctgggaatcacattccagagtggggtagtgggggtgtgcagagccggtagagggtgggaggggaagggtgggccactggctgcctccacccttaacctcaactggcccccttctcttccccgcccccccattgccccaggaaggtagagttagaactaccattttattcctgcagcaaaatgtattgagaacccactatgtgccaggcgctattcctaggagcacagccagcaatagcgcaaggtcccggctgcacagagctcacacactgggggaagagcaggttcaccaatacggaaaggctttcagaaggtagataagggcttgacaaatataaagcagaattgtgatagaaagggactgacagaggagtgatgtttattaatagttgggctatcagggaggcctgccaccagaagaggtgatatttgacctgaaacctggatggaaggaaagaggtaaccatttatggaaaacatctactacttaggacaatggccagttgagagctgactgcatatgtgttaagtgctttacattaatgaattcatcagatcctcccaagaatacctcaaaggagagattattaattaagaagcccattagtagatacagaaattgaggcatacagagaggtgcctcagctctttgggtccagatgggcagggccatctcactggacacctgtgccctccccctgcccacctcttgctatgtgccagaaactgagccaggtgctctatacacctcccttaactccccagccatgccccgtgggtatctgttttcccagttttgtagatgaaagcacagctcagagaggtttactcagttgcctggagtcacacagtcaacaagtggagagccagtcattgaatctggtaccacaaactcttcctgctgcaacagctgtgcttttgcaggcactgactttggaataccctcagctgattcacagggtcctttgtcctggggaatggccttccctgtctccttcagggaaagggtttcatccttcagggaagattcattgaatcaggatttgctgggtttttttcatttttttttttcatttcttttttttttacacgaatgggcttcctggcccgcattttgatttgcgcttgggtttatgaattgaggaatcacagtcagccttgggaattagttgcaagataaatattgcaatcctggttaaggacttaagaattgtcacttgtgtgtgtatattgttgttgttgttgcaacggtgctgtgtacgcacggttacagtggatcaaatttggggagttaggaagtggcgttggtttgtggttagacttgggggaggtgtcgctttcggttgttggtgtgctggtggctgtgttcctgtgatatggaatgtactgtctgagaatgtgttcaggggtctgtggttatgtggatatgggtgtgtagctgctgatgacatggatggagggatgtatctgggtgtgtttctgcagaacaagtgatacctgtaccatgtgactttgtcagttccaccatgtccaggcacaggtcgggggggttgtccatggttctgaacgtatctgcccccattttacagataggaaaccaagacttagagaggccaagtcatctgcttgaagtcatctagctgagaagcggctgagcctgaagggaaaccagggctgccttcagagtccagcctcttttccctgctccccaggaaaggttttagtaacaataaaaggtttaaatgccagcaaaaggtctaaacgccagcgtcggtcatggggcctggcagacgtgtgtgcggtcacatgcatgtccccattctcgttctggtgtctcagctcctgcccattctatgggcccccagcccagccctgtcgcaggagagcctttctttctcgggactgcaaatacgccaaagatgaacgccgcccgcagctggctggctgcagccctgaacaatggcaagacctaggaagtgaagaaattgcccgaggagcacagcagcccagtccagagaggcagttcacagagtctgcctgctggctctggctcgaatgcagtgagccctccccccacccgccagctccacactcctggctgaaaggataaacagtctgcaaagaaattttccctagaaagaacacttcgctcaagtgcaagtccaccaccttagaccagtgattaggggagagttaaagaaggggaggggtgtcccctctcagggggaaatatgcaataaataatcacaggtgggagagcgtgaagtggaggggctggaatcccagctgcatgctgaacccagctccaacaccgttctccagaatggatgacaaaatgcaacacagtaaaacaaatctggtgctcatgtgcaatgccttcctccttcctaaatctccactcacccacttcttcccagcgagtggcaaggtggcaggtgccatctgagaactatctagggtagcagaggaaaaaaaccacaacagcgggtgggctgcaaggtagcttgtacaaatttgccaggccgtaataattagagatgaacagagcatgctcacgtccagttgggagggagctctggaaagcaaacttggaattctggaggatttaccatgagctagacacagctcctttaatcagcacagccctatgaacttcacaggttttactaatcccattttacagatgagggaactgaggctcagtgaggtaaagtcacttgcctgagatcacagggctgaagaaagaggcaagaggaagcatttgaatccaggcctctcaggctttgggcctggggcctcctatcacccctggggtggcaagggaggagccgatcaaaggaagaactaatcttgcttggcacgtgcctacaatgccaccgtgatattagttcctgggccagaaccatatatgcattcctttaatttgggcatcattgttatcatttaattttaactctgctattttgtctggagctagtcaggtttcacaaactccttcccaattcatctcattactgcaaaaaataaagactgttattttcaatgaagacaatgtgactcctttccaggggccagaagctggtctccctggattccagtttccacggtcagaaacaagggctgcggccggtcccagcccatgactacagagcttagaaatgcaggtggcacgtcccctccgtagatgaagccacttaattaccatgcaatcaatatgcaaacaagtgccaaactgggtttgaatcaaatttctcattggggactcagtgggggaggaaagtccagccgaagggggccaaccgggatgagctggcagggagggggctgcaggatgaagagatgggcttcagctgggacccaggcacctgagggttgctcagacaccctccacagtccccagtgtctggcacggggcctcgctcccattgaggggagccggggcctgtggctcagggctgcagtcggcgggagggtttccaggcctgtcagctgaagtctggcggcctccgctaattcatttgactcggaaatctcaacttgaccaggttccccctcccttctttaaaacaaactcattaaacttgtcaacactcattaggcctgtaaaacattgaactagagccactggggagacttggagagggtgtgtgtgtgtgtgtgtgtgtgtgtgtgtgtgtgtgtgtctgggagtgtgtgctccaaagctgaaccaggccctgggagacccatctcctaggctttgcaggggcagaagtcacattcgtttgttcatctacttccttccttcctgcatctgtgtttcatcaaaggcggaacagcttgggggtttgcagcatcagacttgagctggaatcggcctttaccctcctggcactccaatgcagccctctccttagccttgccagtgtatcagtttaacccatctgcgatatgggtattgtcataacggacccatttcactgggctgttgggaaaataatgcatctaatgcgcttataacaatgcctggtgcattttaagagtgcaatgactggtagctattattcttgttgctgtgattgatgatctaaaatgtaagaggcaagtccgggcgcagtggctcacgcctgtaatcccagcactttgggaggccgaggcaggtggatcacttgaggtcaggagttcgagaccagcctggacaacatggtgaagccctgtctctattaaaaatacaaaaaacaaattagccaggtgaggtggtgcacacctgtaatcccagctactcgggaggctgaggcacgagaatcactcgaacctgggagggcagaggttgcagcgagccgagataccgccactgcactgcagcctgggtgacagagtgacgctgtctcaaacaaataaataaataaaatgtaacaggcggcttcatttagcactttgaaatttggatttggaaagattcaagtttggatttggaaagattcaagtttgaatttcagcttcctggtatgagactctagatcacagaccatttccctgagttttagtttcccaaagtaaaatgagtaaaataaatgcatgcataaaaaaaagggggggataatgaggcgagacgtggtggctcatgcctgtaatcccagcactttgggaagctgaggcaggaggattgcatgagcccaggagttagagagcagcctgggtgacacgaaccctctctctaccaaaaaataaaaaaattagccgggcatggtggggcacgcctgtggtcacagctactcgggaggctgaggagggaggattgcctgagcctgggaggtcgaggttgcagtgagccgtgatcacaccactgcactgcagccttgacaacagagcaaaaccctgtctcaaaaaataaataaagaaaaaataggatcatgtcaagaagtgagttaacacatatggaatcaaaactagtatggtgtctgttgctgtaggaatatcaggaatgtccttttttctttatttccctccctattcaacccacgaccccaccttaccaggcagcgcacaatcagggggacaggttgagatcccattgctttggcatggagcatgggggtgataagaggctacaccttcttatgacctaatccaaaagtgaggcagatatgggctcccaggagaggggctggggattgaaactccacccccagcctaagggtggaggtccctctgatctgagaagcagaagcctcatgtggagaggaaaaagtgctcagaggaggaaaaactggccccatcgcctccaccttccatgaaaaaaaaaaagcctgcagtttttaaaaactgcctgatggcaaagagaccaaatgaccccagatctagaaagagaaaccagaggaagggttcctggctgctcttgctttctgtcactctttcctcctaagaagctcctcttcttagcccgcactctctgagctagagacctggtctcctctgcctcctccaggctgccagcaggacccagctccgctaggcccagggacacttaaagggaagcagaattcaggggcccgatgaatagcggttttgtctgggctgccttttaggatctgcgactgcagtggtggtgtgttctttttccctttaaagcggagtgtctgctggctctctctctcctctctctctccccttccccttcttattgagaatgccccctaaaaaaaaagacgccagccttctgctatttttcttctctctctgaaaatgagaacatcagctattgaagcggattgatgaactcttcccaaaagtttattaagggaaggttagacaaaggccccagggcccgcaggcgactgagcagtcagtatatatactgggcccttttgtccccccagggccgacgcatgaatacctctcaatggccctctttagagtgacaagatcaagccagacaacagcttgttaaaaggaactgcgagctgtttctctttttccagcccaaagctccgtccatcacttctcctgcattaatgtacatctgcagcgggaggaataatcggctggaattctgtcggttttgtgtgggtttttcttttttcttaaatacacccttctcctcctcttccctgcccccacctgcccctcctcgctcctgccctccccctccccccacaaaggtcctggagccatatgttactgagcccatcctggctgtgtcttcgagggaccccagggtgggtatttctggaagacagcaagagaagggggttctgaagcttctgttccttccagtgcatgcttataataatcaccccgtttccgaacacttactgtgtagcaggggctggactagggacccaggtgtaccatcgcctctgcagactttttcatcaaggtaggtgttattggccccacatgatggaagggaaagtgaggcaagagagaagtaactttctcagggaatcatctgggatgcaactctaggcctggcccactcttgggggctcaccctgattttcagctgctgcatgcaggacaggggttaaagccaaaagcaaatcttagccccagttctatggcaggcttctgcccggctgactatggctcaggcagctcagagagaatgtgttctgcaaggaaggtttgctggtagaagcctgaccccaaggacacgtggctgggcaaggttgtaggagagctggctggggttgacatttcataaacatgaagttgccttgggagaaacctttcttcattatcaatgctaagggaacccttgctcaaacaagccagggttatgcaaaactccaaaatttccttcatttgagctggagagtgtgtgtgcatatgtgtgtgtgcatgcacgtatatgtgtgtgtgtacacatatgtatgtgtgtgttgtgtgtgcatgcatgtgtaatgtgtgcatgcctgtatgtatatgtgtgtgcatatgtatttgtgtgcatgcatgtgactgtgtgcacataagcatgtgtgtgacatgtgtgtgtatgtgtgtgtctgtgtgtgtactgcagattcactgtcctagtgagttttgttctgtgttttcagctcctgcaccagattaggaccttctttgagagcaaggaccagtcaactacattttattctgctttgatctcacctatttagtgccagtgcaataccatatgcagaacaggtgctcaataaatgctccctaacttgagaacttctctgagacacctgagcaggaaaggggagggggcagccaggcctctgctgagaattgaaggcaaggctttccctccccctcctttccacttctcttcctccctctctcccaatcccacatctgtcttaatttgggtgctactgagggggcctgaaaagggagtgtccctaatgatcatggtgtagagaattccacccatgccatttaccttcaccttctaaggagcttccctgctagcagggccagggaggtcatttgtactcaccttccctggtggtttttcccctggggaaagagagagtggaaaggaaaggaccttaggcaagtagccaggtggagggaaaactgctcttgcctgagaggtgggaaccctgcctctgagtcctggtagcaggcaactgtcccatttggcctgggactttcctggttttcccactgagggtcccacattccagaaaagccttcagtcccaggcagactgggattgttgctcaccctaccccctggcgtgtaaggatcaatcccgtaggtccgtggggctcaggtacctgtcacaaggaacggcctcaacctcctcccacctttgttaaggaatgggttggaagggaagagtgactgcaaaagaattgggaaaagcccagcgggccatgtgctcgaggaccttacccttcggcatctgccccttgcgtggggtggttgaggggaagcatggatgtaggaggtcggaattcgtccacgtttgtgggtagaattggagcccagtggctggagcctggggtgtcctccttatcaacgctcccaaattggagcctctgtcaggggaggggcccctaggatagggccaaatgggcctcccatttggagcttggctctttgacttagaccaactcaagttcgaatcctggctctgccacttgctggctgggaggttttggccaagtcatccccctacctgtggaagacaggtgacaccactccaacccaactctgcccaggacacagcaggcctctgacacacgccacattcttctcttcctttctgctcttctcttcccctagacaccttattttttctggcttaaggacaaaattaggagggaggaaaacggaaaatccagatgccaagtccttccagggaaaccaaagtgggggatgattgaggcctgggaggtggagggagggttgttgtggagtcatcataatttaagaaatctgcctcccttccacgccccaagatgagcattactatttcatggatgattcaagtctaacttccccctaggaagggctgtgacccctgacccctgcaacctgtatttaccacgttcaaaagcccctactagccccagagagctgacctgagctgggaccaaggcaccaggactggcagggctataaacaagcctgcctccttgggctcaggaatcctgagtgaaaaaacagaagggggctcagaggtggggcccagtcctggcctgtgagccagcggctaaagggaggggagagaggactcacgggggtgggggacctggaggatgagttaggggagaaatgggcacataaggagctatttcctccccttgaccctcggttttcttggctgtaaaatggagcaaaagctactttgctcgttagggttttgtaaggctgaagtgaaatagtgagtgtaagggcttcagagtgctagaggggaaagtaaaaagcacacacgcatgctagagcagggggcatagaatagggagggggccaaagcatggaggattagacagttgacacgtggttgttagatgatcagtaaatctctgttgagaaataaatacccagagcttggctgaaacagaacaacgtgggtccatccctgccctcagaggcccccttgcttggtggggtagacaggcaaacagatatccctcccttcagtgtaagggttgccatgaggagtagggggcataggggctgtgggagagtcccgctttggggtccatgaggtggaaatgaattcgtctttattttttcaaactcacatttcctgtgcctctttgcagaaactttctgatctctcctcccaccccaaacttgcctttggtgtgtccacgtctcttggattagactttaatcctcctccagctccttgatgggcatgcagaggctgagaggatcgaactggcctttcccagcacttgctctgggactatctggaagcctgcacgctaactcagcccactgccccgccctgtaactgcagacaagaaatgacctccatgagcctcagtgttctcatctgtaaaatagggctaacaacacccacctcacagtgtcggacaaagccacgtgtggtgcctggcacacagtaggtgctcagagtatgggcctggagcccatgctggctttctggctgcagcacacaagagcctgggctccctcggccaactgggcctggcctttgaagcttagtgtggctccttattatggcaattaattacccagggacaatggagcacagccctgccctctgcccgcgccttccagtgacagggggtgggcggagggcgccgggagggggaagttaagcggctgcctgtttgtttatgggcacaggaagctttattggttttacactccagcctgttctgaaatcaaagacgatttccagggagcaggtgggagtcagccacttggagctcagagagtggctttgtttattttgggggccctgactgagcacaacctggtctctgcctgcaccagtgtcctagagacctgctctggggttgggcaacaggagttggtgcttcgctgggggtagggtgggtgctggggggttgaggggggcgaggaggcagctcctcctgcaggcctgggaggagagggagctttggtttcccaaagcctggggtgagtgctgctgaagttatgtgacccggccttggccaagctactcctgctctctgagctttggtgatcttgccttcaaaacgggcctaaagatgacccctgccccggcagtcttggagaatgcgcggggcaatgctcattggtgtggttccatgaggcgacctttctgcagtcctggaatttgcagtgctcctttgttccttctttagttcattcattcattcattcattcattcactcattctctcatcctgtaagagagcctgtagattcacacttctacttggaattagagaaaagaaagctggtttctcaaattcaaaaacattgtattagttctagttttttgtttgtttgtttgttttgttttgtttttgttttgagacagagtctcactctgtcacccaggctgaagtgcagtggcacaatctaagctcgctgcagcctccgcctcctgagttcaaccagttctcctgcctcagcctcccgagtagctggggttacagggacacgccatcatgctcagttaaatttttttgtacttttagtagagatggggtttcaccatgttggccaggatggtctaaatgtctgacctcaggtgatcctcctgccttggactcccaaagtcctgggattacaggcatgagccaccacacccagcctgtaagttctttatattgaaggaatcacatattattgtgaagaaaaaaaaaaaacctcaaacactaaaagaatatagaaagtaaaaaagcttgtcagcctctgcttcctactctccagagttaaatacaatgaataacttgggagtctgatcttctagatgtttctccacagagaaacggcacatctatacatatgtttattttgacaaagtgggattgtgcaacagacactgctctggacttaatcagttaataatgtgtccaggacatcattttccggaggctggttccttctcgacacctcgccagtgatgggttttacccattgttttatcaccttcaacctgatggtagctgagccctgggctcatcacttccacctgttaactgaggagccattgctgtccccattgtacagatgataagactgagggccagagaagctggatgatttcttcaggtctcctgctagaaagcagatgaactggaatttgtggggtttgttttgttttgttctgttttgtttttgagacagagtcttgctctgttacccaggctggagtgcagtggcatgatctcagctcattgcaacctctgcctcccatgttcaaacgattcttgtgcctcagcctctcgagtagctgggattacagccatgtgccaccatgcccagctaatttttatattttcaatagaggtggggtttcgccatgttggccagctggtctgaaactcctggcttcaagtgatccacccgtctcggcctcccaaagtgctgggcttacaggcgtgagccaccacagccagcctgagctggaatttgaatttgggttttctgactctcaatcctctaggataatttggggtacgtggaggaactggccgtatcctaagttcagaagacagactccagacaagaagtataacagcctgtggtgaaagatacgtggtattgacatcttcccacaggtcaggaacagttatcactttaacatagccttgaagttcaggccagctgctaccagcccatgccagatggcttcttagtgccacagtcttcccttttccctcccagtgagaaagcacagaggtgaaatgggggcttagaaagcccccaccccacccactggccttaataaagtgggattccagggctgcaattcacttttccaatccaggatcttgaaactcacagctctcccagatcgttgtaccaagattgggacctggagctgaaagagcttctccagcagacactcctcagatgtcagctctggaagcatccagtctgaccctctcactttcacagatggatgggcagaggccccaggaaggttaagtgacttgcccaaggtcacacagctaatcagtggcagagctgggacagattcccttttgttggaaagatgatctcgtgcctctgaggcggtagtgacctctctcctggcccctgtcagcctatggccacatctgagtttttccttcccaactgttgaaagtcttccaaacctcggggaggccgggaggcgtaacaaatggggagctggtgacctggaagagggaacaccatgcctggggaaggggagggaggagggcgaggcagccacacgaaagtccagttaccaggctgtcacagcactctcatttggtcagcactttacagtttatgaagcttgtcccaagctgtgatcctcacagccctctatgaactagccttgtcatccctattttccacatggggaaatcgagaggctcagaggatgacatccgttgctcagagtcccacagtaagtgatggaatgtcagatctggggtgaggcaggggcagcttgggaccatctagtcctatccccccattttacagatcaggaaggtgagcccccgagaaggggaggctaggagctccctgttgtaatgctcatttccctagacatatgctggcctcctgggcatatgatggtaaaccccaaatcctgaagggagactggatgatgtgttccctttccagggagcgtgcttcttgacagggcctagtgggagacattaccctttggttccagtgattctaaacctggcagtgtagtgtggtggctaatcttgagtcagctggacccaagctccagtcctgactctgctgtgtgtccttaggaagatgacatctctctgtgcctcagtctgctcacgtgcaatatagagctccattacagggtggttgagtgggttagatgatgtgatgtgtgcacacagcttagcagcgagcctgggcacagtaagtgctcagtaaaggttagcagcttattattatttcttaaatcagggcctagtgagaggggtggaggatgtcccagctctcaacctcaatggccttaacaacacacctatggcacatgaccttcacaggtctctagccaacctgtgaaggtgagcaatgaggcgggcttgtgcctggaactagagagatatggcatgagcgggctcgggtggcattgcttttttttcctttttctttctcttttgtttttgagacagagtctcactctgtcaccaggctggagtgcagtggcacgatctcggctcaccgcaacctccacctccctagttcaagcaattctcctgcctcagcttcccgagtagctgggactataggcacgtgccaccacacccagctaatttttgtatgtttagtagagatggggcttaccatgttggccaggatggtctccatctcttgacctcgtgatccacctgcctcaccctcccaaagtgctgggattacaggcgtgagccactgcgcccagccttttttttttttttttgaaacagagtcttgctttgttgcccaggctggagtacatggcataatcttggttcactgcatactctgcctcccatgttcaagagattctcctgcctcagcctccccagtagctgggactacaggcgtgcaccaccatgcctgactgatttttttgtattttaaatagagacaaagtttcgccacgttgtccaggctggtctcaaactcctgacctctggtgatccgcctgcttcagcctcccaaagtgctgggattacaggcatgagccaccatgcccggctggggtggcatttcagctgcagaaatggtgaagttttcctgtagaaaaaagaaagaggctgggcattgtggctccagcctgtaatcctagcacctcaggaggctgaggcaggaggatcgcttgggcccaggagtttgaaaccagtctgggcagcgtagctccgtctcaataaaataagactgcatctcaataaaaataaaagaaaggtggtagttcatttgcacctcctttccccaggctgtgcccatctaattcattctgtttcaaaatcatcatttaatttagaggggaaaaaaatagctctgcagaccagggctgaaggccaactccaaaccttgggtctgtcccccacccctttgcacttagtggcctggctgtggtctaggggaggccccgaacttgctgtgatctgtggggacctcataggctctccaaagaagttgtcagggaaggaggtggcatagtccctgccacaggccccagaaaggctgatggcacagatgaacatacctgcaaatgccatagtcttcctaatagctgcccagcaacattttcaggggtgctaagggcctgcggtcagctttgatcctcttagcccccaatctgagtaaaggtgatgccagccagtgattgtgggcaaaggctttggggtgggggaaagggttgatggggcctggagggtgactgagggaggcatctagccaatcacagagccctgacaccaccccattgcccggcaaagtcctcggggttcaacccttcacccaggtgctgtttggctgcgctccacctggagacaggctttgaaagtgaattatttgaaactgaggaagtcaaggcctcgggcctctcagcattctcagagcaaacaaacttttggcaagttcagagaaaaggaagtgggattgaatttcctcttcgactcacctggggaaaaattcagactgcttggtggtgggggcatcagggacctggctccaggataggctgagggagtgggggtcctctggggtcattgagaagggtccctgagacgctccgtagcttctccatagcagctggttctagagctaagggctaccaagtttggacagttcttcgtttggtctgatttcattccctcctgctgcagatcaaaagacagcttctcccttgctcaccagctgagttgaggagtcaggttcaagtcctgaccctagctgtgtgtgctgtcagataagctgctttacctctctgtgcctttcctcatctataaaattggggaaaataataattgccccctcagaagttctgggccaagtggaaaattttacaagaagggaagaggtggggagaagtttgtacagtggttgggttttgcccgcatcttcagagagtggaaggaaggaaggaaggaaaaaagaaggagagaaggaaggagaaaggaaggaaggaaggaaggaaggaaggaaggaaggaaggaaggaaggaaggaaggaaggaaggaaggaaggagctttggtctgcacacaccccggagcagcagcccggtaaaagcggatctttccccaagaagccagattctcataaaactacggagcgccaggaggacaaatcacagaaggtagatagtggaggatgcggtggagggattgagattagacataaggaaacacaaacctgttagtatctacaagtcatggaatcctgggtttaagggggtggaaatttgagggccattgaaaagaactctacaaatgtggtagagtcagggatatggtgtcaatgaccttcctgcatcacacccaggaactctggcccacctgcctacttatgtgggatccctgtccctaagctagcctaaccagcactgggggttgatgaaggtccaatctttgctttcctcattccccagccaaggccagtaggacacatgccctctccccagctcccaatcctccctttcctctgaggaattagctacatgcctcccagctgagccatcaaaggatgcttcctctacatcccagtctcctaaccatgctgcctctggaaccgagtaaaatatgggaaacttccgggcaaaacccaggagcccaggagcaggggttctcagccttggctgcacacgagattcatatgagggagctttcacaaatcccagtgcccaagatgcaccacagccccattaaatcaaaatggacagggggtggggcagtattttttaaagctccttgagtgattccaaggagcagcccaggctgagaagttctggcccagagtcagagctgtggatattccagccacattagatgcctgagccacaccctctgaatttcaacgtcctggcccacacaaagcaggcactgtcaggatcatctcacagagctgtaaggcaggcaagaagagaaagcagtgtgaggcagcagtgcctggcacctagtaggtgctcagtaaatgcttgttaaaaataataacaatggccaggtgtggtggctcacacctgtaatcccagcactttgggaggccaaggcaggcaaactgcttgaggttaggagttagagacaatccctagcaacatagtgagaccccatctttacaaaaaatttaaaaaaaattagctgggcatggtggcatgtacttgtggtcccagctactcaggaggctaaggtgggaggatggcatgagcctgggaggtcggggctgcagtgagccttgatcttgccactgcactgcagcctgggcaacagagtgagactctgtttcaaaatcataataatgacataacaataataataacagctctcatttttgcaatgcctacctggtaccagatactttgcatgcattcacataaacttttctctggacctgaatgattcctgggattggcaccacatttcccaagaggagggctgcctttgtcctggtttgaggcaggcgggtgtgtctggaagccctggagcaggaccctggctggttcttgtttggacacatcttaggtaaccttcagcaaacagtgactcagccgccttggctatagatgagttcttcccaggccaggcctggcttcctcaagtttcctcctgcaacatgtcagggcccaggaggatgtgctaagcacctgtgttggttttccttgggggcccttgggagggatcgggggccaagggacaggggtctctcctttccttctgctttctgaagtgcttgttttgctggagcatcttcctgcctgctagatgctggggctcagagaggcagagtgagcagcccaagggcaccaggattcaaacctagtcctcagtctctaaagctatattctgctggcagcctctggttccacatagcaggggagtagaggaggaatccatagcctctttagagctccacagctggtgtcccgagtcagtggccttaggatttagcaaaaacagtgaccatatggtggcaccctcaggagatctgctgttggccaccccttcaccccttactgataaacccctagagtgtctgagaaccagtcccagctccctcactgactgccgtgtgacctctagcaagtcacattccctctctgggctcagtatttgcatctggaagacaatgagttgggactaggttatctctcaggttgcttccagcttgaaccgactcttttgatgcagagaggatgtctcagacattggagacaaagtccgtactgggggaagctgtcccaaaaaggaaggctggtgcctgccccagacctgagtacaatcccatactctgctgcttagaagctttgagacgtggacagtagcttggcctctctgagttctggcttctttatctgcaaatgaaatgataatggttgcaacatagttgtaatggataaaggagctaatccacaaaaagcccttaatagggaggccaaggcaggtggatcacgaggtcaggagttcgagaccagtctggccaacatggtgaaaccccgtctctactaaaaatacaaaaattagctgggcgtggtggcacgtgcctgtaggccagctactcgggaggctgaagcaggagaatcatttgaacccaggaggcagaggttgcagtgagccgagatcgtgccactgcactccagtctgggtgacagagtgagactccatctcaaaaaaaaaaaaaaaaaaaagagcccttaacagctcctggtacataggaagcactttttatgagctgaaattatcactgatgaggatttctctgcatcttagaccccctgcctataaatagtacctaccttgtagagccatggcaaggctaaaatgaaacagtaagtgcctgtagcttggtgtccagcaaatgatcccaactattgtaaaatcaattatttgcatgggtgtggctgagtctcctgtttccaacccccatcatgagagcagaaactaaggagtggagcattgcagggcaggatggaggtggcttttgtttgccctgcccagggtgccaaagacattcagttcccaaagtcctgagtgcccaggcccaggggacctgtctgcgcccctcccacctcctcggctgtggcactaccagccctagcccaggccttgttctccactaagcacctctccactctcttgctttccctcgggcctgagctctcaacccctaattcatgaaacctgttgactcagggcccagacctgcagccccaggcatccgtccgtcagtctatctgtccatccgtcacaccagaagccttgctggcctctctccagggcctggtcagagggtgccagccagccggcaggggctgcaggccatggagacgacagcccgggcccgtgcgagtccctccacctggctccttgtcccatcaggcaccacttaagaggatgtaccgttacatgtagagggcaaaggcagggctggagacgccttcagaaatggaaatgggacccatttgtttataatttactctctgacacttaacaggaacctgatgggaccaataaaggctcagaactcacccaactcctgcctcaaaagtgctggagccggtccagttctctagaggcaaacacatctcaaagcctggcaaaccgcttggctcccagcaccccataccccctcgctccctccctcctcgctaaacttttgaaagacccctcactgttccctagctcagtgggcctgccagcctttccaagctgtggggcaggaaggcagcaggacttgcttttgaggtagagaggggcctagaaggcaattcgggagaggactagaatattctgggcacaaggtaggcaaagagagggggccagtgatggaggaggaatccagttttcaattttcctcaacagaaaaatgagtgcatgagagacagaataattttccagtgtgcaggccctaagtgaaacctccttgagacattgtgagtcattaaagaggaggaaagaaaagaaatggtaaaatcagtttgcctttagcagaactgtacaatgcactcttatttccaggggaatctaattagagggcagacagccgagcctggaaggggaagaaagccagaggttggggctgggaggccccagtgggccaggtgggaggagggtgtgatggtggaggttgggccctgggaggacgaccttggagagacatattccctcccagcatctcggagggctcagcaggcctggattcaaatcctgaatcttggccctgccttatatctttgggttggtggcataaccagtacctccactttcttcattttaaaatgggaacaggccaggcctggtggttcatacctgtaaccccagtgctttgggagactgaagcaggaggatcactcgaggccaggagctggcatagcaagaccctaactctataaaaaaaaaaaaaaattaaaaaatgagccaggcatggtggtgcccacctgtagtcctagctgcttgggaggtcgaggcaggaggatcacttaagcccaggagttagaggctgcactgagctataattgcatcactgcacttcagcctgggtgacagaacaagaccctgtctcttaaaaaaaaaaaagtaaataaataactaaataaaataggaataataaagttcctgttggtgtagttgtcaagatgaaatgagggaatgtctgagcagagtatggcacatacagggcactctgtgagtgtttgtttctgtccctcctcattcaccaaggtgatcagcctgatgtccaaccctaacagcttcctcatcccacgcacccttgataataccctttactttccagaatctccctttgccatctcctgttctttcaccactgcccctctgaaactagccaccaggtcccctggcatcctggtattacagatctagcttagcctctgagaccaccaagccatccccttcccccatctcttacagaatacataagattcttataataaaatatcaacttttttttgtttagaaacatgtaacaggaaataaatgtcctcaggattgtaagggtgcgccatgcacccacccagcagaaccatggctggcaggaggtgtgtgtccttccatgtcaatttcaggaaacacgaggtgcagcatcttcccaggatatgcatccctgtctcagatgcagtgtcccctcctgccaaatgcggccctagactggagagcactgtgtttttttttttttttttttttgtgagactaagtctcgctcgctctgtcgcccaggctggagtgcaatggcgagatctgggctcactgcaacctccgcctcccatgtttaagcaattctcctgcctcagcctcccgagtagctgggattataagcatgtactaccacgcccggctaatttttgtagttttggtagagaggggggtttcatcaggttggccaggctagtcttgaactgacctcaggtgatctgcctgcctcagcctccgaaaatgctgggatgacaggagtgagccactgcatctggccagagcactggtattttatgaagcctctatcggggctatttagagcaagcacagcacggcgctgatgcggggaagaggaggtaaaagattgtggatgcagcagcactggcacatgcagagctgcaatttccaaggcctcctcactgccctcccttagtgaaagggagttggagtggcaaggggtctgtagcgtgggttccgactcccgatgggcctgggttcaagtcctgacccagccacatatagctgtgtgaccttggataaatcactgcccctctcagagtctcttctttaggactggtttaatattgatgcctaccatctctgagcgcttggaatgatgacaattacgcatgcaaagcttagtacctggcataaggcaagagcgtcatagacacccgttaccactgttttatccccatggagaagaccacatgctcttcagaactaagaagcccaatcccacacggtcagctccttaagtgaacacatttttgtccactcccaaatatctagaagcatgacttcgtgccctgtcagaaccagtgtgttttcagattgtaccaccccctgctagtttaatgtaactaacctatggttggccacatttttggaaaataacattgtttatttgatcaagattcagtaaactgggctcagagcaataattgtcccagggtgcgagtaacagattttatttttattgatcaaaaaaaagtttttatctaaaacacatcaaacttttaaaaggcgtcaacagcaggatcaaattggattttaactcctttaaaaagtggctccttcaggaacccattccaaagatgtccgaccctttgcagtgagatactcaaaccccagggtggatgagggattccacgggcaagggaggttattttggagccataatgaagacactgcatttgcatttgggggccctctgagcagctgagacatctggaagcagaagggggaattcgacggaatatctgtgtgttggtttagagtgtcagtcctcgacctcttggaactgttcagctggctagctggggcttccagcgtggggccaggtgtctggtgttgcataaatacatctctaatgaaattattgtacaaaacaatcctaacacactcaccaacaatcacgttggcttgaagagcaaactatttggaacattgcaccttattgcacagatctggccatataggaggacgcaattctttgactccttcaacaaatgtctgttgagcaattaccatgggccaggccctcttctgggcattgaggataaagcaatgaataaaacagataaaatccttatcttcttggagcggaaacagggttcctccaaataattcaagaggggaggctggaagacagctcatggaggaggtaggtgtccggtgtggttcctgacttcagtcttttaaaggccactctcctgatactatgacggctctttctccttgcaaacaccagtgacacacctgattgctgaacacaaaggaaaagatggtgaggagaaacgggacttagggaaagagccagggtggagaagaagaggtgaaaagaggtgagttcagagcccggagcaggcagggaggcaggcttccaggctgtggtctgtcaagaatctgatggcacagccaccatggcaagttgcaggagcaggcacagagaaagaagttcctcctccaagctggcccccttggcatcgtctccacccttcccatgtgaaaaagatccagggctttggagccacgaggggctagggcatggcaccgctgtctgtccccctttttccactgtgctgatgggtgagaggggttgtgtgtttctccccaggctcttgctccctttcacagagcagcgtggtcctgtttatttgctgatgctggttttctctgcatttctatagaacagtggttctcaaattgtgaaccacccccaccaacagcagtggcagcatcatctgggaacttgctgggaatgagacttcctaggctccctcatggggcccaacaacctgtgtttccagaggccctctaggtgattctgatgctgctaacacttgacagctggtctagaagatgttggggaggtggcttgctttgcttaaaatgcattcattggcttcggtgtctgccccacctgggtttggatggagactttgctgcttagcatctgagcaagtctgcacctctttttgagtgtttgaaagagtcctcttcccacgagatgattgtgagggttctatgaaaggatgtagtgcacgatgacttcctgggacatagtggaccctcagcagcccccttctttcctctgtggctgccttacctgacacacgcccaccatgaaaaaaagccgaaagtgtccaataggcacgtgccgatcgccttggaaaaatcaacctcaccaactctgacagcaacagaaccacagcatcttagaatcacagaatcttaagatgttagaaccaaaaagggaatatttagccccacccagcctacccagtttttatgggtgaaggaacagaggctcagagagaccacctacctggccaaggtgacatagcatgtcagggcatctctcctctccccagcccaattgcatgccggtgctgtcctgggctctggaggtggggtaattaatacatcagatacagcccaggaccccttctcaggctgtccccccaaccccacctgctgtcctgctctctgaacagctttgcagagactcttagccaggaagccgaaatgagcccccggctgctttttgtaaacagcttttgaagtctcattttctgtcgcagctctcataactagctcagaacggggctcatacctgtgttcgaccccgatgtgttgagtgaattcatatcttgaaggcatggctctaagttcgagtctctctttcacttcttctcttggtggtgtctcgggggccaggagtcccggcagcggggagatgcagcaggccccagggtcgctcccctgatcagggcaggtgacagccctcacttagcctcccatctgcccaccagcatccctgcaccaggagctggctccaagccggggtccgctcaggaccaagttttccagggttggggcatctgcctgacataatacgtaacagtaattaagaaataagccacctcgcccagcttcacagcaatcatttggctaagtaactaccatggtccagtgcctcaaaaatcaccattagagtacgctccttatggccataaaatttctcgttttctgcctttcaccagcctccccctgccatcttcgccttgctttatttatacattcgtcctcaaacaatggcaataaactctttcccagagtgttgcaaatcagaaatttgtccacatttttccaccaccttccactgtggacctgctctgcctgggaacggcccatccaggccagctggagagggctgggttgcagtagattgatgggggcacgacaggttggggttgctggggagagagggtggggaggggggcagcgggagaatgcaccatgaaaggcctctcgctgcccagcgaccagccggagacacaagaggcccatgagtggctgggggaggggaggggaggggaggggaagttgggggaggagaggggaaaggaaggataagtcttccccacccccttctcctaagaggaaaagagggggattgggggatcctgggaggcagggcaggccccaggcagaatgggagggtgatgaaattggtccttcccctcccccacaggaagcagatgatctcagggtgtcctgtagctcatgctgcacacgcaacttaggatcatagtcccttctgaaactcctcaccacccccaccagtcaatgatcctttctccagcaacaggcattgttgagagccagccccgctgtatgcctggcactgtcctgaaccctgaaggtggagtttatccatcagatacagcccagaccccttctcagggggctgttctttgagatccaggaagaccccttggttttaggggtagggaaaatgcagctcagagaggggtttagaggtgaagtcagggacaaacttcagggtttcaaccccaagccccctcgtctttacagccagcccacgggctcctgggggatgcccctctgggcaaggtgaagagtcctctcatctaaatggggcatgctagctgactgtaggtgatttgggggacacttccgccctgacaactcgtgttttaatctggcattcctggaggcagtagcaggggaaataaccaagttgatggctttggtgttggtgtctccagagggtgaagtctgtttcatagggtgggcttctcaggtggagatcttgtttctaaggggggcggcatggcctccattacagcaactgccccagtggtgggggtgtcaggcttatgtttccagtgatcctgcttgactttctcatcagcactccaggaccggcgcacagcagacccatctttcggagagtgggtctctttcatggtggcatgatcctgagacccctagttcctgttgcaatgaacattcactgctgtagcttttgttagtgtggtttgtgaggcaccagtgggtgcttggtgaacacctgttgggcacatgcttctctgtacaccttgttaggtgcacagaatgttaggtttcagagttttcctgggaggcctatttgaaggaagatagaaatgtggggatagacgggaagctggaagcatagaaataactctggagggaaaagaaactggcacagagtcctgggagagaagctgtgactctggggaagcttaatcagttctccttgctgtgtgtgtaatgatgagggtccgtggcttctttatttaactgatggctgcagttcctttagactgtgattaaaagcattctagccaggcgcagtggctcacggctgtaatctcagcactttgggaggctgaggtgggcagatcacaaagtcaggagttcaagaccagcctgaccaatatggtgcaaccctgtctctactaagcatacaaaaattagccgggcgtggtggcattctcctgtagtcccagctactccggaggctgaggcaggagaaatgcttcaacccaggaggtggaggttacactgagccaagatcgtgccactgcactccagcctgggtgacagagcgagactccgtctgaaaaaaaaaaaaaagaaaaagaaaagaaagaaagaaaagaagcatttagccgggcgcagtggctcacgcctgtaatcccagcactttgggaggccgaagcaggtggattacctgaggttgggaattcgtgaccagcctgaccaacatggagaaaccctgtttctactaaaaatacaaaattagctgagcatggtggtgcatgcctactcaagaggctgagacaggagaatcgcttgaacccaggaggcggaggttgcagtgagccgagattgtgccattgcactccagcttggacaacaagagcaaaactctatctcaaaaataaaaaaaaaagtgttctagaatgataggaactacagagctgttcttagttaccctgccctcgagtaatgcccgatataagaaaaaatagagtttccatcctcgaggaactccctgtcttattgtaaaggcaccatctctaccctgagctgtcctcagtttgatggggagatggactttccacacatatccactaaaagctaatgattagtctccagcaggagttgataccaagggctgagaagatggcacaggcagcaagtgccacagggattcaagcagagttctctggatgtggtagtcctggagggcttcatggattatgtggccttcatgtctagattgggaggatggtggggttagacaacaggaactaatttgaagccatcatcccagggcacaagtcggtatggaggctggaagtggctctgcagggtgggcatgtttgagcctgtgcaggagacctggcatggcacgctcagaagtgcccatcgcgatggttaagagggctctgggactggctgcctggccgtcacggtcactctgccattgagttacttaacccctttgagcctcagttttcacacctgtaaaatggggctaatagaaatactgatgagcattgtagtgaggtgttgtgatttgctacaggaaaggtgcttcgtaaggtcaaagcacaccagcagcggtttgaacgcttcttctctgtggccttcacacccagccccactgggggatgctgcatgggttcacagagccccatcttcagggtagagtgagccccaggtttaagtccttcttcatggctgagcccggaagcagggagttacatggacagagggacgaggcccaaagccattttccatctccacctccaaacaactttccaactggacacagcccctgtgtctcccagggctccagcactgaggaggggtgagggcgtggggagggggagaaggagggtcccgcaggcttggcctctcaggcatatggtcctttcacagccgctttgtggggcgcggatgggtggtcaggctgccttttcctttccatgccgggcagcttcatctggccactggagccccagctgctgctctttcccctctgctgattttgagacctctccttaggcctcccctgctccagcttcctgggcgtctgtcttcctctggccccttagtgcctctagcatttatgctacagctgaatcacttacctgagaccacctggccccctcttctctgtaggtacattttgcatccaggacagatttctgggaaaaggatgggatgggatggacgtggggtctgtaggcatggcttggggatctgcaaagcctccaccgtggaagaataaggaaaggatgacaaaggcatgttcattcattcagtcagttgttcattcattcaggcatttgttcattcattcatccatgcattcattccttgcctttgtgttttgcgccaggcaactgtgcttgcctctgagggatacagaagtaaaataggtccacactacatggaggggccaataataacaatagcagcaataataatcgctaacatggattgggtgcttactgagtacctggaactgttcttgccttgcagtaattcctttcatctttgtgcatgacaactctgtggggttggtactattcttgtcctcattttacagatgaggaaattgaggcccagagggatgaagttactttcctaggttagtggggggctgggacagttgtatcaagggtacctctgtctgtgtatttctcaaggttcccacccctggagctgcatcagtaccctagggaataggcaggatggcagctcttattcccagggggatggataagcaaatagagattccaagaggacaagtgacaagtgacatgctcagggtcacacagcaggtcatggatgagcccagagtgccaactccccacctgccaggcttctgttctgaaggagaggagagactgggtctgggattggtggctggcaggctggccagcccaggagcgcctgtcacacacaaggctgggagctcagcctccatctagttttcctcacctcccctcctcctttctgtctcccatcactctcaccatttagaaataacaagaacgaggctcaggacttaaacatacccaggagttatggctggtaggaggcagattccgaactcaaacccaggtccgtctgacctcactgcctctactcttctcacctctcccccagtgccagcccttgctacctccaccacactttgtaagataggaccaagcgggcaagcccttcaggagcagcatagtgacctctgctctgcccagcacaatcgttgctctccctgctgcttaaataacttggatgagtaaatgattgaaataacccatgagagaagtgaatgagaactagtgagtaatttcaagatggacttaaagtcacaggaagagtgtaaaagattttgagccgggcgcggtggctcacgcctgtaatcccagcactttgggaggctttgggaggctaaggtgggcagatcacctgagctcaggagttcaagaccagcctgaccaacatggagaaacccactctctactaaaaatacaaagttagccaggcatggtggcacatgcctgtaatcccagctactcggaaggctgaggcaggagaatcgcttgaacctgggaggcggaggttgcggtgagctgagattgtaccattgcactccagcctgggcaacaagagcaaaactccgtaaaaaaaaaaaaaaaaaaaaaaaaagattttgagctgagctcctcatagagtgggcctgcccctgcccccaaggtgccctcttaaaatgtcccacctcatcctcctcactaattcacagctgccaccccttccaaaactccatattagctgcacaggacaccagcatgttaaagagaccaagttagaagggtcctcatgatatcttcaacttcaacctcttgcttcatctcccatatgtgctttgtgcttggttcacagcttggcgcagaagaaagagctctgggtctgccacgagaatacagggctctgaattctgtccatgcaactacacagtaccatttccagcagtactacttccttcttcctagaaaggctctttcctggcaggaatgtatacacagtgccctctagtgtctaaggacagtaccatgctgctagcagagagccaggatcagagaatgccccactgcagtttccccttgcatcagattttgtggtgcaaatcatctacctagggcttagaatttattttattttattttattttattttattttattttattttattttattttatttatttttattttttgatacggcgtttcattcttgttgcccaggctggagtgcaatggtgcaatctcagcttactgcaacctctgcctcacgggttcaagtgattcttctgcctcagctgggattacaggcatgcaccaacatgtctggctaattttgtatttttagtagagacgggtttcaccatgttggtcaggctggtctcgaactcctgacctcagatgatccacccaccttggcctcccaaagtgctgggattacaggtgtgggccactatgtccggccgggcttagaattttaaaatccggcctggtggggttcgatgggagctccctggagaaaaagttttgtcaagttttgtgaacaaggtgagagtccaactctggctttcctaaagacactctcctccctccctcctctccttgagttgggagagtgaaattgaacctgtgggggtctctcagtcactgggagagagtgtaggatttggagtcagacagagcatatttggatcctcacattgccaatgcttcctagcccccaggaggcctctggggcagccagaggacctggccatggagcctgaggcctaggttctggttaggggccggtgggacccttcagacgtcagcatggaggagtcttgccctttgccagctgttgggccccatggagggggaggagccatgttgccccctttctagaatctccttcgagaagaagcaagaagtgttctccctggatcaatgccagctcaccctgtcttcttcccagtggagaactggggatgggaggagcagcctgaagtgggcgggactccagccctagaaaaccccacattagaatcccaccctgccaccttctggcagtggccctgggcaagtccctgagactctgagctgccaccccctcctctggggccagcaacttggtggtttagccttggtccaagggctggagataatggactccccagatgtgctgtggccttaagacattctcggcccctcctgggtctgcctgggaaggggagagaggaggtgctgccgggctgtgggggcggggtaggcaggacctagggagttgatggagaacccatctttcaaggactggtctcaaggggaatatgcagagccccctccctgctcctgtaccctcactcaatccccttctccacctgtccctgcacagctgcccagctgcctgggtggggcagggcacctggctggggtccctgctcaccaggacaggggagtacctgtgtgggggaagtggatgggggtcaggaaagtggtcagctacagccagaaaccagagcagggccaactggtcaggcggttgactcagtggctctatccaggacctgacctcccctccacccatctcccctgcacccccagagtagggctgggttgatttcacctttgaactcctagatactgggactgagtgagcacacagacacatttgaaatgaatcaagcgtggatagttttgctctgtctcagcaatgagaatgcagctatggataccttagacccagagcaccgaggaaggcttacctgtccccggcactgttgtttttctaaatttcgttttctttgaacattcagttgttaccaacccagcactactttatgtgccgtaagataccaagtcattttatcatccattcattcatgcaacaaatatttgagtgtccactttgtgctgagcattggagattcggcaacgaatcaatgaatttgaatgaatttggacagtcaatgctcttgactatccaaaggacagtcaagaatgcccattggccgggtgcggtggctcatgcctgtaatcccagcactgtgggaggctgaggcggatggatcatctgaggtcaggagtttgagaccagcctggccaaaatggcaaaaccttgtctctgctaaaaatacaaaaattagtccggcacggtggtcggtgcctctaatcccagctactcgggaggctaaggcatgagaatcacttgagcctgggaggcggatgttgcagtgagctgagatcaagccaccgcactcaagtgtgggcaacacagggagactgtctcaaaaataataataataataatacccatccttgtggagtgtgcggtgggtggtggatgggtgctggggacagatgacaaaacagaatacatagcacgtctgtgattgtgctgagggagggtcgagggtttctctgttattatctgtgttttcacatgtgggggccacagaatccagccagactgagcccggagtctgtgctcctcagtgcccgctcttcctggcctgacccgctgcaaactgcaggggttcaccaggccatgaggagggtgggacagggcatgggcagagggcacagcctttgcaaagccctgccattgctggggaagaaggtggtggctggagtccaggaagagatggggtgggcggatgccaggacaggttccaagctaacagggactcgggatctcctggcctcagtgctgggccagctgcatgagaggcgtgaagggagaggaggggatgaaggacagtgctggctgggtatggtgcccaatgctgagatgagctcccaaaaggagtgtgagcagaagaggtggactgtaatgggacgcttcatcctctcctgggcccccaaggaggtttaacttggattccaagcccctgcctctcagtctgctcctccgtcgccctgtccttgtgtgcaatctgactcccgcagccacgcccgagccccgtacaccgtgcgctggttacagctgagcagttccctcggaggagcagggagggcccttgccatggtcccggcttgccgggcccccagctgagctgtaaatgacttttccattttctgagacctgcgcccaggcctgtttggtattcagagacgcctggcccacactcgccagctctcagctctgcccgaattacttgattaaaacgcatatcaactattatgtgattcgtttctctgccgcagctcaacaccggggcctatgttaaactgtaagaaaagctgggttgggaggctgcgggagaggggagcgcagaagcaggggtgggagggtttccggagggtgtgagggaggctgagagaaggaccccaaacctcagggccactgccggcctccactgatccgggatgggtgatttagaaatgggtcagctcctggtcctctgtgagctgggtagattcagagattgtggccaccttatttcaaggcttttcctctggcaaaagagggaggagggaaaggttggggatggaagagaagccacgttggttttcaggaccagaaatggaattttccatcacccgggaacttgctgtagccatattggccttctccgggctgggagtcctgagtcctgggtttactttgcagccccactgccctgagactccactgaacatctgtagaatggggataacactgcctgccttcccctccctttattgggagaaactgttgggacaacaaaagggcttgtaaactgtagagtgttgtgtgcaagttcggggggtgactgctgcagtgtgtcagagtttaagagagactttgccaagctctgtcaagctctattcattcaagaggcctttattgagcacatgctgtgtcctaggcatagtccctgccgcactcaaggatctcccagaccagtgagacccacagacccataaacagtctagttcagtgtctcctgatgagctttgagaacgccaagaaagggaactgaaatcaccttggatgggcccaggaagccttgctgggggaggtggcccaagagctggatggtgctgggtgagcactcccaggaagagggaaggcactctgagcagaggaagctcatgttcaaaggcgtcaaagcaagacccacctggctcactcactcacagaagccatgagtggctggacagggaactgtatgggatggcaaggtgagtggggacacatgggcaaggcccatagtggttgaggccttgctggcgtggctgaggcttcctggcacatgctggcagtcagtgatggcttccagaggtcagtagctgtgaaaggaggctttgaagggagaggcaaaggctgggggagagatgatgggagctgcccccagcaaccttccatccatcaccatcaccatcaccatcaccatcaccatcaccaccatcacctcagcctgggccggactttgcctggccaacttgctcctgcccaccccaaagctttgacaacgcaaatggctcccagcaccttccgcccctcattctgtcctaaggctctgctgctttaacgagccacaagctgccttgatgttttacgtctgtcctgtgccccggttcatctggcagtgtttcctccactggactggaaaatccccaggacaaggtgatacctcctccatctgactgggagcttcctaaaacagaggctgtttctcccccatgagattgggaggtctctcaggtaggagctgcaattctcctttgctcagtatggactgctccacatccctaactagagacaggatccaggaactcagagaaagcatctctccctgtatccttctcttttggggcaatctccagaccagcaccccctgggaccatcccattccttagctgtttgatagtgcgagggcaggagcccaggctggccatgaggctgctcccctactgcgtaccccgaatctggctgccgtttaatgaatgcgttcccatgttcactccccccacgtccccctcctcgaaccagctgcccaggcttcaccaaggtacctgcttttggtacacagaagactcagccccaaccagcagggcctctgtggccaattccacctaatcctgttgattaatttaactctgaggctaaaggatttccaggggtggggagagagaagggcaccccaagagagtgggggtgcaggaagctgaagtgaggttgatgtggtggcattggggctctttgtgtcttctcacactgctttgaccctgtactccccgccccgtttccttttctgtcatcaccaccgtcattgtcctcatcatcaacaatagtaatagccttcatgggtccttgaagttgcaaattactcctatcatctttattttattttattattattattatttttttttgagacagagtcttgctctgttgccctgggggacatgcagtggcgtgatctcagctcactgcaacctccacctcccagatagaagtgattctcctgcctcagcctctcaagtagctgggattacaggcgcataccaccatgcccagctaatttttgtatttttagtagagacggggtttcaccatgttgcccagggtggtcttgaactcctgacctcaggtgatccacccgcctcagcctcccaaagtgctgggattatagacatgagccaccacaccaggccccatcatctttatctcattccattctcaaagccatccagggagggaggcatacaagggtgtattgttatcttcatttttatagcggagaaaaccaaggtcctgagaaggggagcgacttgtccaagaccacacagctagggaaagacagagcccacaagccaggtctcaggctgccgagaccaggattcctgattagaccggggctgtcccagaggaccctcaaactccttcccaatctgtcccttcccgccaatccctctccagggctcactggctgtgtgtcctccatccaagtgactgaacctctctgagcctcggtatacctatttgtaaaagagtcaatagtccctgcttcacagacctatgaaggctggcacagaggtttctaaaatgggggtctcttcccctgagcttggccaaggcgggtagtggatgctcttttttaggggttgaagtcacaaacaaactgcagttctgttctcttgagatctctctggatctcggtgggcagtgagacagagctctgccctccccactcagtgtccagagggttgttatggcaacctccaacatccaagaggatcatgccagatcctttcggacaagagagatctgtgggccctgcttggccttccccagtctgggcttcggtctgggcatctctctggatccacggagttccccagatccctgcagaataaggagtgggagggacaaggagacaggaaggaattagacccagaactccatggtgagtctagaaagctgcaggtgacttgcaggacccagggatcagctgaagcatgggagggcactggggcccggggcttggcagaagcacttgaattttatctctcagtggcataaagcaaatgttggtcctttgctaactgcagtcatgattttggtcacaactctatatcttgtcctattatttccttaatattttactatatctaaaagcacctttaaaaaactaattcaaggatactaatgctcttataaatggaaaatgagtatcatttcctgtaaatagatgggaaccataaaaaccataaatagcataaaaacaaggaacgttgttaaattctacctagagactagcacacgggaagttgtgagcgtggggcctgccctctctttgttaagaagagacaacaactgtgttaatgactgtatcggattgtgctggcctcagtggtggccaccagccacgtgtgactatgcaaatttgaattacaattaaatacaatgaaagacgaagttcttcagttgcagtagggaagtttcaggtgctcaaaaccccatgtagctagtactgccacattgaacactgcgaatctagaacgtttccgtcatcgcagaaacttctattggacagcactgctctagaactgaatggagactcagtcagattagtatttccaggccaggcatggtggctcatgcctgtaatcccagcaatttgggaggccgaagcaggcggatcacctgaggtcaggagttcaagaccagagttcgagactagcctggccaacatggcaaaaccctgtctctactagaaatacaaaaattagctggccatggtggtgtgtgcctgtagtcccagctactcgggagggtgaggcacgacaaccatttgaacccgggagatggaggctgcagtgagcagagatggcgccactgcactctagcctgggcaacagaacaaaactccatctcaaaaatataaaaataaaaaataaataagaaagactaggatttcccccaggacaaggctgtgcctcctccatcagactggggctttctgagggtagggcctgtgtctgccctcatctctgacctcacagctctgaggacagtctctgcccagagactgcactccctacaactctagtccccatccccctcagctcctgtctgagctcaagtgtcctcactgaagaactgaatctggtgccccactccccatccacgggctggcctcgctgcctgccagacaaatgcctgcttccttcttctgaagccccaagggctggcttttgttgtcaccgtcagaacactgaggttatgcactgcatttcaggaattgaatccttggcattagttgtatttggctctgagccccagaaatggtggggaaggggccccaggatggcagctgtgcccactgtggtctccccacagtgactggggggctgggtaactggaagccctggcaggaaaggccagggcagagccctggcaggaaaagcaagggcaggggttagatctgactccaggtctctgcccttggggatgaggcaggccatgatgaaggcaggactcccttgcaatccattccttcgctgtgtggcatggcgtcaccatcagagaccacctggcactggccaaaaaaaaagcaaggataactttccaacggacaagatagcaggatggaaggaagtgggcccagggcagagaggcattgccaagatggatgaccctccaggcgcatgacctctcacacatccgggccatacccaccagcttcctggctatgaatgtggcaccatgattaaattacccagcatgccttttgacacaccaggcgtttgcatgtgctctcctgtctgcctgcagtgcccttcccttcacctccacttaacatgtaaggcagtactagtttctctttttgtttttgttgcggggaggagggggttgccccttgggggaggggcctaggcctattcctataattaacacttgaagcgattgggaggaagggatctttgtattggtggaaggggtcaggggcggggagcacagtttgagtgaacctcacgttacctttctgcgactcagcttctcccatctctgatgcgagcacaaggtctcccaagatcttctagcttgactcaggctgaatgctccaagcccagggctcaggtcctaccttgcccactgcatacctagcctcttcaggtgcatagcagatactcaataaatgctttaggggaaggagtgaatgagtcaatgacaaaaaataaaagtgcttccaggaataccagagatggagaaggagaggaagggggagaaagaaatgaaggcaaaagagaaaaaggaggaagaggagtggggaggaaggaaggtagcctctgagtgtctgctctcttttccatcttcctttctgcttcctcttctctatgcttcccgcagctccccaggggctgctgaggggcagcttcagcgccccggctgggagatgccctgctagcatcccctctgttgggtcagacgtgggcaggagccacaggattgatggggacagggagctgatacctgggtgtctcagccccaacagctaaggaggctgagcaggggcttcctgcagcctccctagcttgggcccagggctgaagcagattcctggcctgataaccccaaccaggcctgggaagtgagctgactccaaccttctgggctctccaggcccaggcccaggaagcaacaggccttcacccacccccagtctccatggtggaaattagtggggataatggggtggggtccatggccttgaccaaggtcattcaggtgaggtctcctctagcctgggggaatcactcagagaccctgggacatcccagagagagcttgtcagtggaagtcgcctaatccaaacccttcatgtcacaaatggggaaagtgaggcccgaggaggggaggtggccttcccagggtcaccagcatttaggagcagagccaggcctggaatctaagcttcttgatgggcagctctggacacgtgcactttttcttttgatgagacagggtcttgctctgttgtccaggctgaagtgtggtggtgtgattggcttactataacctggaactccagggctcaagcgattctctcacctcagcctcttgagtatctgggactacaggcatgcacttccacactcagctaattttcttacttttttctggaggttggttcttactgtgttgtccaggctggtcttgaactcctgggctcaagcaatcctcctgcctcagcctcccaaaatgctgggattacaggcatgagccaccatacatggaggcctttttcttaaagtcaggattattgaggtatagttaatatacagtaaaattctgtccttttaactgagaatacagctctatggattttgtcaagtgtatctcaccacgaaaccatcccttgagtcttatgtcatggacatccttgcatgtcagtggaaataaacaaaatgcccaaccagaggggactgttttgttgttgtttgtttgtttgtttttccctaaagggaaaggttttacaagaaagtatttaagcaatactctagggttgggcatggaggttgcttcccatccttcacattgataaacaatgctagggtgagcatccttctatcttgtgcttgggaggagtctgatcgcagtgcagtcatgggtcctaggtgggcacgagtgtgccttgtgctctcctcccagaccccggcacccttccatctctctaagcccctgccttctccctccctctcctccggctgtagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacagaggcgcgtgtgcaggtgaggaggcacctgcggtgtcggtgctgcagatatactccagagattcagaagtttgggatggccaaggtcagtgggtttaatgggacccctcggggggtttacaacaggttcagggggttgtgtaggcaagtaatgccaccagcatttgatgcagagttagttggcagcaaatgttggttgactgagagctggacagcccaaggaggagggaagaatgaagggagagatagagggaaggggggaagaaaaggaagaaggtggaagggaaagaaggacaaaagaaggaatgaaagaagggagggaggccaggtgtggtggctcacacctgaaatcccagcacttcgggaggccgaggtgggcggatcacatgaggtcagcagttcaagacctgcctggccaacatggtgaaaccccatctctactaaaaacacaaaaattagctgggcttggtgacgggcacccgtaatcccagctactcgggaggctgaggcaggagagtcacttgaacgtgggaggcggaggttgcagtgagccaagattgcgccactgtactccagcctgggtgacagagcgagactccatctcacaaaaagaaagaaagaaagaagggagggagggagggcattagttcagccagaagagagggtttggggagtataagaatctccaaatctctgatgagcagaggaagtgatcaggaggaagatttccaaacaagcctagcttcctcagatggatgatgagtgttctgttaccggaagcatgcacgtaggctgggtaggccagttcctggcaggttagatgcctcagggcagggtgggcagcccccaaagaccctgaacatcccctccatggcctcaatatatgggaaggaagaggggagaagagcaagagcctcccaatggctcgaggactgccccgcctgctctctgtcagtgggttgaggggcaaaggcctgctgtagggggcctggggacattgcctcacctccccaggccaaactctcggattccaggaggcctacagttgttctccaagtgcaggagcctctctggggatctggctggaaagggctgaggctggagggttggggatggaggaggaagagccgggacaagtcgtgatgaacggctcttgtgggaatccattccctggctgtcttctgcatggattgggaggcatagagagaggggaaagatccccattaccagaatctaagcagtgctcagggagtcagagcggcctgcagaggggccaccccaaactgctgacggcgggcacttccatccaagaggagccagcctttgcccggcacccacttggtgccagtggcattgctggggctgcttctcaaacgtgacctagtggaagctcagaccaccttgtcgggtcagcgtggtcaccccctgcaagccacgggtgcagaaactggaagttcagagaagcaacatgcccaggggcacaagctggatgggggctgagccaggcccagctgctggcaaaaaccacgtcctttccatccagggaaatgaacaagctgagtcacaagctgaaatttgaaagcaactgggacaatcctagaagcaagggacgtttcagcactccaggacccagcggacacccctccgccccctgtcctcactcccagattaggggtccttcgcttcctttgagggagaccccaaggggaaagaggcgggaggcagcagccagctcatctctttccctcccctcctgaccgaggtgatatccgagctggctccaggcctccctcccgctctgatcctcctgcagctgttctcctgggcacattcctgggcgctttctcgttcccacgtctggcggccacggcggcttcccaccaccttgaagcctgactgctccttgtaaaatttcctggctgtcagagcagtgcttttattggcccaggggactcagaaacaggtgtcactcaaggtccacggagggagggggtctgggaatggagaggcagccggagcccaggcaaagccatcctgagggggcggggcccgcctcctgcgtcttattgacttcctatcatactctgggcttccccagtgcatggagctccctctagggcagggcagggactccccattagaccagaatctctcccagggcagggctggatctccccatttagcctgagagctttctcagagaagagggaacaaaaaacgtttgagtttttaaagaataaacggactggtgcggtggttcactcctgtaatcccagccctttgggaggccgaggcaggtggatcacctgaggtcgggagtttgagaccagcctgaccaacatagaaaccctgtctctactaaaaatacaaaattagccgggcatgctggcgcatgcctgtaatcccagctactcgggagactgaggcaggagaatcgcttgaactcggtaggtggaggttgcagtgagccgagatcatgccattgcactccagcctgtgcagcaagagcaaaactctgtctcgaaaataaataaataaataaataaataaataaataaataaataaatataaaataaaataaatcaagaacatttagcctggagaagtggagacttgaaagatacagctgctctgagcatccccaaagggttaacccagggccagggtcaagagaggagcatctaaagtccaacatgaaggtctccaggaaagagctcaggactgagagctcagggttcctgcctttggtcagctgtgtcaccttcaacaggtcaatttcctttcctgagacttcgtttcctgtctgcaaataaggggatggaactcaacaattactaagacccttacatttctgggatccctatttactgacaatcagggatgctttgtgaggtgatgagattcccattaccagaagtgttcaaacaaaagcacaatgtccagtcaatcagggaccctgaggtctttgagttatgacctcaaagccccctgagtactgcttacattgtatggcttcatacattttaggtcttggtctttgattctaaaggtctgtggttctgggattttccaatcgtataatatctcatctcagtggacctggcagatgggtgggttagtggattggttcagggtaggcttggagccaaatacctagatgtggattccagctccatgtcttaccctttccaccctccacccatctctcacaggcaagatgatgataatgatgtctaccttgctctgaggattaaatgattacatgtaaaaaaaaaaagaaaaaaaaagaggaagtacctgcacacagaagtgccataaatgggggttgttcttactaaaactctgcccgttcttggcagctccaattctagccacctttgcagctccaggtacattcacccagcagtcatttacagagtacttgctgtgtgccaggcgctgttctaggcattggggattcactgggcaaaaagctctgctgtcttgaagctggcattctcataaatacgtgcacaggtaaacatgatgtcaggtggggatctggtcaccaaagagtggcctgttatcccctctggctccctcaagctctgccttcctgcaggggccaggagcctctgcttgaagcctgctagatgttaccagtgcctgtaacacctctgcctcagccaggagaaagccagagccacatgaagggcagccaagggggtgtcaggcaggagaacccatgcctggggacccatgactcctttctctggagtgatacatatatcttccttagaggtgaacagacccattttttcctgggtgccacaaccctgagcctgtgaatttcttctagaaatagaggctgcagggctaataggtcccaaggtcaccccatggcctctcccatgactgcctctgatgacttccccatccttcagatgatcagcaccaggaaactagggcagtgtacaacgcctctttactttacggtccttggaaccctgctctgtgcttggggtaggggtgggatgttctgaacggaaatcccattgtggaagcactacagagattcactaattaacaacttacactgaatctcttaataacactaggtagcattcatggtgcatttcttttctttttttttttttttttttgagacagagtttcactcatcgcccaggctggagtgcaatggcgcagtctcagctcactgcaacctccgcctcccggtttcaaacgattctcctgcctcagcctcccgagtagctgggattacaggtgcccaccaccatgcctggctaattttttgtatttttaatagagacagggttttgccatgttggccaggctggtcttgaactcctgacctcaggtgatctgctggtcttggcctcccaaagtgctgggattacaggcgtgagccactgcacccaggcatgtgcagtggtgcattttttatgtgccaggcatgatggctcaccagtctacgtgtgttatgtttattaattctcaccatgaccctgcggggtatgtgtgattcttctctccattttgcagatgagaaaactgagatgtagctaaggaaagtaacttcctaaagcacagctatacatatacacagtggagtactattcagccataaaaaagaatgagatcctgtcgtttgcaacaacatggatggaactggaggtcattatgttaagtgaaataagccaggcacagaaagacaaacttcacatgttctcatttatttgtgagagctaaaaattaaggcaattgagctcatggagatagagagtagaaggatggttaccagaggctggggcgggtagtgggaggtgaggggagaagtggggatggttaacgggttcaaaaaaggaataaggataaagaagatgtatttgtatttgataacacaatagggtgactatagtcaataataagttaattgtacctttaaaaataactaaaagaatataattggactgtttgtaacacaaagggtaaatgcttgaggtgatggataccccatttaccccgatgtgattattatacattatatgtctatatcaaagatcccctctatcctataaatatgcatgcctactatgtagccacaaaaactaaaacttaaaaaaaagatacagttcaaagtgactgtgctgggacttgaacccaagtctatctgctcaggttcgtttcctctgtgctacatgaagagaagggccagatggaatattggacacagtacacagatggcatcaactgtaccctactcccagcgcagggtattgagagaaggatcagaaatgaagaataaaacccagcgcctgctttcaaagaactcagtcctgaccagagattctgggtagggtgctggggctgtcactgtcccttttagagcgtttatttccctctctgtaaacgggcagctcatacgagacgctggcagagacccttccagctcagctatctcagagggtctccagcagaatgatacttacctgtggctggcgctgttctaagcatgttgcctgtgctagctcatttgaggtccagaaccacctaggaggtggctgttattagccccattttatgaagaaactgggataacaaaaattttcccatcttaggagttagaggcagaattccatcccaggcagttgactccagcatccctgctgtcaaccatcctgttacacttagtgagaagggaggtgcctactgggaaggaggtgaacctagggacataggacaatgaaggaagaagagatgacagaattggcaacaaaggcatgccctctcctccaggaagtcctcctggattctgagaggcaaagttggaagcccctcctctgagctccttacccaaccttgcatgtcaccccatctgagcttattgcactgaaaagcagctgctctttgactcgtgcccaggcaaagggcagtttgagggctaggagtgggtcctgtccatctctctagcctgtcttgcttggcacagagaggagtcccagtaaaagtttgagaggagaaggtgggaataaagaaggaagggaagagtaggaaaagaaaaggaagggattagaagggaagggaaggaggaagaatgcatccaactttattcagcattctttttttgaggaaaagatgagcggcacctaaggacctgctgctacatgacaaactacagtggcatatcccaaatgcccatcgctctcccacccacccaagatgttcgccaccttcacctattatctatattgttatttacttttcaacgaaatcaagtgttttaaaataaaaatgcacaacactcccataaagggaaggcaattgttaaaatacacacacacacacacacacacacacacacacactacacacaaaggaaaacaaaacaacatgattaaagcctttcaggaaaatgtcacctgcaaacgcctcctctccctgcattcagaagggagattggcacaggttagaaaggcactgaggatgcattagcaccaaactgagacccctcttccccccttctccatgcccaggaggcctgggagagaagtggaatggaataactttcccatcctcatgtccaggttattgaattctgtttctccaacagggagcagtggcaggaggcccactgtttgggaaacactgaattagtacaaagacctcctcacacccttcccgcagagcctggaagctcggaggcaaggccattccttgcagggctccctccagcatccctgccactccagggtgccccggggaaaccctcggcgccctgtggaagtggggagaagccagggctttgaatccatcgggagccagtcgtttttcctccaggcttggctgcctcctctccctttctctgtgaaacctcaacaggtgaaagccggcagctcttgtttatccagcctgcaagctgaacgctgcttttcccacccgggaaggatggctctaggggtgcataagcgccctccacctggctgcattcccctcccccatctcagcagacacggcccagagatttgggggtcttgggtgatcaggtgccaggggaggtggcggccttcaccccccatcaggatggaacaccaaccaagccttgtagccccagccccagcaaaggcaccccagtgccaatcctgcctccccttgttcattcattcattcgtcattcactccttcattcattcaacaagtattccttgaacacttactgagctccaggcattgggcaaggaatgcatggcctctgtcccgtggagcctgagtctgagggggacattaggagcagcacagccaagaaacagatatatagaatcattgatcctgtggggaagcacacaggtaggaggcccacctgacagaaggcagagaacctacctgaacccaccttagatgcggcaattaaggagtaggagtaggaggaagcatttcagctgagctctgaaggccaaagagccagctgcaggaagagtgttcaggggagagggaacagcatgtgcaaagctgaaggtggaaaagagccccctcaaggcagccccagtgtgcaccctcattctcctctttctctgacctgtcccaggaaacttgcaaatccagataagtgggctctagaaagccagactgatttttttttttttttgaggcagagtctcgcttgtcgcccaggctggagtgcagtggcgtgatctcagctcactgcaagctctgcctcccgggttcacgccattctcctgcctcagcctcccgactagctgggactacaggcgcccaccaccatgcccggctaatttttttgtatttttagtagagacagggtttcaccttattagccaggatggtctcaatctcctgacctcgtgatccgcccgcctcggcctcccaaagtgctgggattacaggtgtgagccgctgcgcccggccagactgattttaagtttgaacctcagctccaacacagactagctgtgtggacttgggcaagcaacttgacctctgtgagccttggtttccccttctgtaaaatgggaataggagaatacgtctcatgggtctatgtatggattgatacgtgaagtgccagcacaggaaggggagacaaaaatgttgggttattatcccactaatgtttgataaatccgtgtgtgtgtgtgtgtgtgtgtgtgtgtgtgtgtgtgtgtttcctatttcaaggaggcccagggtgtgtaagcaaagtagggcctcagtctccagagaaagaacccggcttgcacatctgggtctgaagtgcaggtctcattcaggtgggttgcagatgcgtggcttcctcctggggggcttcctggaggaggtggtcaagcagggcaccagcatccctccaggaaggagcagctgcagaggaaagagcactggcctgagagccacacaggactggctggaccactgactcaacctggcccatggacaagtcacccactttctttgggtcttggtttcctcatctgtaaaatggggataatatagaaccccctcactggtggttgtgagggcagaatggggtcatacctatgaaatcactctgcaaagcgtcctgtgctgcacaatgccggggcctgcaggaggatgctggctggatcagagggtgatggcttgggcaactgggtctacatgtgttgcagctctctgccaggaacctggccgaggggtctccattctctgctctccacctcccaggtctggttcagtaaccgccgcgcccgttggcgtaagcaggcaggagccaaccagctggcggcgttcaaccaccttctgccaggaggcttcccgcccaccggcatgcccacgctgcccccctaccagctgccggactccacctaccccaccaccaccatctcccaaggtgagtgtcttggccccgtcctgccatctcagtggtgccccttcccttctttctttactttcacttacaaaggctcttcttttttttatgaccatttcttactttcatgtaagcaggctattgagagcaaaaagatgcaatcctgcccttgaaattcttggccctgacacagagcagccaggtgggatccccaaggcagcccctgtgcacctgtttagaactgagcttctcaaatggtaccagggatctcccaggaatgttactaaaatgctggtctgggtgaggcctgagattctgcacttctaaaaatccccctgggaatgcccaagctggtggagcatggaccaggctttgagcagcgaggatttggaggagaggacactgggctgacctgctttggagggaaaggaacggattctgcagggactttgggaccatgcatagtcacagtctttgagtttttaaagtgagagagtgacatgagtacaaatgtgcgtgtgagtgcgtgcatgagtgtgtgcgtgtgagtgcatgagtgtgtgcgtatgagtgagtgaatgagtgtgtgtgggtgtgtgcatgagtgtgtgcgtatgagtgagtgaatgagtgtgtgagtgtgtgcatgagtgtgtgcatgtgcacgtgtgtgtgtacttgttgggaagatgttggaatcatgttggaatcatttttttttttagattatgttggtctccaacctatgacaaaaaaaaaatttacaaaggggcttaaataatttgctgggacctcattttcttgcctctctctggaaagatccattttcagagatggaataaaggtcagggtctcctttgaggacctgagaaagctccctatgagggattccccccactctggggtgaacagccctaggccaggctgggctgagaggggtcagagccctcaggtcctcctgggaaggaggcctcacttgagcccagttctcccagtggcttgaagtataagattcccttctagcgctggaaagggataggcagagggaagaaggtgagtgggtgagagaggataggggatcagggggccttgggagaggaaaggaaagtctgggtcccaggagagaaggtgagccttgtaggggaagaagggttccctccccctacctcaccggaacttgctctcattctgtcaccccagaagccctgtcccagcacacaccaggaataccactacttgatattggcctcatgggctgggcgcagtggctcacaactgcaatcccagcactttgggaggctgaggcgggcggatctcttgaggccaggagttggagaccagcctggccaacatgtgaaactccatctctactaaaaatacaaaaaaaaaaaaattatctgggcatggtggcgtgcatctgtaatcccagctactcaggaggctgaggcaggggaatcgcttgaacccgggaggcggaggttgcacggagcccagatcgcgccactgcactccagcctgggcgacagagtgagactccatctcaaaaaaaaaattaaattttaaaaaagatagctacctcataaagcctcctcttaaatgactggcaggctggagttctggaggccaaggaaagagtcaaagagccccctccagcaccactgtgacttggtaagataaattgaaccagtgttgagggtcccagcctctgcaaagctgcacagaagggcccagagagcgcagaataacagcctagcagcaaagaacagagatggctccagagttaggccattcaaatcctggtcccatcactcactagcctggtcatcttgtgtgagtgccccaagcccaccaagccttggtttcttcatctgtaaaatgggatttacagtcttgcttcatacccttaggcagcgtttgtaaaagcacctggcaagtggttgacgctcacaaaacaaaacagactgggtagattaacagagtccccatcaaggtctggttttcagcccagctgacatttattgagcacctactgtgtgccaagcactgaggaacagtggctggtgtgcacctgtctaggggttgtctagaatgttgggttgtcagtcaagacctggccagtgcctactgccctgcccaggagccaacttgtctcatcccaggtagcatgagagggtggtcccttccctccaaggaatggagaccgggaggaggagtctcttggcttgccttctgctctcagaggcccagcgtccagggtgaggccacttgcttaggacctctcttgggtctctctacagatgggggcagcactgtgcaccggcctcagcccctgccaccgtccaccatgcaccagggcgggctggctgcagcggctgcagccgccgacaccagctctgcctacggagcccgccacagcttctccagctactctgacagcttcatgaatccggcggcgccctccaaccacatgaacccggtcagcaacggcctgtctcctcaggtaggtggtctcagcccagcacccaggatcccaccgccacgaaagtcagacatctgcagacagcacgtgggtggaagccttgcgctctttcctgtagcaggctgactgcggttggggtttttgttctagaatcaggaatcctccctggactctgtcctgtgctcttggcttttcaccaggagtgaccaattcctgaaaggcaggaccatgtcctattggtggagagaattgtggatggggttctgggccggtaactctaccctgattggtcaatggaattctgtttgctcctgtgtgattggttaagtcattcattgcctcggggtgctgttagaagtcacaggacctgctttggatgaagtcagagagataatgtgggcgctgatggtggttattggtgagtttggggaacaggacttgataatgccggaagtcccaatgaacttgaggaactgatgggctcatttttttgtagcttcagcaggctcccaaatatccgtgggggaagggatgaagtgccccctgccacatgtctgtggtgagaatccactgcacatgatccaaactgatctgaagagccatagtgtggcagaacagtgaagcctgtggaatgggtctaaatcccagctctactgctcaggggtctctgaggcaagtcagcatctgtgagcctcagtttatcccctattaaacaaagagagtctgtaactaacgtctcaacaagaggtgcttgccacattcaatatgctaacaggtcagagcacctagcccagagcctggcacgaaatcagtgccaagtaaatattagttctctggccctcccagtgtcaggacaatgtaattaatatgggaaacccattacctaaaaggagaatagaaagaattcaaagaaggccagcaagctacatcctgcgggccacatctgtccagctccctgttttttgtaaataaagttttattggaatacagccatgtccatttatgtatggtggcttttttgccaccacagcagaattgagtagttttaaaagagatcatataaggccgagcgtggtggctcacacctgtaatcccagcactttgggaggccgaggcgggtggatcacctgaggtcaagagttcgagaccagcctggccagtacggtgaaactttgtctctacagcaatacaaaaattagccaggcatgatggcaggtgcctgtaatttcagctacttgggaggctgaggcgagagaatcgcttgaacctgggagacagaggttgcagtgagccaagattgcaccattgcactccagcctgggtgacagagtgagactccatctcaaaaagataaataaataaataaaaagagagaccatgtggtccacaaagcctaaaatatttactatcaggcccttacagtaaattaaaaaaaaaaacaaacctttgtctgaaacattcccaagaatgttaattttctgcttgtctggattcatttctgtttgcctccattaatttgtgtagttgagggttaattgcctttcagctgcatcgtttatttatgggaaaacccttgagtaagtcccttcccctttctatgcctcaattttctcatctatgaaatggagataagcccagtacttgcctcccaaggttgctggggattgaatgagatgatctgtggaaggcagtcagctcaggtctggcacagagtgagtgcccagtacctgtaggcagctgcctgcggagctcctaatggtgacgtatcaagccctctcagggtccgcagtatgaagggtgatgccacttacttggctgaccttgtcagcccctgcactagtcctcaccaggccaccccactctcttgctgggatcccaggtgagctaaaccctgcacatggaatacagcctgtcggccagaatgtcttccctggggaccccagttggcttctttgaggttcaaggtcatggcctccatctcactagtgctaaccttccagagcccttgagatgagtcacaacaggatccctgaactggctgggggaggacactgccgagatccaagctttccacacccaagaatagggtccaggcgtggcttggtggtacaaaacaaatttgggggagtgtccttagaaagctgaagagggtctttggggttctgtgtgcagctgtcttgctttggagatggagggccccagtacacattggccaggccagggttgacaatccggcgcacctgactccatgaccactgcttttcctagcccgccctgtctcactgtgggctgaggtttatccccaacacaggactctgtcacaggacaaaagagagacttagcaaagaaggggccccaggcctccagagtgtgggtcggggatgggaaaccaacccactggtgtgagcagtggatcaaggggaagtatctcccccatggcaaggagacttcagggttggatgacgtgttttccatcctctcctggaagttcctaagttggacgcccagccctccacccagcccagaattttactgaagctaaaagcgagaggcctccagcccattcctcagggctgggaggctgacatgatgaatcggagaagctcagaggctcccatcaaaggtgtgaagacagatggagggtctgaccggggcagaggggaccaggaggtgaacagctgctggaggagggcgggtgcaggggcagcagggcaggccgtgtgtgcttctgtgcatgtaaaccgcagaggttaacctgcgagcacttcctgaaggacgggtgcagcgagcagggcgggagtttctgggtcttgtacaaaagctcccggggttgctaggctccgactcccactgccctccctcctcactctgggcaggtggacttgacaccatcagcacatcactgtggtcctgggaggtgtggggccaggaatcctctgtgtataaggatctgcagggagacgccctgtgaggacagatctgcctcctgcatcctctcttcccaacaggaccggcttctctatagctcacctgggcaagagggacaggttaagcttccccgctgggctgtggggtaggcacactgtccctttccccaggatggcaggtccctgacacattgcccagatagatgtggacctcaaaactggaaggaatttttttcttttcttttctctctctctctctttttttttttttttttttgagacagagtctaagtctgttgcccaggctggagtgcagtggcgcgatcttggctgattgcaacctccgcctcctgggttcaagcaattctcctgtcttcgcctccaattctcctgtcttcgcctcctgagcagctgggattacaggcccctgccgccactcccaactaattttgtatatttagtagagacagggttttgccatgttggccagactggtcttgaactcctgacctcaggtgatccacccaccttggcctcccaaagtgctggtattacaggcgtgagccactgcgtctggccggaatttttgttcttacagaagccaaaggggcttacactggaggatgaatttgtggctctaccgagaacctggacagacccgggttaagctagctgtgcatcacgctggccagcttgctactaccgtggggaagacatgcctcctccagtggcttgacccaagtcccttgtctcaaacccagcctgggaagtggggaccacagaacatcaaggactccatgcagaatctcaaggaaaagccatttactcatctcatctctgcacgtgccccctggcttggaagggagtcactaacatagtgaatatttatagagaacctactatgtgccaggcactgttctaggcacttgggataaatcagtgaacatgagaggaagacccttatattgtcctagtggaggtgacagtacaacagggtcagacagacaaaaaatataattttaaaaggcatacagtatgtttaataccagtgttgacaaggacagctgaattttctggagcccttctgactttcagatcctgctctgggtgttttacttatattaatccacttaaagggtagagccaggattcaaacccatgtctttagagcctgaaatcttttccttttctttccttttctttttttcttttttttttttttttttttttgagatagggtttcactctgttacccaggctggagtgcagtggcgcgatctcagctcattgcaacctctgcctcctcccaggttcaagcaattttcctgcctcagcctccagagtagctgggactacaggcatgcgccaccatgcccagctaatttttttgtatttttagtagaggcggaatttcaccatgttggccaggctggtcttgaactcctgacctcaagtgatccacccacctcagcctcccaaagtgttaggattacaggcgtgagccactgcgcctggcctagagcctgaatcttagttacttgttctgtcttcctgcctctcagaaatgccctcacttgcactctttttagagattggctggtgcaagaagaaaccatctagggaagccaccccccatctatggaagccacccccttcagtttggtggaggaaatagctcattcgactcatgtggtggatgagaaaactgaggccaatgactcaggttagggaccaataggcagagctgagttatatgggcaaatgcttttcaggaggtttagatacccttgaggcttggttccctgattgtctcccctacccacccaagccccagcctaataggattagggattaggcactcagcacatgcatgtccctggctttgtgcactgggtccttctgaagagatgtagggaaaaggaatcctgctcatgagacctcattcctgataacgttcatctggggttaggatcatagactacccgcaacccccagcccactctctcccctctgctccgggctgagggccagttacttggacaacgactgtaagaaaacaacttagaggtggggtgccgtggctcacatctgtagtcccagcactttgggaggccgaggtgggaggatcacttgaggtcagagttcaagaccagcctgagcaacatagcaaaacccagtgtctacaaaaaatttaaaaattagccagatacggtggggcgagcctgtggtcccagctactagggtggctgaggtgggaggattgattgaccctgggaggttgaggctgcagtgagctgtgattgtgccactgtgcgccagcctaggcgacagagagagaccctgtctcaaaattaattaattaattaaaaacataaaatgacttaggatgaaaggaaccttttgtaacgcaaatgactttgaataatgtgacacctgcagattcatcccttcataccagcccctgtctaggaatcccaagcaggccaggctcttaggagtagtgaccacaggcagaaaggagaacacaaggctggcccttcagggatctccagtctggtggggaagacacagcccctgtcttcaggaactcatagtctgacggaagagacaaaaccctcatccttagatgccttagtctgatggtggaagcacagccctctcttggaacagagctccaagagacaggtgggggagacaggcatcagaaagtcattcagagctgcagtatttggcaggctgagatcccaagcaaagaaccaggagaaaagttctgccagtttcgagggtcccttgggttgaaggctgcaggcagggtgccttgtgctggaggcttcctcagggcccaggtggtgtgtgccaggtggggctgggaggtgtggttagctggaacttcctcatctcccaacctttttaagatgccaactatatcagagtaggaagtggaaactgaggcccagagagggcccaatctcccccgagattttctgaaaatcacacggttgggttagcggcatccttggctggggtctggagggctcctgccacgacctcgtggaaggggcgtctgtctccccagcaccgctcctggtgctcttttgtaatgtcccatactcatcgtctcctttgttcctttctggagcttaaaacgaaggaagccataaagggatttacatatttacaatttccccacacaccgacctaatgaagaatattctctaagtgtgcagttaaccacacaaccacgatcacggccaaccagcctttctgtcctttcctgcttcttgatacccttctctccggtccagcctgtgcctttagtaattacggcgacagcaatggcagagatcatgcttacagagggccaggtcccgatgggcctgaatgctgaccccacttgccctccttgactcttggctgttatcttgtgaccctcgttttacagatgaggaaaccttccttgtccagggtcccctatccatccaaccacctaagaaacatttatggagcctcttccaggtgccaggttgtgtgctaggatctggcaagtggcagagttaggattccaacagtggctccagagctcacgatgctactgtgttgtatctgcctggtgaggttggtctggtggtccatccagggaagctgaggtcctaagtcataggggcaattaatggcagagtcaggttcagagtcgctgtccccaaacgccaagcttcctctttcctcctgagacccacagaaatcaagctcaaggctttacctttatttatttgtgaatggggtctcctgggtgcgtcttaacagcacatgcccagtactgccctcctggcattgtctgaggcctctgggcagccagttcagcaagaaaagacattccatcaatggcacacctactggacgccagatcccatgtaagcactttgcctatctgaagtcattccagccccacagcaaccctactcttggggaaataggctcagagaggtcaagtcacttgctgaaggtcacagagcaggtgagtgatggagatggggttctaattcaggtctgccggacccaggaacctcaccaccacttgactctcagcaagacacgaccaagacagtcctcttgccctagggaactgagcagtgccactcacacagtggacactggagattcctacctctctctcctatcacttcctcttcatgcccccaccccttcattggcgacactgcgtttataataggcatttaaaatgagtcttgctggaccagggacgaggaaggaggagggagcgagagatttgtaggcaggaagatggggagggggattgtggggtgttaaatagcccagaatttaaaaaaaaactgatgcaaatcactggtaggagagaaaattatgtgcaattacgtcctgatattggaaggttttgcctagcccaggcaacaagatctcattaacaagcagaaaataagattgaaatggtgtgtaaaagagctgaaaaatgaatttgaatgctgcgtttgtccacaattaccccctccttcacacatattttattgcaatttttttattattcttaatctctccattcctcaaagcagattggggacatcctggcattaccagggcgtcaggaggaggtgtggaggattgcctgccccgctgaaaggagacccttctctcgcacattttccgaggttgggttttggagggatcagaattcatttctccggcttagcaggttgtaggaacatggggctttaaccccagctgcgcgctcctctgcgccccgcccagcccttccttctcctcccttcctgggcgagtctcctgctgcccgcttcctccctttgccttctcagggtctctttcaggcctccgctttctcgggaggcctctccctcaggccccatgggtagaaggaagcctggagcgagagaaactgtgccacctgtgccaacaagcagccgtgagttggagctctggttctgccatttactaaattgctgtgtggccctggcacagcttgcttaacctctctgggcttccttttcctcatcggaaaacaggggtaatcattgctacctctcaggggttgctgtgagaactaagggaaaattcaaattaggtgcctggtgcaagtaggagctcactaaatgtgccctcgtcacacccccctcacctgtgccctggcctccacctctgcctcactgccatcccttctgtttccttccctctgttcccttcttttacttccctgctctccttgacccccttcagttaactggacaatgcttgagttggtttcctatccagggcaatgtaaggggttctgctgacctaagtctggggaggagaaggtgccaggtgcagggggttccctctctgcagaaagcaggggaaaggctgtctcctgctcctccctcaagcccctggggaaggacgagctgatggaggagtgcttgactcaagttggcagggcatgggctgagtggtttttcccaggattaggggaaagctaactgagtcatccccccaccctccaacacacatccccacacccctgtttctctttctcttcatgaccagtgcggttggtacagagtcaggggtcagtttgtggagtggaccaggagtccgtggctggatcttcttggacctgaagccgaatgacatttttcagtgtctgccctccccaactggccttctgcacccaggaagagcccagctcccagagactgctcccctgccccacccaaaccacatccaccagcccctggtcacagcatcaggctaacagttaggctgcccgtccactctgctcatcaggcagcccccaatcccccagggctttttcccccggttctcttggcgaggccagccccagggtagggatgaactgcaaggctcagggaagcagccaaggcgtaggtgtgaactgatggtcagtgtgaattgatggtcagtgtgaattgatggtcagtgtgaactgacggtcgctttagtccttggccctgagcatcctcagcccttccagaacctggggagacagacccggccaagaccctgctctcacatccagctccatctttgtccacagttaacccacctcagtgggaaacgctcagttatttccccccggcagctcctcaccaaacaaaaccacctgctcaagtccatcagaggcctcagctccagcccacaagggagcggcctgggcagagcctcttctcctgtgaaaatagactcgtgtttatgtctctgcctttcctacccctttttcctgggtggagggaaatgagggggcaggggagaaggaggaaacccctcccggaaagaaaggctaaaccaggattaggaactttccagactgctgctgaggggagtggagcatgcctatgagtaggctctgctaggaactgggaggcctggcggattgcctggctttcagggtgacattagagcccttggatcattgaaggagaagtgggagagcaaccctgaccttgcctcctttcttagagaactgggtagaattctgggaagatatcgggtcttcagcccacctatctgagtccgaacaagaggtgggtggagggtggccttcaaggaccactctggggccgggtgtggtggctcacgcctgtaatcccagcactttgggaggctgaggcgggcggatcgcttgaggtcaggagactgagaccagcctgggcaacatggtgaaaccccccctctactaaaaatacaaaaattaactgggcgtggtggtgcatgcctgtaatcccagctacttgggaggctgaggggggaggatcgtttgaatccaggaggcggaggttgcaatgagctgagataacgctactgccttcaagccggggcaacagatcaagactccatctcaagaaaaaaaaggggaggggcactctgggcctcttttatgcccaccagcaaaacatcttccatccaaactccacacctccagagggtgtgggcaggagctgacctctgcccctttacacagatggagtagaggcctggtataaacaagtggggaaggggaaagtagcctgcttggaagctctagatgtttccacacaccactgttgtcagggaccatggtcttcagtaggaccacaggcagcatggcagtacttggcacacaaaatcttggtgtgacacttgtattataactaggtgtctggcaggtaacggaccaccaccaactgttgggcaacccgcaggcatacagcaggcctggtgagacacagctgtagtccattctcaggaggattttgaggcagctgatcatgtggtttgcacttgaatatcattacatatgattcccttcaaattcatttatctaactccacttaacagcctagagggagactcaagaaagaaatatgcatggctgtctctgctcttatactttggagagacaatactcctcatcccaccccagagataaattagagtattcattgtagacaatttagtgtgatttctagtcagacaggaagaccagaggaagtctagaggagggagggcatagtcagagaaggcttcctggaagaggagttccagagggaagactggatttgcacagggataaaggaaggggtaggaggttggtgccgaccagacagcagcaaatgacatggcagatgtgaaaacagtcactaatttaggcacatcgtggacacagtggaatgaacatacagaccagggctcaaatgctcacgtgctcagccgggcacagtggctcatgcctgtaatcccagcactttgggaggccaaggcgggtggatcacttgaggccgggagttcgagactaacctggccagcatggtgaaaccccgtctctactaaaaatacaaaaattagccgggcatggtggtgcgtgcctgtagtcccagctactcggctgaggcaggagaattgcttggaccccggaggcgggggctgcagtgagccgagatctagtcactgcacttcagcctgggtgacagaatgaggctccgtctcaaataaataaataaataaataaataaataaataaataaatatacaaaaacaaattctagctcctctacttatttgctgtgtgatcacaggcaagttatatgagcgctcagagcctcattttactcatctgtgaaatggggcctctgccactcaccttgcaggcttatgagaattaaatgcgattgttcatgtgaaacccttagttccacacccggcatctagtaagagcttaagacaatgttcctctttctgcttctcctcgccctgaacagaaattgaactccagaagtcttgctaggtttctctacccaggcaatttcctttctggtcaaaggttggaaactcaggagatccaagtttcctctagactctgcctccaaaccaccatgtgatcttgatagaggccttactgctgtgggcctcagtttccccatctgtgcaatgaaagagatggaccaactgctagcagagagccttcctattcagaatcagtgattctgtgggttacttgtacatccaggggagtcacagcctccagatctgcgggcagggctggcccgcctctcagtcgtacatccgcacctccttcctgcctcctgagaagcctagcaggcccgggtttagccttccagagctgcatggcttggtgggaaagaatgcaaatagtggatctgtccttctttctgattagcacagggactggggacgagacagtacagcagacagaaggaaagaaaatgagggagattaggaattaatacagcaggcagacttagagtttctcaggcctgtccctggggtcccctgcaggaggaaggccgctgggatggttgggcaatcgggcctgggaggccaggcaagatcgcaggtaggagagacggggggtgactttgagggtccccaaaggagacttgtgctctcctctgcctccaagcctttgtacctgctgctcccttggccgggaacaccttctccaccaccccattgtcatctcaagcccacccgtacttcttttttaagacttggctcccttccatgaagctttccttcaggacaccccccacacggtgggttagctgtgctttccctgtgcagttaccacattttatcagtacattaaatgtatatattgatataagtaatacagtatgtctgtattgctacacaaatattattaaatagtaataagtaaaatgttttagcatttaccacaagccagatgctgtgctaagtcagctacatgaattatctcatttaatcgttataacatccccttggaggaagtgctggaatgattatttctgtcctacagatatagggacagaggcatggagcagtttaaataatttgtccagggtaagttgctctttaaggcaggagagcaggggggtcaagatgcatgctagaatcccagtgcttgggctcaatccccagcattgtcacttcctacctgtgtgaccccaaacaggctcttccctgcctctgtttccccttctgtaaggtgaggctaataatcatgcccattttatagagctagcctgagaagtgtgttcatatatgcaaagcatgaagaagaacagctagcataatatgaggtagctgtttgcagatggggtctgaggctccagcaggtgccaccaggggccaaggtcacagtgagttagcgcagggccgggatgcagacctcctgttgcagaattcatgttccctcaacacctttgcagctgtctcttccacactcatttcccatcttctttccatcagccttttccatcctgttccccccgctccttcttgtcccccactctaggttcctgccctgctcccacctcagccccagggctccctaaccttccccaccggcccttctctctcctggccctttccccggctgtgaacacgcttctccaacacctttttcagtggggacgggtgtccttggccaccaggggagttctgctaagggcaggggaggctcctcccttggagctttggagaacatcagagacctgggtcgggtcccccaggacattgttggaggcctttggaaggatgggcctgggtgcgccctaattcctgcgcacctcggccttgtcactcccccactctgtggctctgtcgccttctgagtgataagggcctgcactttcttgagagggtggacagcctcccccacccctcagcccagccaggcctgcctttcactttctcctccagccattcgtgcctccctgtcccctgccacagcccagaactttctcttgggctcagttgatgggaaatccacgtctgtttgttgttttttgtttgtttttttttcacacactctctgcttcctatttctttcctttccccacttcctcttttcgcccttcgcgccccatttcccttcgccccctgtgccaccacccccttgctcaccgtctccctgatcgcgtcataaccctgagaatacctccagcctgggtcctctctccacccactccattctctcaaaccctcatttccctctttgcctgcctcctcccatagctggcctcgcctctacccattctcttccccctaatctctctcattctcctctcctctctcattccgcacccaacaaacacctcttccccctccatcttcagcccctgcgcgccccccttgcccttgccctctcccccacccccgtgtcccctttccgaattcctccgctgctggtgggctccgaggcagggaccgggcgcgggctcccgaggccgggcggacccaagtccagggcgggggttggggcggcggccggagcggggatcgggtctggggggatccgcgcggccgcccctccccgcgctccgccgccgccgccgtcgccgccgcgcctttgatccatggcccgaggccgcctgacagtggaaaatgcggggagacaaaaccactcagtcaaagtgattcccaacaactgtctccccgagataaggacgccctcgggctcggcggcctgcttaattcccgctgcccgggcctgggatcccgagcagccgcgcgcctggccgccccccggactgcggagccgccgctcgctcgtccagtcttggtcgcggggcctcggccgtctcgggacggggcaggcggcgaagggacgggcagccggtaagcaagacccttgctgcctgctggagagagaggctccctcgggagcgccccgttccccacccgttcattagttcattagggccttctccaccaatgcacttgcccttccctccacctagaaccttcttgcccctcctctcctcgcttagccagctctgctcatctctctggtctcagctcagaggttgtttgctccagaagtttgccctgacctggctgtggtggccaggccccctcccatgccccttgtattcccctgggtagcagctttgcctctggtttctaactttttggataccgctctctccctctaatgcaaggaccctaggctcttggcgtgtgtccccagcacaaagcctggcacgaagtaggtgcccaataaacagctgcaaacatgccctgggctctcctgagggtctattttgtgccccattctgtgcacagaggatgccaggtgggctaaacctggcctctgccctcaagaaccttccagttagtccacccacagacaagcaagtgacaaaccatgagccagaagcctccagagaggagggaggcctagggagggtctgcagccccctcttagggggagaaataccgtcttgacggccagctggcctgactcgctggatagaccacctagagccccgactctgctgtctgaccaccctccttaacaagctatggttcaacaatgtgtagattccagagggacaggagatgagattatataaagtgaggccaaaagggagccctcatgatcccacctgaacctccatgggggtgtcagggacaggagagccagcatgtttgggatgatggcaggaggcacacgtcctgtggaggcagaattcagctgaactgagttcactcagagctggccagggatggaaggggtaactttggaaagcagggagtgcgccatctctgctcagagcggggtgccagcagaatccaggccatacctgccaaaaggattggagggtgagtctttgcagggtggggcgattgagctagagtcagtggttcccaaacctgagcctgttaaaaatctcaatttgcagactccaccctgagagcctgttatagtaggtccatggtgggactggggaaatctgtgttttttaaaaaggtacagtgcaaggcagccggtcccaggcctggcacatccaaagcatggattagcgaggttccatcttgtaaacctctccccaagtggaggaacgtggggatctgttgaaggcctccctaacctcagtgcacctgggggtccctgtgcaccccaatggtatccacgccttgacccttcctttttttttttttgagatgggagtctcgctgtgtcgccaggctggagttcagtggctcgatctcagctcactgcaacctccgcctcccaggttcaagtaattctcctgcctcagcctcccgagtagctgggattacaggcatgcaccaccacgctggctaatttttgcatttttagtagagacagggtttcaccatgttggccaggctggtctcaaactcctgacctcatgatcctcccgcctcagcctcccaaagtgctgggattacaggcatgagccacggcacccagccgacccttcttttctttagaaaacaggttggggggagtgtctgcttgaaatgaactgagatccccctccccagcaatctcagagctagaaggcacctagaaagagttaactggctgtctcattttgcaaatagagacactcacaatgctcctgcacactttcactgtccaaaaagactcaggagttagcagggcttttgagggcacagtgggtgcagcaatggccttatcattgcaagaggttgatttgcagcacgtggggtcattcatgcttctgctcccagtggcttaggtgacttctgctttgacacagagccctgggaaatcttttcaagcatccacaaaagaggtaacccgtgtgggcgaatgagtgctggatgaggagacaggagacctgggtggggcttttgagggagatccgcccctgccctgttcctgtccctccatcctgctgcgtgagggctggggctttggggaataggagacagtgtgcgctctcggaacccagcccctaggccctgaggactgccagtggaactggcctgaggccaaatgaatgtgaccctctcaccagaccaggggtctctgaccagcggcatcgaaggattaaagtcccgtgagggccctggcaagtgtcttatcacaaaggggacatgtccaggctgaaattgagacatactgcccaggggcagaagttccggagcctccccggcaaggggctcccttcccttcttgggcatagataatgacctctgccggccctggaactccatagcatccttccctgagccccctggactgtggctccaaccccaaccaacttcattctccttgtctaggtctctggggtgaaacagctgtcccaactggggtcatattctgcttttacccccaaagaagtgaagttggtatcccagcatggttactgatcatagtagcagtcatgccacaccacattggtttggcagttggcaaaggcacctctactcctattagtatttggccctccctgagccctaagggcttggaatcattgtacccattttgcagactcagagaggtgagccccgtggtcagcagcaaggcacaatgttggaaccaaaacccttggtttatccagatactaaattctctcctccaagctgggctgccagaacaggcagggtctggagcagatccttgctactccaagtctgttctgcactttaacgaggtccctccaaggctctgcgtgcctgcggatgtttgagaagcactagaggatgacctctcatgccgtcccctcctcccagctctcagatgctccataagctccctgcgatgactcaaagtaaacaccctgaacagcagaggacagagaaaggaaggggcctgggagggaaccccaaatccttccgaggcccagaggaagaggcaggagagcaagggaggtggctgcgtttctgtactcagccaacacccagctagaccagggtatgggcctggcaccctggcatgacagctcaaccctgggcacatcaagctcctgggctgatttggcaggtgaatctagcagggaggtatgcagtgggcaaggaagtggtcagagagacagacagacagacccagagagagctggggtatgaggtgctgatggagagaagggaggtgtgtgtggatggacccatggagagaggggaggtgggcgcagacggacccatggaaagaagggaggtgggtgtggatggacccactgaagcatcaaggaaaaggagggatggagagtggtggagactggggggagagagagagagagagaggtagagagacacccagagaccaagagacagaaacaggagcaagaaaacctagggcagagcaatgcggaggcaggggcatatacaggggtggggccaggagaggaagagacacagggagagagataaatcaagaaggccagggatgatggaggggggacccagagctggagggaggaaggtgcagagagagggcttgagggctcggaggagagggacacagacagctctgccatcagaggaacccgaatttgaattccaggcccaccacctgctcccccatgttggtccacgggagcagcagcagcaggcaggtccctttctctcccagcctagtgacctgccagagccagcttctctccacactccctccagcctcttctcccactcccagtccaggtgtctgtggcgaggaccttttcccatgcacagggggctgcccgggcctgaaccccagatgccctggcctcccagtgcagcggtggtgggtcccagagccctcagagcccagggtgagaagtcctgcccttttgccaagtgttttcctttagttccagatgccaccctgacaggtgctaccctgtgattaatgtccccacccccaaggcctgggaccagcccctcctccccaagccagaggtggcggtgggtgtgcagcgcagggactgagcttcccgaatcccttcctggttcctccctctccctcgaccccctccagccaccaggagcagagagcagacccctcctcaaagacactctcagataagccacatggccgtgactgagtttccctttaagcctcagtttccctggctctctgaaggtggcaatagtcctgctgctgtgctcaggaggctgtgccagcagaaagcccggagctccctggggcaaagcagagaggctgctgggggcctctggggagccccacacactcttgataccagagccactcatggtggtggatgtggggataaaaagaaccatttctgctccgtcagtgatgcggggaggagaagctggcagttgtcggaccatgtctggaaacacacaggcttcagcaacttgaaggccctgtgcagagtggcagagaagcagaccatggttacttcaaagagagtcataactagggacattgcatggtttgggggactgctgtcagagatggggatcaaggttggagttagaattggtcgtgttaaattggagagtattatctaagttggtggcaatggttaccagctgtgtgatcttgggcaagtcacttgacctctctgtgcctccatttgctcatctatcaaatgtggatgacacagggttagacctgcttcccagggctgttgtgaggagtaaatgggttaactcactgaaatgcttagaatactacctgagatggagacagcattacagaaatattagcttaggattatgggtggctgaccttggaagtgtggtcagcaccagggtcatggagtggggtcgtaatcagagcggggggcccaggttggagttggggtgcatgcagtataggataaggcggggactccatttgcccaaccccttccccatataacccgaggcatcgcctttccagcctgcatcgccagcgagaaagctactatctcctcccgcatctcttagggcctggggactgaaacgagacaacatctctccaccaccgtccccagcctcttgtttgtttggtacgtcaatgccgtgggcatgtttttgctaatttcgtagctgcctttatcaaatggggattcacaggcgctttatcctcgataagtggattagtctttgagctaaacaagaaggtgtgggacgcggggggctgctccggagaagatatttgttttgtaaagaatggagcctgcgttccctgccctgtgtgggtgaggcggcagggcgtcgacatagctggaagggctgtctctgttccttctcccagggccccagaagccctaactcgtgggaactttctacagtgccagcagggagcaggagggaggctggatctctggagaaagagctcctgggtccatctcgtgaggggagagtgaaactccaaatcagacctgggtaaataggtataccggggctcattttgagttgtgtcacctccttgggttgcagctttttcctctccatcttctgtcttcatccacctttcctttccttcctacccttcacctcctttatttgtctcctttcctcatccctcaaacccctccaagggccttttgctaagaactgcacattcaggcaccaataagacattgtttctgctcttgcagacttcatagtccagttggacaaaaccaagacaacaaattaatgggcccccaaatgtggcagcaagaggcgaatctggttggaaaccctagaatgcttccagctgcttccttagccttgatgctctctaaggaatggccatctgctgctcacagggcttctcaagcttctcaagcttctcttcaaacacccgggataatagttgagtatgttccccccgaggccctgggggtggggtgtaatatagagtttaatgtattctctttgagatgcattctttgccactacggagccatatatgttgggtcataataatggaataagttggcatcgtgtcaagttgactcctctccaggaagttgcgccatgtttagcttgtggctttccatggcacatgaaggacagccgaatatgggcactgagagggaaatcgaagatgattgggatgtctgaagtctgagtgaccaagaaggtgaggtatcgtagacagaaacagggaatgcaggaggaggacctgggtcagagctagctctttgtaggtcaagaccaggagatagccacaaacgtgtccaggacagaggttggggcaaagatgtggatttcagagacatctctctgcagagacctggaggtggaataagatgcacagggagagaagagagaaaggctgggaggtttcattgcacccatggcggggggacccaaatgctttctttttcccttccatttttaatatgcatagccaggatcttgaggtccttgctctgtgttgcagcaagagcctggctgagggggagagagggagcagagactctaagaaggaaagaaaagagtggagcagagcattccggtccccagctggtctttagcagcgtctgtcctccccaagctgcctccagctgagtgtgattttgctatttatttacatgtaattattgctatgaggtgcagatattaacgctgtcaagagcaatttgctctgacatttttcactcgctcagtgcccccgccactctcaatggggcccagggttctcccggctcaggccgctgcgtgctcggtgggccggccgggaaccacccagccggcaaggagtggcgtcagcgggctcacccggctcctctgcaaactcattaagcttcgaaattgaatttggtccgggagagggctggctgggccccactccaccagtcgaggctggctcaaggcctccctgctctgtcttccacagagaaaactgggcagggccaagctcactggggcacaggccagtggctaaggctggcagcaggctgcagaggcagctggtgaaggcagtggagggtcatggtcagagaggtgagatgtacacagccaccatcagcagagccccaacacggccaaggcacgctgcgggcatggtagctcaaaccctctctgtctgctccattaccaggtcacccagaaaaccaatccgtaacttcgagggacagcactgcaattgacaggtgcacccacctaactaacagactgtcctatgaagccagtcaaacaccttagtcatcctgcagaggatggtactatggaggtaggaagaggtgctgagctggccctgcagcaaggcccctgggtggatgctagaaacagaaccgactctatttacaacttttgagttcaaatccaacccccagtgcttactaattgtggagactggggcaaattatttagctttctagagcctccgtttcctgatcttgaaaatggaacaggcatttttcattatatttcatatttcattgaatctaagacatctgatcctggccctcccttgatcctatcagaagatgggaacaaaagctttccacacagctacgcagccacatagccacagcaaggcactgacgaaggcaatacacatcctcatttcagagaagtgaaaatgcatgtcttcgacctgctgtggggaggaggggctggcagtccgcctgcacaaagtaggtgatgggcacatagtaggtgcttaaggctatgatcctttgcccatgtgagcttctctataaccaggggccattttacaaatggggaaactgaggcttatttattaattcattccactgaagggattttgttcctgggagggggcaagccgggcctgagctatcacggccctgagtccttaacacgttgtgatatgtgccagcttgtctgcccaggtactaacaaggcctccctgccaccgctcagtccctgccagagccaatctgcatcctcgtctccaccaattacagaggtggagacgcccccccgcccccaaccaacaccgccaggccaggggggcctgagagcccagacgtcctccttttccaacctgggcgggggaccagagtcaaggaggccctcctccctcccctctccttcctcccgcctgcccctcctcccctcagctcggccaattaggcccctgacacctggagccgctgacaaactgtttctgtcacttgctctctgtctttcattagggccgcagaagagggggagcagggaagggagggggaggagatgggatctttcatgcttagtaaggccagatacattaattacaaaacggccatttgccgcgtgaaagtgtgctaattaaatttatgcaatcattatctttaaatagtcatatcttttccagcgatcggccccttccccccgagcctcgccgctccgagcagagtcactctaatccctcgtccaccatttatcgagccatcagagatggtttcagaatctcactacaccgttagcaccaggacccaccaggggccctgagcccttggacccatcctggcgtgggcaccttcagactcaggccaacccaaggatctgccctgggatgaggggcaaagcctccatctggtgtttccagatatttctagatgtttccagaaatttggagattgacatcttgtaaaacagacattggaagagtgtgtgtgtgtgtgtgtgtgcgcgcgcgtgcgcgcgtgtgtgtgcgtgtgtttgtgtgtgtgtgtgtctttgacttcttggacaataagtggaatgccattctgttcctccctccgcccccacctcacctctagacatcttataaaacagacattggaagagtgtgagtgtgtgtgtgtgtgtgtgtgtgtgtgtgtgtctttgacttcttggacaatgagtggaaagccattctgttcctccctccacccccacctcacctctagacagtccttaactaaaagcctccaaggacccctggaatggggagggggcacttagaaacccattgggttggaggatgtttgcaatatgtcccctcaatttattcttttcctccaaccaactctgtgctagatcctgtgctcaggataaaaagataaattcatttcttcattcatgaattcctcacttagcaaatgtttattgggtgccttctgtgtcccaggcactgggaataagacgccaagtctgtccccaggcagctcctggccaaatccaggcacgtcatggccaaatccaggcacgtcatggccacaagaaaacaacaaacagggtgaggctcagtctgttcccaggcagagggttgggccttagtgggactgaaagtttccacggggtaaggcttgaacacagggacctcacagcctcttttggctgcacctcccagggtctctccctcacacaccagaaggttcttaccaaagtctcagctggatgtcttctgctgcagtttcacaaattatcccctctgctttcctcttcactcagacagagccggcctcatgagtctttccaagtctgtatatcaagctgcacgtgggaggagaagagaccccaccagggttgtgggtggctagcccccaccctggtcagagatggcagtcaatgacccggtgttcaccacgtatcctctgagcttccaaggtccccgagcttcagcctgtactctgggttggggcacacaggatctgtgccctatacatgtgcagtgctcacatgcacacacaccatgcacacacagtagtagatactgcatgcacatgcaatacttatgcacacacaatactcacagaaacacataaaaaattcacacatatacacacaaatacttgcacatgcacacacagattctacacatgcacatacaatactcccatgcacatataacacacaggcacatacaaagacacaatgctcacacatcacacaaggacttagaagcatgcatacaacacacacacacagtacttccatgtgcacaagcatgcatgaacacacagtactcacacatgcacacacagtattcacacatgcacacactctctcatcctctctctctctctctctctctcatacacacacacacacacacacacacacacacacacagagttaacactcaggtaataaatgaccctgagccacctatggtaaatgaaggccacagccaggcacaaggcgatcaccttctagcatcagaccagaagtcgagagtcaagggtccttgccccagtcctgtcactcatcccccaggtgattctgggtgagccgctaagcctcagttttctcatctgaaaaatggggtcacagtacttcctagagtcatgatgaggcttaaagggaaatacttcacaaactgtaaagtgctgtgcttgtgcaagagaatgccatcagccaggcttagaaaagcgttcatggagggcttcgagggtgacaaatgagagggaaccaggagtcagggggctgggtcgggagagggaagggaaccttcttgcccacacggcaggtgcagggcttcggtgtgggatgctggtagtggagggggttgggtgtggaggccataagcagagatggaaactgaagtgggggacagggagacctgcaggaaatcttgtttggaagctccaagtcagcacccgaagcctattaccgctgtccacagggggaaaggagggggagggtccagatcctcttagtggagtattgagaggaagagggggtgagggtgggcagctgcccgggtgggtaatttctggcttgcactaatcccagtgtggggctgggaacaggcagccgccagtaggggcatgcgtgtgtctgggtgtcccctgggggctggaggagggtgaagggcgcacaggtttgcgtgagtgagctgacgaaggcggagttgtggggtggcagtgtgtgggtgcgtgagggtctgtgtacctctttgtgtgcacatcggggaggccggtggatctgtggccagcgggatgggtgcctgcgggttttcatggatgtcgttctctgtctgttcgtgttggcgtgtctgtaatgtgtgtgtcttcctgcacgggtgtctgggtgtgtgttggtgcgtctgtaatgtgtgtgtcttcctgcatcggtgtctgggtgttttttgtgtgcatcccatatcttcgcctgtatgagtatggatgtgtcatggtattacgtgtgtgtagcaattcacagtgatgtcttgagactagtggccgtcaaacttggctgctcattagaatcacccgggagctttaaaaactcctgacctgaccgggcgtcgtggctcacgcctgtagtcccagcactttgggaggccaaggcagccagatcacctgaggtcaggagttcgagaccagcgtgaccaacatagagaaaccccattctactaaaaaaaaaaaaaaaaaattagccgggcttggtggtgcatgcctgtaatcccagctactcaggaggctgagccaggagaattgcttgaacctgggaggcagaggttgcggtgagccgagatcacaccattgcactccagcctgggcaacaagagtgaaactccgtctcaaaaaaaaaaacaaaaaactcctgacccccagacccccaagtgattccagtggacagtcaagacggagaaccagtgatggagcagacagacccaggggagaggcccatctctcttgcccagtcctcagcctgctctgacaggatctgcctggaggcagaggtggattccagaccccagacccttaggaaccaaggcaagttgtgagctgggctgccacaggtcatctcccagcctggggacagttcttggtccatagggacactttcatgcaattcagacaaagcattctattcctggcaagctgtgttctgacaatgggaacagagggctctgaaaatatctcctcttctcacctcttggggaagtcaaaacggtgagccagggctggaggtggacctgaggcttggagatgaaagtgctctgtgtgtcaagccagcagatccttttggaaccacacccaagacagggggcaggagggagtggcagtaatccctggggtgccaagtcactctccctctttcagcctcagtttccccatctgtgaacatgcagcaaactccaagttgcctcccaagtttcatgtgcatatttgggtgtatttacatgcaagtgtgtgcatgtgtaagtgtattggatgagtttaggaaagtgggagtgcaaatgggaaaaactatcctgcccgttaactggggctctgatgaaaggctatttggcgattgggaccagagatattttcaatggactcatcgtcctggattcagttgtgtgtcctgcagagtgtggtgtgggctgccctgtgcagtgtgtgtgttgtggagttgtgtggattccaggccttgctcagctgagactgggagactccaaggatttgtactttgatggttccttcttcctataggggagcacactcaggccagagtggggtgcaacttgtcaaagcctcacactcctgctccctttccagtgtgcaggccccagcttctgcgtggggacagaacagttctaagggggcagagcaatgcttcattcagaaagaacccactgggtgttggcccccatgggagaaaaagatgaaaaactgcacagcccctgactgagagctgttcccagagtctgcttccaagtgctcatttccatctcaggcaaggtccctgagccacctgcctcttcccttctaatccaggcagaagaggtgtcggggaggtgaaaaaggaaggggagggggacagctgatatttactgggaactaacaatgcaccaggcatggcacatccagtgtacatttactcacttaatccttacaataactctctaggtagctacaattatcatcatacctattttatagatgagaaaaccgaggcacagaaggttaaagaaattgctcagagtcgcagttagtcagggcagatattctggcccctatgctgcaggaaagcccttctgagcactgactggtccaggcccagtgccctcggggaaactgttgtccctcttagagcctcagggtccctctcaggcagtgtagaggtggggctctgtgtcctgccgatggtccctgcagccttgacctgattcctgacccccacccctatcctgaccttcagtctctaggccctgtgcctccctcttcctctgcaccctgctgcggcccccacccacccaccacaaaccctgccacagagccccaatgatggcgattgccccttctaattgcagccacactcccaaagccacgttcagttatcacagagggtgcagatctcacagctcagcctcctcagtcccaggccctcggggccagctcaggaacggagggaactaattacatttttcccatccccttcttttaaagtaggggagcgcgccggcatgtcccaggggagggggcggtgagcagaggctgtggaaggggggcccccacccccaaaccagcaagcctctccccagcagacggaagggagggtgaggctggcctcttattgatttagtctggtcgaggctgggactgatttggagtagagggagaggaaggggttgggggtggggtaggggccgtggcgggtggggggaaatggaggaggaagggagaggaagggacggctgtctgtcagcctgacggacagccctgagatttgccttcagataaaaccttacagatgtggaggtcggtattgattttgagttagtaacggtaacctaccaagaagtaatacattagtgaaagcaaggtcaccaggaaaaaagtaaaatctacccggggagaggccttagcattcttgagaggggtggattactgcatcagacctgaacttcctcaagttgaaaagtttgcaggctccggacctcagctggattcctaactgtgggccaatgcttcctgcttctgcaggccaagagggagccctaaaggtccccgggaagccagaggccagcgaggggcatttaggcccatagggctctgtgcagtgaggttgccaaacctctccctgtgtgctctccagcacagctggtggcagggaaagagcacagctagggacccgggagacctgggtgcaaatcccagctctgccacttaccggctgtgtggttgtgggtgagcccttttgcttcctcgtgtctcaatttccccatctgcataatgggagtaatgataccccatctgcttgaggagtccatgaactggccaatatatgactcaggccttgtggtcttcatcagtgagtgttctcccctcccgccgctctccagttgggtcctgtcccattagcttagacgctgccctgcctggagacagggggttggatgaaatggaagccctttgatccacagacccccaggggctctgggagagagtaagcagtggcagcacatcctccattcacaccctccccagatgtggatttgatttgatgttccagggcaaatcccattgagcaaatcccattacgggaaaagctccctggacccaagctgtttctgagctgtcagttcacagcccagggtccaaggcctcttgagccaccgggcaccacccaagccccttctgagaaaggactgcacaagccctcgcagctcctggaatttttactctccgccttcaccttcttgctatttcctaaacctgctgggtgtatctcgtgattcagccccctcagccccagggacctcagggcctttgcacttgctgacttctctgcctggaaagctcccctgcctcgtcttctcagggctgttctttctggtcttgctggatatcacatctttggggaggtcttgcctgactgccccacatagccccttatttttcctccgtagcatttatcagtatcagaaattatattatttgttcacttgtttattgtcagcttcgttccttaggccgacagctccaggaggacatgggattggcatttttcatggctgtgtccccagtgcctggcttagtgtctggcatataataggtgctcagtaaatgtttgttaaaggaatacacatgaattcagcagaggttttctgagctcagaatatgtagcaagtaccacgtaggcactgggactacagagacagacaaaatgcagttccatcctgctctcaaagagctcatagtccagccctagctccagactggcacatagtagcaccctatgaaatgcttgttggacgaatacgtgaatgaatgaaggatatcttcaagaaataccacattgtttgggatagctggaaggtaaagtgcagggtagaaaggggtgaaaggagttgggacaggcagctagaggtctggtcactaggagcttttgctgagagataatggggagccattcataattcttgagtgatactgtcagattgggcagcagttctgtgcaggtctctgtcttagaggatgagtagtgggactacacatagctctcagcctgtctcaaaacatcctcgtcctcttcctaaccatcccccgactcctcccctcccatcatcccatccgggcttggcatcctggggatgggcaggagggaaggatcaaactggagtctcacgggagctgacaaaccctcccagtagtctcccagcccccgtcaactgtccttctgaaagaagtgatctggagcctgagtgttttttctgagcctctaagtctattcttggagtccaggcctcctttgagcagggagcagggtccgtgtttgtgttgggtgagaaaggagatgggtgggaaaaggtctagactgagaaccccagggtagactcagattcctgagtctgccctgggaccttgctctcctccccaagcccctagcacattcttcaagctaaggagatcccatcttgacagacagaaagcaacaaacacagtcccacagtgtcagacaccctcacataccactaccccagcaccctactgttgacccgaccacaacaaagatctcagaagcacattcaacacagagcgagttagggagacctcagctccctaaagtagtgctagtgtccaaaggactctagaccctccccagcccagcctcctgcctcccaggcagactttctctctccttcttgcaaacccattccagtgtgtctttgccatcttgatgaggttgacacacccctatgtcccacccaaatctccccagctgtgtggagatgaagactagccagttgacggtctcagctggtctgagctctgagctctggttctggggtgagagtgacagagggaaaaggtggaggaggggagacccccagggctgagggcatgggggaaagaaccaggcagaggctctgctcaagacattccagaggacctaagcttcccccagagcaagggaccccaccccactcaccccacattagctgcccaggaaacaaactactgctggtccttggagtgagaccctctaaagtgatcagatgcctcaacctcattcattcttgagagttgaacttgacattttgcaggtgagccagggtcaggcgaactgagccctgggcctgctgtgagatctagggaagccacggcccctttgcgggcctcagtttttcatctgggaaatgggcatcctagctttgccccacaaatctctgtgggcttttgggttgggagagtcaaatgagttaactgctcagggatactcccgaggttacacagctggtaaacggaggagctcgctgtctgtccctagcccgaggaatccatcagtgccctcgactgtggccaggcctcaatgcctgtggcacaagccaataataaaggcaaaggtaaaaatcttcagaaggtgtctagtcggcaaaacgatcactgctcgaatgcccgcagcctgctttcttaccctgtaaggggagtcagggaactcaactgtgtgcccagcagggattgccacgtggttctccgtctcggtgctgggcagattatcagcaaagccgtccccacctcatactcagggtcttcctcccataaagggcggcatcaccaggaggtcatcaggggcctgggccctgcaggttaggttcacgagggcctgcctctccctcctaccctctcccctgccctcctctgaactcactgggacactgtgccctctctctcctgccctctcccctgctctgctctgaactgactgggacactgtgccctcccactctccaggagctcctgctgcaccactcccagtcccaccccaggaaagcactgcttctccccgtcctctttcctggagagctagacagcaggttccacctcccctagatttcccagactgccaaggatgactgggtgccctcctctgtgtcctttgatagataagatgcctgtatcactactccatgtctctatgatctttgctagtagcttccctcacccgacccagacccttcctcctcctctcccccgaccgagggcagggaccatggctctttctcctctgaagtctcagagccttcagctctcagcctggggccagagtcaccatccatgcctgtttgtggagtaaacaagtgaacatcccagtaagtgaacacctggacctccatccaggtcccctaagctgagcttctagagacaagcctcccctggtagtctgtgttgccagcactgacagtgagttcctatttgcggaacctggccaggcagggaaggaggggatgctcacagacctcaggagctggtagaatcaaaggaaggggcctgagaggctctttgaaagcattggctgtgggcttcagtgtcgaaggggcaggaacctcagagtccggaggagtggcaggcagagcaagccacacacagtgacagcagacagatcaagagtcctgctgtaatgtttgtgttagaagatggggccatcccagtctgatgggggaggcacagttctctgagcttggagaactccctgactgatgggagaggcctcattagccagttcgttcattcatgcattcattcatgcatttattcattcaatagacaggcccagagtgacccttagggccagaccctggagctagagaggcgagtaaggccctgctgagttctcagtggaaggaggatccctgggtcaggaccctccttcaagagaaacaccgaagaccagcagccatcccatgcatgagggcacgcaaatcaggtaaactgaggacctcgaagctacagagacttcaagggaacaactctggcaaagagtgttccagggccagcctggcattgtgcccagtgtgctcgtgtctctggggtctgtccggtgagcctggcactaatggccttttccccacaggtgatgagcatcttgggcaaccccagtgcggtgcccccgcagccacaggctgacttctccatctccccgctgcatggcggcctggactcggccacctccatctcagccagctgcagccagcgggccgactccatcaagccaggagacagcctgcccacctcccaggcctactgcccacccacctacagcaccaccggctacagcgtggaccccgtggccggctatcagtacggccagtacggccagagtgagtgcctggtgccctgggcgtcccccgtccccattccttctcccacccccagggcctcctgcttgtttatggagagctacaaggtggtgtcagggtggggaatgtccatttcacagatggaaaaattgaagtccagccagatggaacagttcacctaaaatgacactgagttgggcaaaacccaggacatctcctggctaagcctctgcttccgtactatggctccaacagaaataaaatacacaacacaaatatcacttaacatttctagtggccacattttaaaacataagaagaaacaggccaggcgtggtggctcatgcctgtaatcccagcactttggaaggctgaggcaaacgaatcacttgagcccaggagttcaagaccagcctggtcaacatggtgaaactctgtctctactaaaaatacaaaaattagccaggcatggtggcgcacacctgtaatcccagctactcaagtaggtgaggcacaagaatcacttgaacccgggaagcggaggttgcagtgagccgagatcacgccactgtactccagcctgtgtgacagagcaagactctgtctcaaaaaaaaaaaaaaaaaaatcaaggagaagaaacaatggaattatttttactaacattttatttaacccagtacatccaaaagattatcatttcaaaatgcaattcatatataattattgagatattttacattctcttctttatgctatgtctttgacatcatgtgtgtgttttacacttacagcccattttaattcggacactgagttttcaacagaaatacttgatctgtatttaaatttcatatagtttgcaactgagaaaatatacttacaaacccaaagtgttccaaattgtaagttttccaactactaaataacccaattgaagattggtttttgactttaaattagttcaagtgaaatcggcatttgaaattctgtttcccagtcgcactagccacatttcaagtgctcagcagccatgtgctgctggtggccactgtgctggacagctcagtgggagaccctgccccttctgccgcagggcatgggaaagctgtgtttccaactctctcctccactccaaactctgcaatggtctcatgcacccatcccagctgctatcccctttgtgccttgccttgaggcagggaccgtggatcctcacaccaaaggctggaaaacgcaggcctggacacagcctccaccgcctggcaaggccagcagcagggcaggtccagatgggacagggagccagaggtcatgggtcactttcctgccccaccgccctgcaaaggcctcacctgctggtgtcaaactaatcagaagggcgtgtggcaagagggtgaggcccccatccctgagggtgtcctctcccccagcccagccctgggccagcctttctgacctctgcttcctgcccacccccccaaacccactcctcttcacgtgtcgttggcctccactgccaaatgagggccactgccaaatgagggccagctatgtcggcctccacctcccagctgtgttcacaacccttcctgtgcatgtacatgtttgcatatgtgtatgtacacatgtgtgtatgggtgtttgtgagtacgtatgttgggacatgttacaattcttgtgtgtgtgtgcatgtgatgcttctatttcagcacccatgtgttattgcatgcatctttgcatatgcgcgaatacatgtatgtgtcagtgggcacatgtgagcatatgtgtatatgacttcacatgcgtgcacataaatgagcatattgtgcatacatgatgtgcacatctgtgtgtgtgaacacacatgtgcacacatatatgtaagtatatgtatctgcttaaacatgtttaaatgtgcattcaagtctgtacatatggttgagcgtgtctttatgtgtgcctccatgtttggcataggtatgcatatgtcaatatgtagataggtataatgaatatgtatgcgtgtgtatagatgtatatgagtgtgcaaacatgtgactgtatgtacatgtgtatagccatgcattgaggcatgcacacatgcttgagtgtgtctgtgattgtgtgtttggaagtacctgtgtgtggacacatattctgtgtgcagtgtgtaaataggggtgagtgtatgagtgtatgtttgagtatgtcataggtgtggctgtgtgtacatgtgtatggatgtacatctgggtgtagacatacactgtgtctgtgtgtataactgtgtgtgtgtgtgtgtgaatgtgtacgtgggggtctgcatgtatatttgagagcagggtgcacgcatgtgcatgggagaatttccagagggtcccagggtgacctcctgacccagcccgtgttcctgggcatgcagcaggacacacatgctcttgataaatattttagagtgaccccagcggcagcggcagccccggcctggggcaggcgttagtcacacccaagctcggtgccctgctccaggggcgcctgctcaattcggaaataaaattaaccccaaagtcagcatgggggcagcaggggaggggatcaaaagggaaggggcctaggaggcgagaaaggagggtttgttctcctcttgcttggacaaagccagccagagcagcttcctcctcccccaccaccccctactccattcttctcttttccatcctctctttccactcccttctcctcctgtcactccccttccagctccacccctgctgccctggcttctccaggaatagctcagagctcctcttggccacattctccagccctccccaaagggagcccagcacagaccccaactcaccccacagagactctgggcccaagctgggagggaagggctggaggaaaagccccctcctctgcccccaattagtgcaggcagccacacacttgcctctctgagcctcagtcttcccatctgtgaaatggaggccacgaattagacttagccgtctcaaagtgtttccattgcaccacctccctctcctttggcattttggaggccctgagacacatcatgttcccgctaaccacttgccccacatccctgggcaacttaatccatctgtggctgggatgccccagtgtgtgtgcaagagtcccatgtcctggactgtgcccgcctatgcccaggtccatctgtcctcccttaacacctgccctctgcccaagttcatcccacagggcactgggcaaaatgcatgctcctcattcatgtcattctctaagttatttgtccccaggttgcaggtgcaaaaacgaggctcagagaggcgaggtagcttttccaaaatcccacagcatggcaatggtggacccaaagtcttctaacttcaaaccacagatttgtggaggccactgagcagcgatacacacctgagcccacccatgcgtggattcatgtccacagcttcacatgcatgtgcatatggatagacacacacgcagagagaggggtttatatgtgagtgttcactaatgtgtgtacacagctttaagatataaatatacaaaatgtgcatgtgtaaaggaaggaggaacgaccatttattgagcatctactatgggtctagcatttcatccttatgccaccctatgcagtacacgtggttattcccattggacagatgaggaaatgggatcccagagaggctgtttatgcaaggtcacccggcagcccatactgatgtgtacacagccacacctgcagcctggttcctggagagccaccttcaggtgtgcatggaacaagcctacacatgggccaaactcttaggccccagagtactcctcctcttctccgtgggcttctcatcttcccagggacaccttcactccttttcctgctctggccattgtccatccacctgtccgtctttcctcgtctctaggggagtgggggcaggggcccagggatggggcacatggcagattaatacggccctggtgttcccagaggccagggctgtactaataatggggctgatagaacgctgaagtgtgaaaagaattttaatagatctgacaagtctaataagaatttgtgtctagaagggtcctcctctggggctgcgggctgacgaggcgctgacggctgagattgtttaccggttggcatcaccaccacatctcctgccaactcccaattaatctaatttgagacatttagagcccagccacgggcgcgaggcagaagaggggagatgcggagagacagagggacagggagggccgttgacggaggccataataagagatgtcacaaccctgccctcgccggcccctcggctccacccctgggagaggcaggctgtgcagcctgttgggtgcccttgaagttggcagggtcatcaggaaagtttggcttcctggtgtttccttggctacctagacagggcctggcaagctcctactgtgtgctgggcccatgggctggtcgctgggagaggctgacaaggataaggcacgcagagtggccagaggcacaagcaggaccaatgcagactcctcctccatgtcacgcactgcatgtgactctgggccagcgacctctccgtacctcagtttcctcatttatagaaggagaacgctgatacctaaagcatggggcagttgaaagaaatagatgtggtcatgcctgccagcacacagtaggtggtccatacatgagggtgctcgccttgttgttctgattattattcaaagccagtgaaaactagaactaccatatttatcaaaaggataggaatcagtgtatcaaagggatgcctgcactcccatgtttattgcaaaaccattcacaatagccaagacgtagaatcaacctaagtatccatcaacagatgaatggataaagaacatatagtgtatctacccagtggaatactattcagccataaaaaagaataaaatcctgtcatctgcagcaacatggatggaactgcaggtcattttattaagtaacataagccaggcacagagagacaaacatcacatgttctcatatatgggagctaagaaggttgatctcatggaggtagagagtcaaatgatggttactagaggcagggaagcagggagggagatgaagagaggttggttaatgggtgcaaacatacagttagatagaaggaataagctctagtgtttgataacagaatagggtgactacagctaacaacaatgtattgtatatttcaaaatagctagaagagaggatttgaaacacatagaaatgataaatactgggccaggcatggtggctcacacctgtcatcccagcactttgggaggccaaagtgggcagatcacctgaggtcgggagtttgagaccagcctggccaacatggtgaaaccccatctctactaaaaaatacaaaaattagccaggtgtattggtgggcacctgtaatcccagctacttgggagactgaggcaggagaattgcttgaactcgggaggcggaggctgcaatgagccaagattgcactgttgcactacagcctgggagacagagtgagactccgtctcaaaaagaaaaaaaaaaagaaagaaagaaagaaagaaaagataagataaatcctgaaggtgatggatgccctaaacagccttacttgatcattacacattctatgcacgtagcaaaacatcagaggtacccccaaaaatatgtgcaaatattatgtatcaattgtttaaaaagacagagctctcagcccatccacaggaatagctgaagaggttggtgtgagaggctggcatggtgtgaagtaaggaggggaggcagcggctgctgtgactccgggaaagtgtcacctgctttagcggtgtgcccttggacagatcgcttacattgcctggagcagaacatgggatcaatgcagaatttggggtgcagagcacctcgtgccctctagtgttttgcatgtacaaagggttattctctaggagcctgcaggggtggctgggatccaggctcagactgcctgggtttgaatcctggctccacaatttatgaactgtgtgatctttgaagtggtgcagtctctcagagcctcagttccatcatctgtaagatgcggataccaccactaccagcctcatagagttgttgtaagaattaaatggaaaatgagcacaaaatgcttagaacaggactaggatagaacaagctctctgtaaaccctggcttctcctctttctattccgactgtccctctaagaatgaggcttctttttttttttttttttttttttttttgagacggagtcttgctctgttgcccaggctggagtgcagtggtgcgatcttggctcactgcaagctccgcctcccaggttcatgacattctcctgcctcagcatcccgagtagctgggactactggcatgcgccaccacgtccggctaatttttgtatttttagtagagacagggtttcacggtgttagccaggatggtctcaatctcctgacctcgtgatccacccaccttggcctcccaaagtgctgggattacaggcatgagccaccgtgctcgggcagaatgaggcttcttaatgggatggacactggagcccgggtaaggcaggcttccagtagcagagttggtgtggccagggctacagagtccccccaaggccagagatgggaatggccctaccctcacacagagtaaggggcagacccaaggcagggccaggctgactgccaccaactctgctctaccaactgggagcctggaggccaagtgacttcagaggaaggctggcagtccctgggggctcagctcagaccctaggcagacttaactttcctctcatcacccaccctggagcctggtaagcagaggggcacagggttcagacactccagagagattccagggcatttgcacatcccttgggactgtcgagggccaagccccttcatgctctgtaaccaccatcttaaagaacagtgtctcacttcatcctgatagcagcagccctggaggaggctggactttatttcccccattctgcagacaaggaagcaggtctagagaggtcaagtgatgtgcccagggccacatgagcaggaggtaactgggactgcagccacctcatctgctgcttcatcccctcctgcccccatcaaaggccatgtttacttactaaatcccaatcctagtcttctgctgcttccaaaccaacatctctcaagctcacattgtgccaggcatagtactagctagccactttgtacgtatttcttctttaaccttcataacagctcctcagatagctgctgttacgatccccattttacagacaaggaaactgaggtttgaatagatgaggtgggatgccccagagcacacgttaaaagttggcatgtgcaggatttgaacctccgtcatttgaaccactaggcaatacagcctcccgtggctcaatgattggcactgtccacttggcctccctggcctcatcctcaggccgtgcgtatcaccttttggctccacccacctgccctgggcaggaacctccaaccttggggaagcatgtagagtgctacagcgtcccctgtggtcaggtgacagaacaagtgttgaaccaggccttgcaattcttaacacagtgttctttccatcttcctcttgcttctggatcctacaaatcccaggggtttggactggccacagccacagatcccagcttgggaggcagcatctctgtgcttctggaggccttggccacaccccagccaaatcatttggtcagggctgatttcttttgtagcctcagaaaggcagaattagtacagtcaagacagaacacatgtacatgcaggtcaagggtcatccctgcacatacacaaatatagaggcaggtacctggctgagttggaactcacctgtacacagtgcctgcacatgcactggcattcccaaggttcatctattcacaaaggtgcacacaactcacacacatatgtgcatgtgtgtgtgcaaatgttgctcttctgtggacattcatgtgcagtctaattcaaggagattcttgtttcagttgttcacacacacaagtatgcaccactctcaggcacacacaccctcagacactcatctgtctcctctgggggaccagatggacagagctgtaggtctcagctccctgcgtatctgtgtcctggctccttctgcatggatccctcagctcacccacagccactttggcctcgcagcaaaggtcttgctttgccttatctgtaagctgggcacagatagagaaggcagagagaccttgccctcatcattacctgcactcagggattcacagggccttctccatagcaggtatatgtagtgggcttgttgaggggtggttaattctttgctcagcaatgtgggtaatcttctgtgcctccctaggaacttaccagggagctgggcacaaaatgcattaaacatatttgctgaatgattggagaggaggtgagagaaagagcttcatgaagagatggatagatggaaggatggatggatggatggatggatggatggatggatggatggatggatggataaatggatggatggatggacagagaatggataaatgaatgaatggatggatagatggacagaatggatgggtggatggaggcatggatgcatggatatggctggatggatgagaagatgagtggatagaaggatggaaggatgatggatggatgaaagaatggatgagtagacaggacggatggatggatggatggatggatggataaatggatggatggatggatggatggatggatggatggatggatggatggatgggtgtagatagagtgaatggaagaataaacaaaaagaacctcaatttctaggagagtctcttcttttttccagctgctgttgattatctggccaaaaatgtgagcctctccacccagcgtcgcatgaagctcggggagcactctgctgtgctgggactcctgcctgtggaaactggccaggcctactagggcccctggggcgacttgccccagcccaattcccagcccaaccctaactgacccctgagcttcccagccttgccgcctcacccccctgttgtcctaggaggccaggaaaggagcccacctgcttctcatcaccagccccctggaggtagacagccagcttgtcactcacctgtggttagggatccagagtgatgcccttggagtctgctccccactttccccaaggagggtttctggtcagcctgaggtcctcccctgtcaaatcccatggtggcctctgtgccatctcaggcatggagattggggcccaccttgaacaccttgggtgcccagaggaggatggtgcctgagaggaggtcctacagccctttggacccaactccagtgggggccctagctagaagtggaggtgaagctttcagggctgctctcagctggatgcactgggagccagccctgcaaggagggtctctggctcagtgtcagaaccacagccctttcctcctctagacattgggactccagcaaagaggggaccctggccctggggtcttcccaggggagtcagcaggggggcagtctcacccccacccaggaatttgaaggacttcagaaccctccccagacacctctactgggtgcatggggaaatctagcacaggcagggagactggggagaccaggaagaggcttaaccagagggtaggggcacatgggggtggggcttgtcagccgtgggcccgcccaggatacaaggacccaactcaggcttctggaagcagagggctcttatcctgaagcccaagttcccagcatgtccactccatctggggcctggggagcccacagaacttttcagtttccttcattagctgaatcagatgagatggggaggggataaagtcttgaggatacatgagtggaggagcaggaagtgggctcagaaggcactttcataaccagatccctctgtttgtgggagggcaagcctttgttgcccaaggcttcagctctctgcctgcaagtccacaccccagggagttgagattttgcccaaagccttccgcagaggcccgagcccatccttaccatgccccatcctctaggaagaggtctccatcttccccaaacccctttcagtttgtggggatgcagagagctaccctcagagctttggaggagggttgtagactgggcagggatggtttgccccacagacaagatgatcccccctggcatgttgttaggggcaaattgctgtcctgctcagagtggcatctttcaatgttgcctccatcttggccaagaggtccctgcctcctgatccggcacagctgagctgaggcagatgtgaccagttttcaagctaccagccctgggcagaagaagatgtcaacaattccagagcagagggaagaggcaccttccttgaccacaccagtggcctcctgaagttccatgcttttaagagctgggaccttgggaggatgattcaaaccctcgattcctcctccctgggaactttttaccacctttacctatttatcaaaatcatattcatctttaccatcactgtcactgtaatctacattccatcacctttatcaggtgctgctgagtacaaagcacttgggatgggagacacagcactgaattcacaaacattggaccaaactgtttgtccccatctgggttcatgaggccacctctttgctcaatccatgcctcttgccctcagtcaacaagacattcctagagggaaagggctgctgctctgggagtcaacctgagttcctccctcctgggaagctgggttggcaagattctaggacactcacctgcatggacatcacctctgtgacaaatgcttacctgtttctcatcttcagacttggcgatatcaagcctgttctggaccatgaccaggctggctcatatctctggtttagagaaacctatgaataactggggacaaacagactctttggtagcagcagacacatgtgatccatcaagatcaaccaaggttgcaactggagcgtccactgccagagacctttggctcttcaagctcgggacaaaaaagaagactctgttgtcccttggtaacccagtccctgcttttgtagctatcacagcagaaagcaactcttcctgaagaccaaacactcgtcatccacattccttgaatggccaatccttccatctggaggcctggctcagaaagtatctgagtatcctgacaccctctgtgactcaggagcagggatctcaggcagctgatatcaaaaccacccagccccatccccaggaggcgacattccaatgctaggaccaatcccagatatctggtcccgatggtgaaatggaacaaagacctgcttgggaataaaccaaatgatttctcatgacgttgaacataagttctcccaagccatcatcttggtagaaaatgggacttattccttgacaggccccacccccttcagaaagaggcccttgaccctgataggttctctctaaaacccgtatattaacgcatctggccaacttgggttataaaattcagccttgtgttggcaactcgaaacatcaccagagaggtgatgttgaatgagagacacaaggcctccatctctttggggctgaccacagcctgagaaagaaggtctgggttccagtggccaggccgtcccagaaacaacccccatccatccctgtaaatagagtctgtagcaaaataagagctgcttcctccaacttatcacaagtcgccgttggtcctctctaaggagggctctcttctgagttcattgtacaatagttggaaacgtggtgatgtgctgttcgtttatagaaagctgactttttataaatatatatatatactaaaaaaggaaagaaatcccccacagtgtgtgtcgtgctagtgccagagaccatctgtagggatatatcttcatattgtgtgtttcaaattatgcattccaggctctagtgggttctttcaatcttgttcctttatttttttcatttggtatttctctcttgctatataaagaaaaaaagaagtgatgtgtaagaaccaagctatgcttttatacttccattttatacttgatttagctttgttgttcttttgccagaggaacatcaaagggcagagcaaacagagaactagggggataagagagaagaaaagaagaatggagagagaggtttgcccagaaggaaaacgaagagccagattgaaatctgactctggcttgagaacaggacgggtcccagagtttgaccactgccagaatccagtgtttcaagatggagttggtgaagcatccaagattttggatcctgggcctcagtgacactccatcacccaactaaaaagatgttctctgggacctctctcaggctgatgttcttctcatcaagctcccgaatgtgtctcgcactattggacactttttgggggtacacaggtcttctctcctcccctcctgcagaggcaccaaaaccaagaccaaatgggggttctctagccgccaacttgaaacgctctgagacttctgtgtatttgatgcttcttcaagtcagctctgacgtggccaattccctgacctgggaaatatttacatagtactctagatcattccttcttcctagtaactgcaactttgttgcttctgtgtttgactcacagccactttcccccatgcggaagtgagtgggtgtacgtgagggtgtgagtggggtgtgtgcgtgggcgtgtgggcgtgaggtgtgtgtttaaatataatcgcaccataatttattcagctatatggagtagtagactagaaagagaaactggtatttgctttaactacctgctgcttgtaagcgcttcctctgtaactcaggcgtaactgttatacattaaaagaaattaaaagcattttgaaggtttcgtgtactcaattgattgtcattatgcagctgctccaaaagggactctgaggggtgtccaagaagcctttggacctaatttagaggatcagcgtagaaactgtgtttctcttgctccccactgggtcctctagtgccaagcagctgcgaggtttctagtgaatgcctaatcaatatttgttcaatggatgttgttactttaagcctcgctctgagctcatagaaacagcacagtgtcaaagaataaggtgaaactttagttctcttcaccagagcaaacttttcctgctgctaatcttagaaccctcagtggctgtctcccattacataggatttgggaggtagaagagagctcagaaacttacatattgcttggaagcatatggggattctcgggcaaatttctggctttgttctttttagagatggggtcttgctatgttgcccaggctggagtgcaaggctattcacaggtgtgatcatagcacaccgaagccttgaactcctgggctcaagtgatcttcccgtcagcatcctgagtcattgggactaccagtatgcctggctctttttctctttttgaattattgatggagagatctccagagaaagctgtaagggaatgaaggaagcaagataggacaagtaaagaaggtgagcaaagaggtggttttacctggagtccagcttgaacctgatgctacaaggagctctggagtgtggattgtagtaccagagtagtcccaccttgaggctgggggctggcttttggtactgtgtcagtcagtcattgactgctggctgtcccattgatgtgggtgggtgggtgatatgtaagtgatatgtaaactatctgcccaagcatctctaaagtggcttttgtgggctgcaggcactcctgcagagaaagcacagctatgagcccttagcaacaacaagcacatcagttaggggacaggtgcactggcccaggaaaagggacctgggcagggaccagcaatgtccactccacatatgttcccctggccctaaaacctgggtatccaagtcattccagggctctggtttccttggattgtcttctgaaccaggaatgcagtggggtgagagagttgttggttgaaattgtacatgaagaattgataaggtgctcctgtcgacctgtgtccagttaatccagccaaattccccagggcaagatctggagggaaacccttggatcttcctagggtctgaaaccaatcagaagttgccccagtatcttcctcttcacagagtccctggagtgtgataagctctgtgccagtcccctatggaatccagaaagcgtatatcagagctagtgctcccagccatgtcctgtctcacatctgtcccccacctacccatctgcaaccaatctatccttcaggtaagtcaggaagatgtgggggagagtcagctctgcagctaactcactatgggtcctcagacaattttcttcccttcttggaccctattttcatatattttaaaaaaacaggcttgctgacacctaaggatcttccaggtcaccgtgatgataacctaagccaaaggtttgttgtcatgcaggcagctcagagagtgcctgcatcacttggaggtgtccatcacaagtgctgggaaagcaacacaagacatgaggtgctgagtgcatgaggccaaggagctccacaacatagcctgccctttgagacccccaacttgaggagctttgctagaagcaccccctgcccccaaagacctttgtgtgcatcccaaggaaagctgaggaatgtagttttctacccaggcacatgactgcccagaataaaatcaggttcctgtatataaaagaaaagaggagatggatattggatagacaagtgtatcagtcagctactgccacagtaatgctgcgtaacaaagcagtctctcttcctggtttcattgatctgcacgccttatgatgaatgagtttcacagcctttccttggacaaaatttgctagttagggaaaggagctccttagataaatgaagcctctgaggtgggagggacacacaggacagggagaccgaaagcaattgcacatgctgtgtggctgaatctagaatatctggtcctcctgacagtacagattccagagctccaccattcccctccctaggctgccactgacttactctgaacagagatcattttcctactgctgagtaggaaacagctgcagtgtaaacagctgcagtgaggagtggggacccatttcctgaaggcagcaagtggggctggtgttcagagctccagtcaccttagctcttagcaccttagttcagagctccagtcaccttaaaaagtgcttccttaggtaaagccccaccccttagtactctctgtgtgaccataggcaagtcacttcccctccgctgtctcgtctttcagatggaagtaaagtctgtcccactgtgtcagcatagaatacagtaaccaacaaccccaaatgttggtggcttaaaacaccagaggtttgctttcttctcatccatattcatgaccactactcatcctagtcagcctgatggagacaggcatcctctcgagcgtgctggcctcagttacctaaggaaagacagagcaggtggatcagccactggcttttaaagcttccactcaaaacaggacacatctgctcacatgccattggccagagcaagtcacatggccacactgcacttcaaagggagcagggaggtgtaatctaccacttgcctgggaagtgggaagcgggattgcactcgctgcccagagggtttttatgaggatcaagaggagaagcaaacaccttcctgaagcacctgctctgtgctcctctccaaggtgggccctggagggagggtggggcagggagcttcattaaaaagaacaggagacatagatggcccctgctctgagggaaggggaatgccatttaattgagctcctaattggctccaggcagcagctttttgtgtatcatcagtgtaaaaacagccttgtgaggtgggaatttaaccttttgatgtacaggaaggaaatcaatggtcagaaatttaaagtcttggctcaagctcacaccactggtcagtggtggagactgagctctccatgttcatgtctgatttttaatatcaaagcactggggagatggagcaggggtcttgtgtgagggtgaatccctggggtctctaccccatagaaaacaggtggggctgccttctgctagggggctcacaccagaggggctaccccaggtcagggagccccgggggtcaccttctcatctggcaatgagacacctgccaggaaaccctcaggtattagcagtggagtgacccctcccagaattcacaccacattcattctcttgggcctgttggctagaactaagagcttaagagagaaacactaatattacgtaccaggtactccacgtccatagttttagttaaccctcccaatatcctgcaagataggcattgtgagtcccatcagacaaatgaggacatggacccagacagtgaagtaactggatcaagcctcccccaactagaaattggagaagtagggattcaaacccagatctgcctgatctcaaatgccttgtccatcataccaggctgcttccccaaagtggagctatgacactggttaaactagaaggacagtgcttattgaaaggaaatttaacagtcagctatgtcacaataatgttgcataacaaaccacctcaaaactcagtggcttaaaacaacaagcattaattctcacattcacaggtttgtgggttgactatggttgggttaatctaggcatggatggtgtgataggcacaacattaagatgtcccctaagattcctggcccttggtgtacacactctatttagttcccacccctttagcatgaacaggatctgtgaatataatggactagtcactaccttcacagggttatgttacctggcaaaggtgatggaatagtcagtcactctcatgattatgttacgttacataagacttcatcacagcagactgcaatgagatcctcctgctggctttgagaagtaagctggctacatggctaggatgttaaggcatcttctaagagctgagagtgacccttgtcgagcagccagcaataaaatggagacctcagtcttacacccactagaaattgaattcttccaaaagcccaaatgagcttgggaacaaattcttccccacacaggccttcagatgagatcatagcccctgccagcccccaatttcaacctggtcagatcctcagcagaatgcctagctcttctgcactcagactttgacttgcagaaactgtgagaaaataaaatgaatgttgagttaatccatagagtttgtggtactttgtgatgcagcaatagaaaacgaatacagccaagcagctttgcttcaggctgcaagtctgacaatatttgttctgggaccccattaagaaggcagcttctaggcaatgattacaactcatgagttcaatggatgtcgtgggggttccagttcaatctgcatttcaagctccttttcttgtgagattcactgatatcccatggccaatgcaagtttcatggccaagctcaaagtcaaggaatggggatgtatattccacccattttaatgcatgaaaagagtataaatgtctaattctgtaatagtgaagaattaggacccattattcaggaaatttaggggaaaatccctctatctgtttctacctcctccacttccatggatacacggctgatcaataagcagttacctccatgctgagtttaaagttcatcaaaccccataccagccctgtcacattggtccacagaagataggcctccaagagagaaatatgggacttaggggaagtccggcgaatgtcagaatatcagtaggagtatcgggatgaagtttgtggggtatcaggagacgctttggacatctgaacaccagcaggagcattcccaggcaaaagggtagaaaagttgacatagaggtggctggtttccctgggaccttgtgctgggtcccacctaattgaccctacagatcccttcctccttttgtgaagccaggcttgaggtaagcactttagctgcccatactataaggataagcatttttttttctgtgtcaggcactttacatacaagatttgactacagtttcaagacagccgactctggatccaagcagcctatgttccagtcctgacaccactactgtataatcttgagcaagtggtctaaacttctctgaagactcagtttcctcatcatctataaaactggcataataatggcaccaacctccaaggtggttgtgaggttaaatgagatcacagaataaagaaatcaacctaactttctttagccctgtgttttgcacatttatttgatcatagggccttttattgtaggaatgcttattaacattacagggagatgcttggagctttctagcagccaacagaaagtgggaaatctgaagagttacacaaccactgatgccaatgagaaaataagaatcttactaagggaaggttcaaagatttctacccttcaaaagggtaggttcaaataatttctctctgggaagagactgtgtgatacaataaataaaaactcaggaaacttgtgaaatgtataaagatgagttgtgagggattgtttctcacaatggtcttcaatataggttgacagcagtgtagcaaatataatcctgctggcaggtgaggagatatgagaacaggatataatctagatactgaattctttgatgtgttcatttgatctagggatcgtttgggagcatctagagaaggagggtaatcccattaagaaaatcatacttaacatgaccttttaagaactagacttttgtttaatggcaaagaactgaaaaatatacactctggaaaatttttagagtgtcagttatatagatatgtaggttttttatagacagcattatcagaatctgacaatctct

SEQ ID NO: 1985 - DNA, 2113 bp, Homo sapiens
gaaagctggtgtggagggagaagcgagtgtggtccggagaaagaaggcgtggagaagagggagggagcgagagcgagagaataaatatataaataaatacgagaacgaaatccactccgcagtctccgggctcggaaactttggccccgagcgccagagcgccagagcgcgagagcgcggcgctcgccactctgaggctggcggcctcgattccggccgcgttcccccggcccccctccgccgcggggcctggtctccgggttctgccaggcgcatcagcccgcacaacttctggccgaggccagccggcagaggcggacttggggttggagtgtttgtttgtttgaacttcctcgtcgtcgccaccttccctccccccaacctccaccccacctcacccccctccccagcttctggacgcgtttgactgcagccaggggtggggggtgggggtagggagtgtgtgtggaggggagggagaagaggttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaagtgtccaccccgcttggccaaggccgggtcaatcagctgggaggggtcttcatcaatgggcgacccctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccagagtggcgactccggatgtagagaaaaagattgaggagtacaagagggaaaacccaggcatgttcagctgggagatccgggacaggctgctgaaggatgggcactgtgaccgaagcactgtgccctcaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacagaggcgcgtgtgcaggtctggttcagtaaccgccgcgcccgttggcgtaagcaggcaggagccaaccagctggcggcgttcaaccaccttctgccaggaggcttcccgcccaccggcatgcccacgctgcccccctaccagctgccggactccacctaccccaccaccaccatctcccaagatgggggcagcactgtgcaccggcctcagcccctgccaccgtccaccatgcaccagggcgggctggctgcagcggctgcagccgccgacaccagctctgcctacggagcccgccacagcttctccagctactctgacagcttcatgaatccggcggcgccctccaaccacatgaacccggtcagcaacggcctgtctcctcaggtgatgagcatcttgggcaaccccagtgcggtgcccccgcagccacaggctgacttctccatctccccgctgcatggcggcctggactcggccacctccatctcagccagctgcagccagcgggccgactccatcaagccaggagacagcctgcccacctcccaggcctactgcccacccacctacagcaccaccggctacagcgtggaccccgtggccggctatcagtacggccagtacggccagactgctgttgattatctggccaaaaatgtgagcctctccacccagcgtcgcatgaagctcggggagcactctgctgtgctgggactcctgcctgtggaaactggccaggcctactag

SEQ ID NO: 1986 - protein, 504 aa, Homo sapiens
MAALPGTVPRMMRPAPGQNYPRTGFPLEVSTPLGQGRVNQLGGVFINGRPLPNHIRHKIVEMAHHGIRPCVISRQLRVSHGCVSKILCRYQETGSIRPGAIGGSKPRVATPDVEKKIEEYKRENPGMFSWEIRDRLLKDGHCDRSTVPSGLVSSISRVLRIKFGKKEEEDEADKKEDDGEKKAKHSIDGILGDKGNRLDEGSDVESEPDLPLKRKQRRSRTTFTAEQLEELEKAFERTHYPDIYTREELAQRTKLTEARVQVWFSNRRARWRKQAGANQLAAFNHLLPGGFPPTGMPTLPPYQLPDSTYPTTTISQDGGSTVHRPQPLPPSTMHQGGLAAAAAAADTSSAYGARHSFSSYSDSFMNPAAPSNHMNPVSNGLSPQVMSILGNPSAVPPQPQADFSISPLHGGLDSATSISASCSQRADSIKPGDSLPTSQAYCPPTYSTTGYSVDPVAGYQYGQYGQTAVDYLAKNVSLSTQRRMKLGEHSAVLGLLPVETGQAY

SEQ ID NO: 1987 - DNA, 134841 bp, Mus musculus
  misc_feature (1)...(134841): n = A,T,C or G
gggaagagcaggggtccaagggccattttctactaaaagaggggtttgaaaccagcctgagataactgatatcctatctcaaaccaaaacaacagaaacaaagaagtcaaacctgtaagtctttattttgaagcctccaggacccagaatgttctgataaagaaaatctgttctgccctgctcttgctgacccaccctctgccaccagaatgttgggctattgtggatgggttcccatattatgcccatttgccctgtggcctggatgcttcagtgagaaaaaagcaatccagaattacgaggggccatgtcactaaccactgagcctccagccacatcctccccacaactttggacctagggaagcaccaagaagactccctgaaaggtcaggaggcaaagcatctctctagtgtgtgaacaaaccctcttggggtttacctgacactcccagtgacctgacagccctcacacagggaacagtattgcttctatgctcccaggaggctgcagatccatctaatgagaattgttctgctagacagttccagtcacagggctccaagaatgggggacagtgactgggtaactgcctgtactggctggttttgtgtcaacttgacacagctagagttatcacagagaatggagcttcagttgaggaaatgcctccatgagatccagctgtaaggcattttctcaattagtgatccagggtgggagggccccttgtgggtggtgccatccctgggctggtagtcttgggttctataagaaagtgggctgagcaagccagaggaagaaagccagtaagaaacatccctccatggcctctgcatcagctcctgcttcctgacctgcttgagttccagccctgacttcctttagtgatgaacagcagtgtgggaagtataagctgaataaaccctttcctccccaacttgcatcttggtcatgatgtttgtgctggaatagaaaccctgactaagacactgcctcgactctagcacagagtaacttttctcaatgtgcttcaaagggagttggggtgaaagaaggactcagcatcctttatttttgctgaaaagcaatttgtctgtggaaagtgcattcagcttcattgtacagcctgctggcctttctggacacatccctgcactagctccggatctctctggtcagcatgccaaacagtagagatgagcagtgcagagtgtccaagcacgcactcactcacaaactacgctctctggctctatcacccttagagctgatttctggaggcaccttagcctcacactacactaagaacaaactagaataatggccaccttgtctgcaactagcgcccagcatgcagtgagattgtcacttctctctgcaggttcagggtgatggaattctttagcctaaaccttggtgataaagcatttctcattcacagcacaagtcgagaaatttctgggcaggcacagaaggtggtaaccatcatgccttgtgtcactaagagctgctaacagggagacattaaagtatcccccttatgagctctggccacagcagctgctgggagcacagtaacacctgggaaggacattttaatatcttgacaaaagtctctgtgtaaacatggcttagattccatggggggagatttctgattgctcagtgtcagtgctcgatatttttctggtcccagagcctagaaatgtggcctgggcagtcagtctgaagacttgagctctacctcagcacccaggggaaaagccaggtgtggtgacatgtctttgaaatcacagcatggggacagtgaaggcaagtgaaaccttcatacctattgtccagccaacctacccaaattggtgaatttcaggttccagtaagagacttgtcaaccaacttgaggttgacctttggcattcgcaggggtgtgtgcacccacactcctatccccacagtatattttgtttctattcaaacaatcataattttatctacttcctccatagcaatattttagggggggaaaaactagacaaccattatgaaaagtctctgctacacaatgttcatttatccaggctcctcgtggttcggatcagggttgcttcaactctttctacttgagactgtctataaaatagtatacaatccaaacatttgctaataataaatcataaagaaattttcttgaaaacaattctccatctatcatctataattttactacttattaaaggcaaagagaaaagtttcatgctaatgagattaatgtgttaacgactagatgttggcagaatatttgatactttaggaccctgagcatcttcagagtttgtcagagttcatcaatattttgattttataatcgtcagtgctacaaacgctgcttcatataaatacatagtattgaatggaataagtacgtttagagacatttcagaatttgttggaaattcagtcctaaccccaagccaaaactcatttaacaaatttttaactgaaactcaagtcagcgtctcaaacaccggtttttaaaatcaacattctaatgcagtccagagatcacaacaatttgatacgtgctgggagagatggcagaaaaatattaaaagtctttattccctgtgattaagccatcgtgtgtctactgagtcagaaaactagattccagaaaatgtacctcagtttgtagcacacagaagtcttgagcccgagcctaggtgttccagtgtttggttgctgtcgactggcatgacatcgtgcacagtacacatgcatgtgctttgtgtccagaaccaaagctgtagtgaagactcatggcgtaacatggccaagcacagccagaaacacctcagattcattacacatttgactctgaatttttgctcattgtgcattttgaaagcttttattgtagccagccaactttttgatgatctctacattcatcctctgtcattcctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaaggaggacacggggtgtttggagggtgtaaatgggactcaacggacagtgacgggggctgagctaggcttgcttatagagctagctgtgcaacacttgtgggtctcgagtcttctctgatctttccttcccttagagagcacagccaagaacttctcctagtgttccacctgatccctcctgctgacttgtgcagaggctgaggcctggctgtctctgctaggttgtgccacggttactgattcctgtttgctatcctgactctacgaaactagactgctggtgtatccatgaagtgtttgctagtggatcaagctgctgctgctgacttgtgaactgaactgccgatttccagacaacacagacaggagttactccaaagaacctttgtaaacaggtcccacttctcccatagcctttcttccccactacctctggttggtggtgggctacaagggatgttaaagcatttaagaaccatcattaaaagtaggatttgaaaaaaattacagtgtggggcttccaaacttttacacttagtccatacttgtttattggcctggaggccaattgtggggtccttggctggcattcttgccttgaacactgtgtaaatgcattttcttgctgccttacttttttgcatttctcttaggaagtgtgatcctgcctgctgcatctttatgtcttccttgcctttgaattataacagtgtgtgtgtgtgtgtgtgtgtggtgtgatatgtgtatgtgtaagtgtgtgtgtcatggcatgcatgtgaagattaggggattatttcctgtgtgggctcacactttccaccctgctggagatttggtttctttgttgctagctggcctgcaaccttctgggaattctcctatctccatctcccgcctcatgagaggaacagctgtgagtccagtcatgcactgccttgtcagacttcctggggatctgaactcagctctttacactggcatagcaaacatgttagctactgaggcactgaggccttcggctggtttaagtaagaggtatctaatacaagcgctaaggtatgtcttggctattccacaccattttccccaaggtgcatgggattcacctttgatgtgtagtgttgaaatttcctttactcctggagtactttgcagatgaaaattgttgaaagatgcctactaaactggaaagtactttcagagggtgatgatgttgggctcaaatccggagtcttgctcatggtaggtaagaacttagccctgagttacatcccagcagaggtgaacgttttggggtgtgtgtgcggaggatgatagtgttattttgagacaaggtttctttctctgtgtagccctggctgtcctggaactctctcaatagaccaggttggccttgaatctagagattacctgcctctgcctcctgcttgttgacattaaaggtgtgtgccaccaccagctcagatcttaacatcttaatatcaaactttgttttacttttaaagtttccttctcagggattccaattcaatggacttggctcctcttccctggctctcaacaacttatatctgaagcttttaacttattttttctcatctccaatctcctccctccctccttcctgacctttttcttttctccccatccttccctttttgtatgtgatgtgtgtatagtgtgcacatgtgtatatgcatgtttgattgtgcatgtattcatacgtgcacacaaaggccagagcttacatgttcctgttgggtggggacatgtcatacatgcatacatgtgtgtgtgtggaggccagaggttgacctgtggtgtggcctttgacagnnnnnnnnnnnnnnnnnnnncccctccccctcttcttcttcttcttcttcttcttcttcttcttcttcttcttcttcttcttcttcttcttcttcttcttcttcttccccttcttcttcctcttcttcttcctcctcctcctccttgttcttctgtctctatctctgtctctgtctctgtctttttctgtctctctctctctctgtttctgtctctctctgtctctctgtctctctgtttctgtctctctgtctctgtctctctctgtctctctgtctctcatttagcaatcttcctggctcaacctcccgaatgctgagattacaggtgacacaaccaccatcagtcaatgtgtgcatgtgtgtgcgtgcctgtgtgtgtgcatgtgtgtgtgtgttggggagcataatcagatgaaatgttaggattcctcttccacactcagcaatatgactaactttctgttttgcttttataatagcagttttgctgtcctttgacttctcagataggaagcatttgggggcagggctccgggtggggactttctcttctgtcctctgcagttttcaacagctactgatgctgtgctaggggaggggccgcttgctcatctctttcctgttctttggggtttgtcctgcttcctcttcattcccttcactcccaggcctctgaggggcaacggttgttcccacttatctgactttccccaagactcttgggtgttttcaagcctgtcatctcttcagtattttacaaatcttttccctggtcagtacagtgctcggattctagtacttggaatggaacttcttacggtgtgagaaacctgtcttttgtgaagggtgtttgcagaatggggtgcctggtggaatggggtgcctggtggaatgggatgtcttcaggaatggggtgtcttcaggaatggggtgtctggtggaactaagaggctttcccttctcacttctgagaagtctgaagttcaggtgaggctcagaatcctggtagcccaaggctttcggtgctctttgttcaggattgggcagactgctgcccagggagttccttcctcctgcagtgtgggcagatctcagaaatatttgcaggctctcaagtactggaaattcttttccagacacagggacttagagagtcacaaggtcatgggcaaggttacagtcaccagagctgctgtcagggaactcgctgctgcctgctctattaagtgggttactatgctcacctcattccttcaagaaagcaaccagtaaaaaaccgaaaagatttaaaaacataaattaccatctatctcccctctttttcacgtttatttaaaaccaccaccattccattttgcttttaagagcaggaagggtcatccttacaagcaagcgccttgaaatctaccttccctgtcttagtcttgttcagaccacagggcagtgcattccagttatcccaggactcagaagtctgatgcaaaaggagtgctgcgagattgaggccagcatgggctggatggtgagttcgaggtcagtctggattgtaggatgagaccttgtattaaaaaagagaaagcacaaataaaaaataaaaacccaagaacccactattgcccaaatagtgaatgtgacggatggcgggccggggcgacctctgcagactggcccattccaagtctttggggaaccgcgcgtccgcgcccgnnnnnnnnnnnnnnnnnnnnccagagcgaggatgcggcggcgctcgcggatgctgctgtgcttcgcgctgctactgggtgctgggcatcgcctactacatgtactcggggggcggctcccgcgctggccgcgggcgggggcggcgccggcaggaaggtgagtgccgcgaggcctgtgcgccgacccgggcctgcagcggggaggcgccgtgcaccgagagtgctccccggctcggggcagcagatgtggggaccctggccgggacgcgcgcctcaagttttctccgggccctcaggccagcggcgcgagctccggccctgtccggctcacccgcggctctgggtgcagcgacttgcctcccgcatgcggggcgcgggcacccggagccacgtaccgccctgcgcccggatcttggaggctgttatctcgctggcgacactgcgctccactccctgtgccgggatcatagggacaacccttccgccggactccctgccccctgctccgtactccgcccagatcaccccggagccccactccctgctccgggatcttggggatcattgtcacccgaaacccggtgctccccgagccacattccgcccaactggaacccgcgaccctctcgtcttgcgcccagatcttggggaccttggtcgggctggaaccctggtgctccagtgatcagaggcgtgatccctccctatcctccccatccagcacccaggcagtgaggtcgtaccgtggttctgtcagacctcccgttctacttgctacactgcccacctcggcccttggccgctcacggcggcgggaactacctagccttttgcgcttgcatttcctaaccccaagtccctcctcggtgtgtgtctctggtgggttcggtagtgaagccggggggcttagagcttacaggttctgattcggcagtcatctcggcttggataccgagtggacaccgagcgagcgtgggatccttgccttggttggtgctgtctaggctgttgtattctctcctgaggggtttgtggtgttttactagctaacgagcttcgaaatatagttatcttttccaaagatttgtagccctccttacttgattttgagtaacagtacacgaccagaaaagaatggaggtagatcgcggcttagggagatagggggtagagtcttgagtaggatggactgcccatgagcagccgccgactttacccctactcagacactgaatgtcaaaggcacatggctgattccctttttctctggcatcttcaagttattcctagctgcaggtacggagggaggaaggtggaagtgtcgttttgactctgggaggggttcatgattcgttttttattttcagtagcgaacatggaaacagtgtttccctgtgcctggcttgtgtggggtggacactgactttcattagccctgctttctgaatggttggtgtgccgggagcccctgcttgctaggttttaagtctagcaagcgtggctggtggcagcagccaggtttttgagaaccatggtgactctgagcaagtgtggtgtgtacggactttgcttccccaggagacttccctcgccttgggaatagcctggctgctgacaatgctttttcctagtcacacaaagatgaagtcctggatcagcacaggtatgtatgtagaaaggcacctgtggcatcagcctcccagggatgtcacctcacctctgggggtgtctgttggcaagcagttggcttgtctcctcattaaagttctctggatgcctaagaggtattagctttaggtgtgaagaaagcccaagacctctttgtgatccgatggagaccctatagaaagagcagatcaatgacctggggttctgttgtcagtgagccataaaatgttgtcctggctcagggtatcatggtttagtgatctgcagggcaagggagtgctgtgaaaactgcagatttggggctggtgagatggctcagcaggtaagagcaccgactgctcttccgaaggtcctgagttcaaatcccagcaatcaaatcccacaaccatctgtaacaagactggatgccctcttctggtgtgtctgaagatagctacagtgtacttacatatagtaaataaataaatcttaaagaaaaaaaaagaaaactgcagattttgaaatttcagtagtgctcccattgaggtagcaaggtggatcctgagagagagagacagaggatgccgccaaactgtggagtgccatcatggatcccttagtgggtttaaacactagacggctctccacatttagctcatccccttgataagagaaaatgtgcgattcctttagcgtgtacaacatgactgtgaggataagaagagcagctttactgagagcctgtagattttttttttagcgataagtagatggcatttcttctgtgtttggtgctgatcacagcgggctcttgttccatctttagatagttcttcatgctctgctgtttcatccccaaggggccccaggcttcagggttgtgctttggggattgtctgagggcatcctgttaggatttctgctgcttcagcagccaggccaggctgtgcactgtgtgccctgcctgctaaacaacaagtctgagaactgctgttctccatttagcaaaacccaggaagtcagctcacctcagactacagactgaataaactaaggagctgaaaaccagctgtcagcatttgctggaaagcccggactcgatgttgtgattccgcagggcagaggctccacgttaaagcaatttatgcataatgtttaaaattgcatttcatttgtataggtatctccccctgccatatttactcttgcctccctagatgatgatgtgcacttcaagaatgcctttcctttgagcatcttaaatgctttaaaattttaatcacgttaagtttccctggggccctggtatgctggcagtggatggcgctgcataggagggaagggatttctgttgaaaggaagctgcctctggctgaagcgaagccacaggaagggttcccagtctgagagcagtgagctcagccgagagactgagggccccttcatggactgcctaagagtttgaggtactgctcttcctgggagctggcacctctgctgcactcactctgggcctcaggtgcaggtgtttggcagttaggcaggaagcattggggaggggcttctcttggaactacagagaaaccttttgtgggggacactcattgggagaacagtaggttctaaaagcagagaagggactcgggcctatgctgtcctgtagagggcttcccatggcaagctgactggctcacttgttcatatggctgatttggaggggaccaccttgagtagaaagttaggcgtacaagtggacggtgatagcacggcggccccagtggtgccggggacatctcactttcttttgctcagtgacccttcctcagtcgctgctcatctctgtctctctgctctctcatcaacgttgggagagtagcatccttataccatggctttgcttatcctttttagtttattcttaggattatatgctattagtaagtgatcaataactgatacagaaagaaggaaagaaagaaacgagagaaaaaaatcccctaaccccagaaaatggagtgagctagaatcctgtgaggcctttgtttctggcaaactgtacaccctggcgtcgtctttgtgtacttcctgacggacaggtctgcaaggttccttcagatttgcactgaaccttgggctctgttaataaagtcatttgtggggaaacctaagggacaccagctgtggacccagctgtagtgacataatggggttcccagtagctgaagtgggtgaggcgtgcaccctgacttgggggaaagtccatgatggttagagtcctggagctgctccgagtgttggcaggatgggctccaagctccccacccttccctgatccccggttaggaggagtagctgggtttatctaaggctgaccagaggctgccacaccactgtcctatgttggcagggtaccaatgataggcgtgcaatttaaagaaaggccatttgcactaagtatgacatagatctgccatcctggtacttagggatggaagcaggaggatcaggagttcaaggtcacggtttcttacatatcaccttcaagcctaggctgggctgggctgtatgagaccctgttctaaaacaatggtgcggggtgtggtggggatgggaaagcccagcgtagcctcatccacacctctaagagaagcctccgtaagggaaataaagctccagaattctgttgtggctgcccagggcagtgcaatcacattagacacagattgtgacccacaaacactagaaagatggcaagttatgccctggaccctccagcaaaggtgaaaatgaacctgtgtaccagtagctacggccatcattctgctcggcttgccaggcgagctgcggtggggtgagagtgccgaggacctgcggggacagggacagtttttctgaggcttttggtctgatggaagaaagggtgtgtggggtggggtgggggtcgggggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcaggttcaggtaaatgcacagggggagacttgggccttgacacagcctgctccctgaggctttgtccttcttgtccttgtctccctctgcagcctgtttgagagattggcttgatggtgacactgagatttgctggtgagaggagagtcatgtatgtagccgggccagacagtctggtggccactgttttttttttttaagatttatttatttatttcgagtacaccattgtcctctttagacacaccagaagagggcaccagatcccattacagatggttgtgagccaccatgtagttgctgggaattgaactcaggacctctggaagagtagtcagtgctcttaacccctgagccatctctctagcccaagccactgtcttaattaagcacctagagccccattaccccacgggctctagttgcttgtttcttcctgcccacctgcccctgtatttttgagaaagtcagtctccctcttgtctccctttccacatagagcagctaagggtgaactctgtcacccactagggttcctgtgcccacttccctgtcgtaacaggtactgagtgttggaatgctcacctcttgttggtgacttgaggtctggccttgccttgagcagaggtgcttgtctacccacatggtctcagctccttcctgccgaggtctcttttgatgcaagacctcagtagtgcttcccacaaaggctgcccaaggagcttgagaacaggccgggccaggcgggcagcttgcctccctggatgattactgtactctgatgtaccagagacgctcaccacagcagaacttgaccttgctctctctgggtcggaagacttcctgacctttggcctgagcattgtattcgggaccaactccagcctcagaggttctcctgggagtatataccttagtctagaaggcctttctgtctcacttcccagagactatgggcccatttggagtggaataagaggatgggggaatcaggcttcaacaccagtcagctcacctgctgagactgatttttttaggctcccatcctggagtgggtttgtgcctgggtctgccagtaccctcctgacatggcttggtctgtaaagctggcttgtccatacttagtcttctccggtacgtgggcctaggaagcatgtgtcatgttgcacagattggatttcgtgtcagcaggctgacatgtagacagtcgtgattcacaggggctgggtatgtaggaaagcagaccctcttatctgaactctcatttctggagccatagtttgggctttcctaggagccatatgtcatcccgaggctggtgtgacaaaacttcagtggacggtggctgtcactggccaagctaaacctgtcgcccatggcccagcctatccttgcaggctgtcatcctggtgaatgcccctttttcctagaagcgccctgtgaagtaagtagtctcctccaggccaccttgctgcctgcctccttcaaggtgtgcagctcctgtctctcccaaagaagaggaatgccgggaaatgggtggatcagggccataggattgtagtgtgtatcttagcagtggccagtggttgggggtttcagcttcttggggtccaccccctccactgtgggaggctcacagcattgccaacctctgcacactgggtgcagcaccctcgtgggttataccagatgctaccatggcatggagcagaactgacctacatgctgaggagggtactagtaactgttttgctgcttcttgctgcaactttgtggctgggctgtctcagaaggaaagagccaatcggtgaggtctgtggtctatggtctatggccccctttaggagtacatacatgattactaagttttaaaatctaatagatacctgcttagcacccactgcatgccatgtgtgtccttaaagcgactgaagaaaatgaagggtaggaaaggcaagagggtctgcgagggttacagagcttgtgggtagacaatcgcttgggctgtgctggcacctgcctcctgaggtcttccagttgtcaggatgggggtgtgactccccgagattcctagaccccttccttggttgacagtgtcctttcccttactgtggtggtgacttagggaggcaccctgtgccctgtatgcttaggagtgtctaatggcagctgcaggctgcttgccttatctcagatttcttcccgtttagcgtcagatttaccctcttaccctcaggttttagcctgacctgcagcagctatccttgatgctccactggctaaagtggggtgataccaggttctattcctgtcattctcttcccaagtgtctttcgagactccccgtgtgcagagcgtagctgtgtctggaatcttcctgggagcccagcccactgcactgtggttggtggggtatggggcggacagcagacagaacagcatgaagggcagcatgggaaacgggtacaggtcttggccagcatgagtccagccaagttgtgaagccctaggcgctgtcttcctttgctcctgaggccccctggttcctcagtgctcaggccctctgtcacatcatcttctgctcactagatagagtgaaccagtgtgaaccagtgttcccaggggtcactgccttaactttgccagcagagtgcatcttctttcacggggatgccccgtttttctcttccgttcacttagttaccacatgcacctggttagaatgccaaatcacccaccacacgccagccccttcccctcctgtggtcctcagtttccagagatacctgtagttctgtgtgtgatagacttgctcactaggctgtgttgtgggatagactctggatacctgagctaatctgtgaggtgtagcagggcagcagcgttgcagttcttggtttaggttctttgaaaggacattgtgtatttacagagtttgtcccgccgttcagagctcagggagtcagtcatccttgggtcttgaggccctgctgcagtcagtggtctgttactgctccatccccagagcagctggaggtgcaggccagagcctgctggtgtcctgctttggagcgctggcacttggtagtgaaggccatgtctggaacctagcatctgaggtgtttgtagagagcaagatgaagctgtgacttcactgcctggagttgctaagggactcctgtagagtccccaggggagacaggtatctttgggggagggggtggttacatgcaggctttcgggtacttgtggaggaagcagctagagtggctaccggtcagcccaggacaggctcaggagtgctgcagtggcttctgatatcttcctggaaggctcgcccaggtgtgaccttgacgccttgttttggaaaatcagtgggccccagatgaaaggtctttcatagctaaatcacctgggatgggaacccgaggaaccctaggcaaattaaagactcggactggaagctgcctataaattaagcactccataggcgtggggttagtctggtgcttacagtgggaattgtagctgctgtcctgcagagtggtgtggcccagcatgggctgccttgctgcctggctgtcctgttctgactgccttgggctttcctgttgacccacttgctgaacctttgcttccaatggtcaccttcccctccatcctctcccaccctgcctgggctgtccgccttcccagctcactcctgctcaccaggacattggtttttctatgtatcactcttgcacacagacacaaaggagatcatgagtgaatatctggggggcaggtatcccgaaactttttctgagtcccttcactttctgcttttctcagttgtccactgtgtcaccaggatcattgatgacagcatttcccaagggagaggggaccataaaagtgctaaggggcattggctctgcctcaaagcaacctggcagttgtataattagccacccctgactctactcgtcttccctgaatcctgctgaattctccattccgccgtctgcttccgtctcatcctgatacgatttctagggatcactgtttttggattttcttttaagctcttgacatatgtccagcggattgagatgccgagcctgtggtgatgctttggggccctagcctggcttatagagacttggggggtttgggggagacctactccagtttctcatgatcaaccataagcgaggatcagctctgaatggaccaatcagggcgtcagggctctgctccttgtcatctatgagagcccagtttccccctgggcctctctctctctctgacagacgaggctggcctctgtctgccccgttcccagactcctgataaagagcctggtactttttatttcagagagcagctgagagtatgcacccattcagaaaacatgctggtgtgtccaccacggaagaggtccccttgggtgccaggttgcagaagggcaatcgtgtcttacactgagatttcagttaaaaggtagctagtgtattttgtggcgtcccttcggtgggtgagaaacacttagtgaggttttatctgcggtgctttgaagtcctagaagatcctgacaggaaagcactcaccgtttgtgctgattgatttctgcctttgataccctgctaggagcacttggtggctgagtgtgaatcaaggtaggcatgggtcactgtcacctaagctgctgtcagcagctcacagccctttacctaacaagactgctgtggccattcaatggcggtttcttgattgccctgtctgtctgcgtcagcaccctgccttatcatgggcaggaagatgaagtggaagaccattaataaatgtatattactcccctttgttcctccaacaggatgtgattgcaaaactcccgcatattacttcgtatttgtatctggcagttttggcaaggacacgatactgcatatttcctgtaaggtgtaattcctggtgacttcaatttatatcagccttgacactgtaattcctgaaaggctccgagccccgccatctgtcttgcttctctgtaggctgggaagtttttcctttgtacgcactaccagactgtcccccaggtcacacagtagcaaactcaggctgttttaaggtctcagcagctgcctatgacaagggcctgggaaatccagcactgggcagcccgttttcagtctgccccggacgcccaggcacagattccaggtcttcctcttgtacccagccacagcttcaggccaggagggtgctgattacagggctgttgcctgcttatcctccatcaaacctgctgatgtagatgagcagagagctcaagaaggcgggtgtctgggcttctgggtggtctgaggcccaagcctggcattgtgaaagggtggtgactgcagcttaccagccttacctgagctggtaaagagctggggtggctcattcctgacagagggacaccaagaacacatagcagtagcatcatgctgtgaacaaattgatgccccaccccttttttaaaaagatttatttgtaagtacactatagctgtcttcagacaccccagaagagggcatcagatctcattatagatggttgtgagccaccatgtggttgctgggatttgaattcaggaccttcagaagaacagtcagtgctcttaactgctgagccatctcgccagccccgatgtcctttgttttagaaagggatggactatttacccttcctggcctgggctgtcatcatatcagtaatgtttgactttagcatttttctcctcaatgggacatgggtggcacatactgtcgtttgcctgttctggcctcccaagctgcctgggtccaggagcaggtccagtgtggagcctgagagcaatccagtggtttgcaaacagtagcttctttgccacctggccaccgagtcatggagatcgtaatactaagggttgcacagaaactctgaaggccactttgcaggggttggagacaacctagatactgcactgaagctggccctgggtccctctgtaggactggtatgacgtggcaaagaggatatagcaaagtattgggcttgggcctaagccagagtgcctgcgtatgaattcttgcttcctgggtggctctgtgacctcagggaagtcacttagtctttgtgtggttttgtcttttgcctgtctcagcagtttccagtgtgcagcgtgttagtatgtataaactgtttggattggtcctgctgtgcacacagcagatgctcggtagtatgaggcattgtgaaggctgttgttagtgttaagtgttaaagatgggtgccaagtaatggcgtatggtaaagggagcccctgtcccatggggatgctgtctcttacagtgggttgcttgggaagagctgagatgacagggcctggcacccttgttccttcctcacctgaggatgtcaggctaggtggtgtcccactgttgagagccagtgcacagacctgagccttcacttctagtgctgggtttctcaaaagttctttcccaattccaccctttcatcccttgtaacttgactttgaaaatttgtatcaggatgcgtgttttaactgtgtaactatgtaattaaattttaaaactcattgttaattggttatttcgacatcttgagttgttactatctgaaactttcccacaaggttctgataggtaaacagtcttttggtttcatcagtgcagcatctccttgcctttgaggctgtgggtgacggcacaggcaagatggacaaatagctgtggtagcacagcacagcagccgcagggctgaggcctggccatgccaattggctcagcatttacacatttactctcagattgcagattaacaaacttcacttcataatgattgcagcaacgagtaatctaaagtctggacgttggtgaggatgctgggcctgaggaaggccatcacccagcccttcgttaccctggagtgactctgggtccctgtctgtttggttcacagtgaagagggccatggtgggtcagtgagagatgaaggtggggcccaagggtgcagtgaggcttcctggctgcctctacctgctcatgtgctctgaagggctttctgggagcagccacagctgaacgggctggcgaatggggaagaacagtggctgtctccattttcctggaccaactcccttctttgggccacctggggttgtcttggatctaggaaggtccctgttgttacggagacactgtggatctgtgaggctgtgttttgagttggacctattttaaggtgtttcaaagtatagtgtcccaggacaatggcagttgaaggcctcaaagactaacaggtggctttggtgagcggactgtgtggccactgaacagggtttggtttgctttgcctttctggccccagaggtgtccaggctgctggaactctcccaccttgaggtcctccagtggtatatgctcacaccttggtggtccactcttgagattatctgatatacaccctaaatgtctctaggtggtgccctccactcagtcccctgcttctagcctcccatcccccacccccaggtccttaatgcattagcccatccctgagagcccagtgtaggactgcccttccagcctagccattctaacctgagtgtctgtggtcacctgcgcagggcctgttgacctttcttcgtggaaggagttttggataatgatcttcatctgagactccagtcactcctcctgacacctcccagctagctctatgtcctcctgccccatctgcatgtggtcttgtagtcttgggaggtgacagactgtatcgaatgtgaaaagtaactgaagcggaaatttgagggttctttggaaagtcagttgggtcagatggtgttttgctgaggcaaacacgtgaaggaacgttttgttaaagtggacacaggtgtgaaaggctaagcagactcttgaaggaacaattttgctgaagcagacacaggagagaggatgttctgctaaagcaagcatgtgatagcacatgtgatgaaggagtctttgctaacgacacacatgcattggtctgccttacattgtgcagttgagctgcctttgtcaggactccatagagagaaacataccaaaaaccttctgatggtgtgctgtagtttcttgccgcttccccggacaggctgattggatgcacatgctgagacaaggcacatggaggacacgtgatgtttggagggtataaataggactccatggagtgacagagacttggcttgtgagtccttgcttccctgggagtgtcacagctgagaccttttcctggtgttcctgttggtcccttctgccgactagagccgaggctgaggcctggctgtctctgctaggtcatgtcaccgctgttgttaacccaactctaccaaacttgactgctggtgtatctgagatgtttgccagtggatcacagtgagctgcctgctgacctgtgaactgaactgctgatttccagacaacacagacgggagttgctccaaagtacctttcttctacgctacttctggtgggtaatgggttacaaggaaggttaaagtgtttaagaaccatcattaaaaataggatttgaaaaaattaaagttatgggtaactgagtgttaactccttccgtggctataggtaagttggcatccacgctaaggtgaatcttcttggtggtgctgctgatttggggtcacccatgctctgtaattcagcctgacacactcattggatccgctttggtctggttatttttagtcttttgttggtgccctgtccaggggtatacatgtttgtttccatctctccaaggaagttcatgtgacacttgagtgtctctcttcccccaagaggcttcttttgtcccctctcagcgttgagctgcaggagtctggcttctatgctctgtcttactccaggaagagagtgtgacagctgtctgtcaagagggaggctttgcacaagaagaatagctgacagagtctggaaagttggccatgggcgggaaggccataggcgggaaggcatatagtaaaagaccacttagcagctgggccagtggagaaggggagtgggcggtctgcagcctctggtgcttgcagtgtgtcaagacttcttaggatttagaacccaactatctccgaagcattggtaggtccttcagaagctgccttatgctgaggtcgggggaggtgtgtaacagcattgagtgttctcagcatcttaactcagtgtatctgctgtagctttgtggcccagtgtggtagatatccccgtggcctgttagctttcttgggtggttgagagctcagccctacagccctactgtctgccttctccagcctgcaagaaagggcactgccagctcacagatggtatgcacatgtttttgggtgagctgtcccttccttcccaggacccgacatacgggttctaagtcttttcaccctcttatactagaatctgctgtatgaagtggtcctcagtggtggccaagggagggagtcagccttgtttctgaggtgaacttgattttctctccaggtgcagtgggcacaagggttagacgagacctgagttctcttgaagccctcactggggttgcaccagcgtgcctcagctgtgtttgcagtaagccgttagatcctggtgcatctgtaggtggagttcaatctatccctgagaggtggcacaagcatgcggagctggtcagggagcattcgttgtaagatacagggtcagaatcagggttttgttcatttctctcaggacaacccttccctctgagcctttgagttctcagtgtcctagctgatggtatgaaaccattgctacaatattattacattggtaaggctttcagacaggactgagatggatgtgagtccacacacagattcacccctcagtcagaacccctgagggactgggctcttgctgcagagggacagcaccagcagctgatttgacgctgagtcaaagccatcaaggaatgcgtacgttcctggtctcagctacttccttgaggtgtaagatgcacatcatggagactcatggctcaagagctgttgaaagactcactggttatcacgtggcaagcacttacatatgccaaggacaacccagtgttttgtgacaagacttttcctggagagatacaacacacacatctacttgccctacatggggagcccacaacagaccaaagtatggaatctactggagtccaacttggtggaccagtgggttttactggggttgcttacagggatatgggtgaggggtcacttactcctgtaagcatgatgactcaaagtcagcgcatcatcaaagtccaacccagcatgggtgacagctcacaaaagctcaggacctgcaggcagcctggtacgtgttgaagaatgtcctttcccggtgcctcggttggtctacacctcttccatgcatcttggctgggttctgcttctttcattgctgtcagttgtggagcagcttggaggcttttctgaggctccatctttcggggtggggtcctccgatcggggtcttgtacaacactctgtgctgttacgatggcgtctggtcttatgatttggaagatttccttgactggcttctagaatcagagttgcttcttctcccaggagtcttggtgaacttgctttcttccctggagtactgatacctcttcctcagagccattttcagccgcaacccctctgcccctgctgtgacacgaagttagggctgcaccaagctctgtcccagcacactgccagcctccactggaaggtgacatgagagggatcggtgagagggaggtgacagcttgctccatttggctcctgttgcccctgtagtcttcgtggcactaacagacttttggcttctcacctttggagatgccagccccaggaaaagagcctctcgccctgtgttctctgtccccatggactccaacctccagtgtcccagccctgtgggtacagaggctcagtctaacctccccgtcacccacatatgtaagagtcacctgaccaccagtgttagctaggtgggtgtttatacggaaaccgctctattggagaaataactgtagatcgggttagattctggctgatttgtagcctactttccaacactgtaatgggcatagatgggttccacttatttagagtgtggttcacgctcatgggagttgcacttgctcctcctgaccagactcggagatgctctcctctgtccagccacgttcctaagcctcagggaaactgggtatctgagggatcgagttaaaccacagggctcagccatccaggttgctcatgtatatataaaggcactggacgaaagcagagcagcgcagaaagggctgactgagtttacaggtcacagcccatcatcacgggaagctgaagcaggaactgaatgaagtgtaaccacagaagaatagctgcttactggcttgcttcccatagctcacttggcttgcttctaatacaacccaggactgcctgtccaaagatggccccacccacagtgggctgggcccccacatcaatcaagaaattaggcaaatctgatggaggcagttcttcagttgagggcctctcttcctagatgactctagtttgtatcaagttgacaagaagcgacaacgcataaccagcacagtgcacaaggcctgtgttcaggcaccacctgagtttaattcccagaagccacggtgaagaagaccagctcgtgaaagtcgttctctggtgtccatgtgggtgcgcattcacactcacacacatcatcgttcaggtgtgcaatcctaatacaattagaacttcatgtacagattcaaaaaccaaacaggaacagtacgacccatgggactcggggcatggtgcgagtagaggatgcagaactggtcaaggatccagacctcctgcagcccctgggctggtcttggcgctgcttctcatctgtgttaagtgttcggcaccgtctagcatgatagatgctgtccccaggtcagcagtgatctaggggactccaggacccacctgggtttggcatatcagccaacagtgtcagagcagccctttcagttaagcacacttgtatatggggtagccaaaacaagaaaagcagtaattcacattttctccaagaacaaggtagctccatttgaagagttgttgttttgtttttgttttttgttttttgtttttttccctcaagatagtttctctgtgctgctctggctgtcctggagcttgctctgttgtaaaccatgctggtcttgaactcacagagatccacctgcctctatctcccgagtgctggtatctaaaggcgtgtaccgccactgcctggcttgaagaggtttttgggagcctttcaacttggtaagactcctgtggtgctgagttcaagggtctgactggtgctggttactgttcaagcaggtgatacggagtgaaggtgtgcttatacacctgtccatttaaggaagtgcctgcatctgacgtgtggctctgccccaggccaaggcgagccttactgctgcttggctcaagggagctttggtgagcaccacagatcaccgtggaccagtcagaggcttgcaggcctcataactctaaaccttaggctcattaattattaacttggggcagcagtgtcttgttggcttgtatgtaacccattgcctgctcaaggtgccaggactgccagagaacggcttttaggctctctcttcacaggtgggaagtagattctgggtcatgattcctcctgtgtgctcatagctcttcacaaggtggttagggccaagtgataccatgaaggtaaagctgggcacattttagagatacgcagaactcatggtcacctggctgcctctgccactccagactgactcttccacttgagtgtgctgtcaacacattgttctcagggtctccagtcgggtagttgggcagtgttgtcaggcagtgagttagccaatggagccgagagctgcccctgaatgtgggcaggggccagcaggttccaggaggtaatgctcatggcatgaggggtcagatagagaccaaacaaacacccgtaatgcaagcattcagaaggcagatgcaggtggatctctgtgagtttcaggccaacatggccatctcaactctgccccttgcaaaaaaaaaaaaaaagccaaactctctcactaaccaaaccctgggaggctttcttgctgaccctgtctcctccaatagaaaaagctgccagcggggactgagggatctctgtggcattgcctagggcacaggtgatgcagatcctgcccgctctgctgctcagtgtgaattctgagatggctgagtcttatatcccaggcaagtgtgaggagttctggcctcagagggtggtgaccttcggttctgtgttgtggatggtctgcagcatcaggagtggcacattctgcctccttgatcccagggctccttctgtgggtggaagttacccaggccccatggacttggtctgcctggtgtctcaatgaatgtctggctgccctgtgtcactagctgggaatccagctgccatgcttaggcattctgccattgtaatggtggaggggagccctgtggagggccaggaaggttgaggccttgtgtagaagaggggttcagctccaggaccagacgtctcccaggtagaattccagcccacccactgcccgaggatctgagatggagagctttgttcagtccagtctgtctgtggagtgtgtgtgggaatggcagcttgaactcctcctgcctgccgggatgagcaccagtgtccatatggatatggtacggaaaagcccatcagagtggggtcttatgtggctggacgtggcaggggtgaatgggggctttcaccagcctggtggtgcctggatgcttttggtttaagatagcaccccagttagctgtgtgagctttcccattctagcacctaccacattagctgagagagagttttctctcttctaagaaggttctaattactgagctgaaatattaacacacgcttatctgtggtgattaggactaaggaagcctggccgagaagcttagtcatctgcttaagtggccaggagtgtgttagtgcacagtttatcagggaccccagggcagggtagctagaggagtgccggcagcctcctttctcctcctccacctcctgctcctccccttccctcttccttcttcctctccctttctcccttccttctcatcaacccctcttcctcccctgcccctttctcctctctacccctcttctctttctcctccctcctgttcccacccccccccccagctttgccatgcgcttaacccacctttctttcctcctactcctttgttctttcctgggcttctctctttcccctccttcttccctttctgtctcttcaccaggaccactctcccctccactgatgatctctgctcagaggcagctatgcagtgggtcactctgagcaatcctggtggctgaacctagaagtcacgtttctctctgggtttgatccacatggagcctcctgtgcagccttcttcaagaaaggctgcctcagacagctaaggagtgtgtcccacagtgagtggtcccatctggcatctggtggttgttaagacacaaaccaaaggctcctcccactgtaacatttgttgtgaggatttcaaaaccacaccaagtgctctcgaggtcatggagaagtcagagagtggcaaagagggaaaggcctcgttggacattgcataattctaggccagggtcataaatggtttaagtaataatatactccaaatggttattagtgtttgctatgctggaaatcatggttgttatatgtatgaagcaaatgctacgccacatacaaaataagtaactaaaataaatacaggcaaagtaaataaactaaagtgtaacacacacacacacacacacatacacaaaagattcatggatggttaggtaggcctttagttaggctctgtttttcagaaagatagtaacaatatcttgtatttgtctattcagctaactagggttgtttctttttggctgttataagttacactgtttcttatagtttcacactcaggtgaaacattctgtgtcctttctatattaggggatttatttaaagtgtctttattttagagaactaaggcagcacgtaccaatgcacattatattagtaacacaagatgggttggtgatgcagggcaaagtatatagtaaatcttcagcttgccttctgcaaaatagttaatgtaactatgtatctgggtttcagagattccaatgagttactgtgtgtgagtatgtttataggggacatatatggctaggtggccctatggtgatcaattgactaattataaatattaacactagataatacgtcctgatttgaatgtgtgcaagtgtgttctgtaaatatttacagtagaagtttggtcatgatttaattcaagactcttcaggaactttttgttctgtctattgagcccagggttaaactctctggcactgtttgtagagtgaggtttgaagccattcctgagttctgtggcttctctaggagaagtagtgcctacttggaactggttttcattgtctcctgcttctccttttacgtaattctgttcttacaagtatgacattcacgaggaggggaagcattctttcttagacttacacacaggctctatagcttgtaggtttgctgtatccattcccagaatgtgtttgttgaacatttagtccatgtacatggcttaccatgatttgaggtgagccccagggacattcactccaagaccagtctgaggtgggtgagagtttccagatgatgcggatggactgtgcacagagtcatcctggggcagctgctctgtctactctagatacatagactgaggttgcaattcttcagcagactcatttagtcatgggcttccaagttttagtgtattttattttattttacagccttggcctttgactgcctctagccttccgcactgtggccaggtatccttgggaagctggcctgggcagagttggtggacactgtgcttctctaatggcagaaactgtcaatgtgtccttcctctgggcccgatgcctgcaggaagggcactgttccccctgcagtgctcttgagctctgccttctaaggagctgctttccctggacctggtgcctcgggcactgcgcaggtgactggttaactcctgtgtattcccttcctcagaggcctaggctcctctgggcaagagctcccacttccctgtggatgaattcccagatccttccagtttgagttacaaaactagattgttcagcaaatgattaaaaagtgaagactttggttctggcagcagttttaatttgctataattctaggcagcttgcccaaacaccgtgttgtctagattttggagtgtatttaagtgtttcttgaatggatccaaaggatgtgggtggaagttacgcaggtctgcagcaactgtgagcctggtactacatacttgcatatagatacgtatagggagttgcaggggtggtgtgtgtgtgtgtgtgtgtctatgtatgtatatagatgtatgtatgtatatgtgtgtgtgtatgtttgtgtataggtgtatgaatgtatatgtgtgtgcctgtgtatgtatgtatattgtgtctatatatgtatatatatgtaagtatgtgtttatgtgtgtgtatgtgtgtatgtttcacctaaatgtttgctatcttaagaatgcttaccacaattcttgcctgccctcaacctcaagaattgaggtccctggtctgtgtccatctctcgataccatgattctgaccctctccctgtccacagggggcttctcagcttgagtgtgcacggtctagggcatgttggtatgcctgcatgtgtgcgttcccaagcctgctagtgtcctgatgtggaaggctcctgatgctccagccctgtcaggccctggcctgccgagccctgcctggatcagagggcagtatcgagggcatcgtccctggagcaggctttgcagtgtgtgacagagccgcatgctgctctggtgcatgtggtcagccatggttagtcattcatgattttcctgaaaatgctcttctttcctttggaggtctgttgtgggccccattctcagaactctggtgcagttgagcctgggaggatgggttggtatgtggtgggagctgtccctggagagatttaggtctgcttttcttatcttctttgctgtccttttgcctgaagaagtacactgcctttcacattagccaccctgtttccccaggactgctcctgctagtgcctacacggtcccgccagtgtgtatgaagggctgaagcaggctgtgtgtcggagcaactcacagaaccccagacttggttgttcttttagaagaggcaccctttccctccctctccccccaagcaagctgccttgtcctttaaaacctgaagcagagaccagatgaagctctgcagctgcaggctggacttgcttgctgtggcatgaggggtctagcctggattccttagaatatcactgtttggcctttcattctttagcgagttttcctcagatggcagggaatccaggagctgtagctttcgtgacgttcacgagccctctgtctgcacactgcatcctcctcctagctgtgtcagacctggcctctctggctcccttgcagctgttttaggaggtgattcatttcctgggagaattagctggagttaagaactgaagtgtctccttgttgaagggcttgcctgacctccggcaggtttccatctttaaaaaaacacttgttagcataaactaactgtacaaaatagtgggtgttcagatttctatgttcacctcaggctttaggaaggaaacccggtcttctggttggttctgggcagatacggttggctgcagtcgtcgtttctctgacagtttctttcccaggactgtggtagcttacagttgtagtttccagctagctgggtggctgagacaggaggaccacaagttcaaggcttgtcttggctacagagcaagttctaggtaactggatggggaggccctgtctcaaatcagagtgagaacagaaggacagacaaactgacggcgactcagtgcagaatgcttgtttatctttattgaggtgctaggttcagtccatagcaccacaagacaagttccccaggaccaaaatgaaacaaagtcagaaatggaagggttttcagttgagatgatttgttgaagagagggaagggcctggaagagagacggtgacagaaactctggcaggcttagtaatgtggccccaggaacacacacggtcggtagctttaaagcagaaagcccccagccccagctcgcagaacatagtcatttggctctgatctgatttggaccttgattctggaacgaccctgctggttcaggcaccctgtgagatcttggggtgctgtttcccctcttctccagctctttacttccagctgctgcctcctggctgccgtcagatcctggcagtagtgtcttcagaggaaccatagcttctccttcactcagagttagggtttgccacaagaaagaccgtaaagtaggcctgattacatccaccatgcttggcagtgctaatcctgtgcctgtcctctggatgcagatgaagaccacagatttgcttgggccacaaggctgagaggtcagctgggcttcctcttccctcctctccaaacctccatggaactgctgtctagaatggatcaaccttcttaactctgcgacccataatacagttcttcgtgttgtggtggctcccaatcatccattgatgcttcataactgtagctttgatgttgtggattgtaaggtaaatagttttggtttgccaaaggggtcatgactcacaggctgagaactgctggtgtagaaaataaaagtgttatcctctgaaggatgcatggtggacgaggaggctggaggactgcctctctcttgttgtgggctaggttgttagaaccggctggcagcctcaagtgagtggctgttgctccagcccaagggtcttgcttcttactcctggggctcccctaatcataaccctctctgtgccccaggatagtgacatcttgacacacctccctccctcttcaggtgcaaagtgtgatgtgcagagaggtcaggagagggagacggacggtcaggactgtgtgtgcagccacctgctccgttgttggcttttcttagtaggtttctgaacccctggagtgtagactcgcgttcacaggggcccacctgcattttctgtagaccccaggctttctcctcatctggtccccagatgtgttaggggttgtgttgtatgcagtctgtggcctgcaaccactgccctctgtagggctactcttgatggcactcagccagagacactaaacccagggtcccttttagtccccctgtttcaagtataggtttgcacacttggaagatgaaccacagaggtgcatcttatgctggtgggtccaaggctacaccatctgctgacccctctgctcagtgttccttcctgaggtgtgtcccgtggctgggggggggggacggtagccccagtgcttttggctgttcagcatttgcctgtttagtgacctggcttttcacaaatggcactctgatgccttgggtggtgggggttgggggacatcttcagtaggataggtgatgggggacctgcaggaagcagtggcctctgtggtcccttctggaagggtactgtgtcatcccagtagcttcaagtgagaggttctccagactcatccatagcagctcagcaagtctctgtggggtcagccatgtcctggggatgaattaggggagtctgtcagagcactgtatacctcttactgagcccttgctggcgttgacactccccaggcaagaacagagctcgagttctgggctgcccaggggttcctgttgggtctttcagagattgtagggtagaggagtactctccaccctacattttagcaccttggaaatctgaaatcatgatgcctctctcagtggctgcccgccctacagccattgcgctggaggcccagtaaacccctcggggtttcctcccatttccactccatcctgtcagcagcctgagaggaagagtgacggccctctagtgaaaagcacccagctagtgtctcatcagctccctgaggggccagcatctggctgactacaaacttgatcatgtgttctgtacacactggtctgtgatcccacagaggagtcagcagatgtgcgtacccctatgcctcctaattcccaggcctccgtagcgtagtgagtacaataaagatttttccctttttcagcctgctcttgcggcctgccttctcaaaagctcgtgcgatagctgcttgttacctctgcacacagttggttgctcactctgcgaggtgtcatttccagggtttgcccatggcttcctggatgttgacttacaatttcttctcaggccatatgtctctggatgccatgtcaagtcccttataaggtgggcaggcctgtggaggcaacctgtgactgtgggagggtttcagtgagaaaaagagctgggtgggaacactgggcaggctgcctgcctttgagcttcgtgtctctgtgaacccgaggctctgggtcctggagtgtgccggaactgacatggcttggcatatcgcctggaaatccagctgcccgaggcgctgggtttggagctttttgttttgttttgctctggtccccagtgaagcagcaggtaccgttcatttcacttgtacaaggcacagaagcacacatcagcgatgatgaataatgccagggcacctgctgcgtggtggacgggagcaaaagtactactgccctgggactgcttgtctcactgcctggggctgtggggtcataaagctgctcttacctggctctgctgaccctcaggagtcatgctgcagggcagtgtggctgtgccgcagtgaggaatgagcccgccatgttcccctcggtggggctggagtggtgtccagtctggatgcttctagcgagtccatcctgcatagcctctcatttaattctggtagcagtactaactgggcaatgttgttagcccatagttcccatggtccggtagtaccggggggggttctgctgaggcctgggactagaggaggaagcagcccccgcagcagggtaaggcctgggttcttcggaccctctctgcaggaacgttgtgccccttcagaatggtggtgctgaggtatgaagtcttaggtnnnnnnnnnnnnnnnnnnnntggcagtgtccatatgcaccacatctgaagattctagttgtcattgtggtcactgacattcttggatgctgtcatttctggatcccagggagcagcgggaagcccccctccccccatacaccctgaggccaagactgagggtgtcttgacctcaccattaatcctacctaccccagtacagggctactgtcatccggtggctcctggtgctgcctgccagtgtttatcagctagcagaacgtgtggggaacttcagtgtcccaggcaaaggtgagtctgtagacagcagtcctcatgccatgggtggaagggtacgtgagacaggaagtcggttgccgagcgacagtgaggtttcctctgatcctagactcttcagcaacagctatcccccgcccccctcagtttgccatgttcgttactccaggcattccgagatgctaatcctacacctctgtaccaccgcattgtccatagagaacatatgtctggttcgttttgttttgattttgatgttgtgtatgtgcgcatgtatgcatgtgtgtatgttacatgcgtgtgtgtgtgtgtgtgtgtgtgtgtgcgtgtatggaggtatgcaggcatgtatgagcaggccgaggccaggagaggatgtgggtgtctgcccccattgctttccaccttagcttttgagacggggtcttgcactgaacctgaagctcgctgtttgggctaggctgtctgagtagtgagctctcaggatccatgtattcacccctgtcagggcacctgcagtcttgctcagtgtgggttctgggtgtttacacaggtcttctgctttcatagcaagtacttttcttcacagagctgtctctccagccaattttgacagtgtgtgtgtgtgggaaagtgtgtgtgtgtgataggtagcccaggttggccttggacttacgcagccagtgctatccttacacctcctgtctctctacttccaaatgctggaataacatgattgtacaccatagctgtcacccagcttgaggacactgtttaaaggaacttaggaaaggttgtgttttgctctgtcgttgatagtaatggtcttttaacacatgaggagccagaagggatcctcttagacacactgggctgtgtgtttgtggacttgcaagatggatgggaacggcttcccagaggagggcagtgatggcaggaagaagcaggaggtttgggtagtgatgtctgtgtgtagaggatagaggccacaggatgggccacggagaaagccccggagcacaggctgctgccatgaagcctggctgctgccgttatggccagggtgactggagaggaaggtggtgtgggggtcgacagaatgtgtgctaatggggctggagcccacattttaggaagcgatgtggggaggggcagatgacaatccttcaggtttattggtgctcgctgctgtgggtgcagggcctgtggtcctgtttctgtgtgtccttcctgtatattaccaacaacagagagaactctgttgtgtgttccaggccagctgagagtgacagtcatgttccatagttgcaggtcaaggaagaggaaggtcgcttcctcaagcatgcccccttctatctcaattcagcttacaaaccactgagaagatattttggtggttttttaatttttgtgattcctgcctcccttcccaatcatgtttttgccatgtgttggtgtgaaatgcatccctgtctccacactgcaccctgacagtgagacagcattcaaggctgcttttgtctaaaccacaatggctgtcactaacaccaaggactggggagcccagtgccattccagggcaggacacagtcctgttgtgttcatgcctgacctctgcactctgttccacatgtgacactgagtggactgactggtcttgcatgaaggcccagcgtgggatgagaacataggtgtggatgagagcacaggtgtggatgagagcacaggtgtggatgagagcacaggtgtgggatgagagcacaggtgtgggataagagcacaggtgtgggatgagagcacaggtgtgggataagagcacaggtgtggatgagagcacaggtgtgggataagagcagaggtgtgggataagagcagaggtgtggatgagagcacaggtgtgggatgagagcacaggtgtgggataagagcacaggtatggggtgagagcacaggtgtggatgagagcacaggtatgggataagagcacaggtgtggatgagagcacaggtgtgggataagagcagaggtgtgggataaaagcacaggtgtggttgagagcacaggtgtgggataagagcacaggtgtgggatgagagcacaggtgtgggataagagcacaggtgtgggataagagcacaggtgtggatgagagcacaggtatgggataagagcacaggtgtggatgagagcacaggtgtgggataagagcacaggtgtgggataagagcacaggtgtggatgagagcacaggtgtgggatgagagcacaggtgtgggataagagcacaggtgtgggataagagcacaggtgtgggataagagcacaggtgtggatgagagcacaggtgtgggataagagcagaggtttgggataagagcacaggtgtggatgagaacacaggtgtgggatgagagcacaggtgtgggataagagcacaggtatggggtgagagcacaggtgtggatgagagcacaggtatgggataagagcacaggtatgggataagagcacaggtgtggatgagagcacaggtgtgggataagagcagaggtgtgggataagagcacaggtgtggttgagagcacaggtgtgggatgagagcacaggtgtgggataagagcacaggtgtgggataagagcacaggtgtgggataagagcacaggtgtgggataagagcacaggtgtggatgagagcacaggtgtgggataagagcagaggtgtgggataagagcacaggtgtggatgagagcacaggtgtgggatgagagtacaggtgtgggataagagcacaggtatggggtgagagcannnnnnnnnnnnnnnnnnnngctctgctactctgcattttgatggttgtggtttcctataattgtcttcctttgttacacagaataactttccttggtaaaagacaatgacttcatttaactgtgggttcaaggaatatttaggatgtattaagggattatgatagtttagtagcaggttctctaagagccatgtcttcactagttctgggtagttggctaggtttccagcactaggcatgacttctgtcttgctgaccaggtcttaagcccatttaaagagctattggttactcccaaggtaatacgtgccttagggtcggtgtgccatgctagttgtggctcctgcgtgttgtagctggggaggactgttggttggctccttcctttagaagctttcatggcatcttctggtaccatgagaactaactagtcctcaaggagggacatttcaggtcagtcctagttcaggggtccctgggccctctgtctgaagtgtgtggtgtcttcagcaatagggacttgcctcccacttctagggtgcagtagcaatagcctataatatttggggggtaaaaggcctgatgctggggattttgttaggtgatctttggctttagtggggagcattctcagcccagatgggcaacttcatttaaactattttacacatacacacacacacacacacacacacacacacacacacacacacgcacacatgggggggtagattccttacagaattttcagacatccatcttgctgttattttatgttccccctcctccttctgtatttgtctccctcctccctaaagcttctccatctctccatcccctctcaggtcgcctgcaccccgctagtcccctctttatggctcccacctctacctggcaatgggtttctctactttcctggtttctgcagttactccagaatatgtatgtactcacatgagaaaatttggagctaggagctctgctgagagagaacatggaacctttgtttttatgagtctgagctgcctcactcaatacagtcattctcagtaacagccgtttgcctgcaaagttgatgatttcattttccttgactctagctgttcttcttaacacagttttcctcttgagagtaggaggcctggagccatggttatacggtcaggcatgcaggagggtgtgtgcacggcggcgtgtcaatgtgtttccctccagagcacttttaaaggtctccgctgttattaacaagaatttgttattcgtatttaggataatgctgatgaataatccatggtgtgtgcttgtgtgtgcgtgctgtgtgtgtgtgggctctgtacacatatgatgagtgnnnnnnnnnnnnnnnnnnnnaaatccccagggatcctttaggatctccccttccccacctccactccgttaagtcccagcgcctgcactcggatggaaatgtttgctgttacgcttctcggtttgattaggtcgttggattaaattaattgtcaggctgcctggaactaaagcctcttaaaatgaaaactgttttcactcaggaaatttatgcaagatgaagaatgggaaaaccttcccggggaggaaaggccgggtcacctgaatctgcctgtccctgctccccaaagccaggatgtacacgccagcaggctccttttgttctgttctagatgtgtctccctcttagagcctcttggttacaagtgaaaaccacccaggacaggagtaagctgaagagggaacgcttggggtaggagggcatctcacttcaccaagaggaaggaaggctgccaggaactgggacctggagtcagcctgggccaccacagtctagtggcctggttctgtgccccagatcggtggctctgctactttttcagtggaggtgttttctgctcagatcttgtatctgtctgtccctagtccagcttctcagcctgggctgagcctccttgagggaacccacgagcccaatttaatatgggcttctgctgtgacctatctgcagagggagtatatgtcatgcagatgtgggtagctgataatggacaggacttggatcatcagaaagcattttgtacctccgcgttgtgtttgtccttaacctgagttgctaggatatggtggagggagaaaggaagggtggtcggcacaggtatgaaggtgcaggaactctgctctgagaagggccctttctggggtgggatttgctctttcttatacgagttaaacagagacctttgagcctctttgtagggtcgaggtatctgtgtgtggaggaaggctgtactgttgagcttccgtcaaagcttgcaggaagcttgtaaaacccaggatgaccctggtctgctcttgggctgtgtgccaggatgaaaacacacattgagtttttcaagaatccagaaagctagctgtcctcatgggctcaggaaagttttgcctgcattctggattctgttctgaattctgctgcccgtttgcattgagtaatgactgcgcccaggaagccagagcgttggcatcagggtctgagatcctccttaactgctgatcacgtgtgagagtactttctaaggtgcttctggcatgaagaggtgtccaccccacttggttggccagagaagcagagccctaagccatggcacagacttgttggtaccagttcctgtgatgcccagagcagccactctactctgcacaggcagcaggatgagccctgtacttccagccctgctctttgtttcacggctcagtagcctggtttgcatcacgctttcagcactgcgcctaggctgtgtctgtggctacaggtaccactgccatgcctagatgtgtggggagaggctgtggttgtccttccttgggtccagaatgtgagcacccaccgtgaagctgcaaagcagcatgggtacagcctgttcatgagtttggcacggcagctgcatgatgtgttgagcaattgatgggatagtccttaccaagagggctgggaggcagaaagttctggcttctgatgatgcctgtaggcctttcacgtgtcagatgttcactgcccagggagcaacgcatggacacgttatgcctggtgggatggaagaagtcgctgtctctggcgaaggcccttggggaaggtctagcatatgatgtacagctcagagaacggaaggtgcccaggtctcagcatttgcacagatgcagcttgtcctgtgcctttctcggcagagtaatggcagcacgagccagaggtctgactcacagagagaggcagtggacagaggcctggatccccttgcatgtctgacaggagggccattaaacttgtgctaactaagcctgggtctctgcctcattctaagacagaccggggttcacgcaggtttccttggtgcaaacctagctctagctacagttgtatacaggtccggacctgctccactctagccctggcctgcaggttctcaggccatgacaggttgttagacctcagtttcctgccatgcctggctggggcagtttagcctgcctgtctcctgtgttttcagaactgccctctgtggaggaattatccaaatgtaagtttctcagtcaggttcagggctgccctgggctcacccccaggcttttatcttcctgctcttgcctctcaggagactcctgttgatcagggaacatggcgtaccatgatgaacatgctgagcttcgaggtggtctgatgcttcttcctacctggtccactgtccctcctacttctgtgcacttggcccagccgggccgttctgagtgcctccaccaggtgtggctgacatttgctgctgctttgcccttccctgtcaggaaggctggggaacatgagggtcagcgtccagagtcagacccagggagctcggactgggctcctggcctcagtgagtctgctgcacagcatggcccttaccaaagcaggcgtgaggagtggaaggcagaggcagttgtccacaccctgccagcctgtgtctcatgactctgcaggaggggtgtgacctggtctcccctgtcaccccagtgacgcatgggtgtctgtcagagcaggtcaagttttggtacctgtgactatcacctgtgcccggggtagttagctgtcacacacttctttcctggaatgggctggcctctgagccgcttggcgttacacgtggtgcctccacccatcggaacactgtgctctaagtgggatccatgtgcctccctctctgtgtcactatgtctctatgccaactgaacaccaaaccctgtggctcacagtcatgagacagccttgtagcccttgttcttccatggtcccctagagacttggagccctgttcctcagggcatcctttccttgactgtctctgcttccctcttctacccacacaagccattttttccagacttcttcccagggccagggtaccctggtcatcacccataccgacccagctgatgctgttatggcttctacccttcagttacagtaaaattgccaatggcttcctcagctctttaaaaaaattctttttatcttagtttatgtgtatgggtattttgcctacatgtatgtctgtattacatgtgttcctggtgcctgtggtaggaagatgatgttggggaactcttagagttacagatggttgtgaactgccatgtagattctgggaactgaaccagggttctctggaagagcagccatgctctaacctaaggagccatctcctcagccccttcttattgttgttgtatatgtgagattatggttgggggcatacatacacacacacgagagagagagagagagagagagagagagagagagagagagagagagagagagagagagagagagtgagtgtgtgtgtgtgttatggagtcatttctctccgtccacctttgtacgtgttttagggatgatgcatgccatcagtcttgcacagcaagtgccattactggctgagccatttaggctaaggggcttacaaatgaagagctgtgtataacagaacttttcctagagtggaaagatccaggaacacatctcctcaccccacatatggaacctgtagcacactgcattgcttgtaggcagctcaacaggttagagagtgagcattctaggttcctcggttggcctaactctcttccaggcaggtcagctggtttctgcttctaggcaacttgtctggtaaggagctgtctttgcagctgggctttgtggcttactctatcagggagggacctagggtcagtttcaggtattttctgaaactatgtttagttgtttactcttctgtttaaagagcttccctgcagactagaatgtttcaatctaggaggaaactgttaaagagtttcaggctagttaaagacctcggcttcctctccaaagcccctgggagcatccctgtgtttaaggagacttaaacacctggtgctgttgccctgtgttgtgtctcctgtgaccattcccagagccatgagaagcaggtggtagccacatggatttacctgtgtcctcctgggcgccaggccagctgttgtctttgcttctcttctttcatccagaggcgtggtcctccacatgcctgctgagtgcttcctagagtccacaggtgcacacgggattcaggcagagccttggatctcacttggagctgtactggcatagcacctgtgggtcagctctcctgacagtgccagatctttatagatagcccggtgccaacccatctgcctgcttgttgggtctcctccctgggcatattctctcatgtttgtggctactagttctggggcctttctgtcagttttcatcttggtaaggaggtgctggccagcactaagtactcaggcaggcaacaggagccctggcaaggatctatgtggcagggctttgtttgctactggatactggtggccaccctagtcctgacaggtgtttctttcatagtttcctgaaggtgggtggctatctcttcatgtgtctgtccctcttccagaggagagtcacagggagagattgagagccatcctttacactgtcattgttttttatctctgtaaggcttagcctcaggcagnnnnnnnnnnnnnnnnnnnnttcagtggtgtcatgagcttcacttggcaagaactcactaacactcattgtggtggtttgaatgaaagtggctcccataggcttataaggagcagcactattaggaggtgtggccttgttggaggaagtatgtcactgagggtgacattgaggcttaagccaggcccagagtctctctcttcttgttgcctgttgattcagatgtaatactctaagctatctctccagcaccgtgcctgtctgcacatcaccatgcttctcagcgtgatgataatggactgaacccctgaaactgtaagccagaccctcttaaatgttttcctttataagagttgtcacggtcatggtgtctcttcacagcaatagaaaccctcactaagacacccatggggagagatactagcaaaagcagaaaagggatgctgaattcagacctgggccatggccaagcatgcacctgcattcctgagcaggatggtggccggcctcctgaatatcagtggagcaaatgacggtggttgtgagaattgcagaatgctgtattcctcacaaacttttttaacacagcacctccagccatggtgcgtagagggtgcgtctcctgggcgtatttcttgaattaaggaacccgatcttctgctgttatttggaaacacaggctgtccagctttctgtcacctaggggctaggtaagaagcccgaggctgatggtagtgactgttctttgtacctgtccccaccccttgctgctctttcctctgtctggtgtttctagatgtacttcttcaaaattgtgtccattttgagattataatatagttatttctcccttccccttcattccttccaaacctgcgcatctattcctccttgttccctttcaaatttgtggtctcttttgttcattgttaatgtatatattcataaacacataaacacaacctgcccagtctgtattttgttacctgtgtactggtattggataaccagttggtgtgctttcccctggggaagactgtttctcctgctctcagcttcccttagttccccgtagttcttgtgtaggttgaggccctgtgccctaccccatccactgcagcttgtctattgttcttgttcagctcaggcacaggcagttctgttggtgagactctatgggtgtagcttctgacattcctaggagatacaacctcacagccaagtccccattcccctggctctacagactttctgccctcttttctgcattgatgcttgagccttaggcagaagttacattgtgagatatgtatctattgggactgggctctgctactctgcattttgattggttgtggtttcctataattgtcttcctttgttacacagagaactttccttggtaaaagacaatgacttcatttaactgtgggttcaaggaatatttaggatgtattaagggattatgatagtttagtagcaggttctctaagagccatgtcttcactagttctgggtagttggctaggtttccagcactaggcatgacttctgtcttgctgaccaggtcttaagcccatttaaagagctattggttactcccaaggtaatacgtgccttagggtcggtgtgccatgctagttgtggctcctgcgtgttgtagctggggaggactgttggttggctccttcctttagaagctttcatggcgtcttctggtaccatgagaactaactagtcctcaaggagggacatttcagatcagtcctagctcagggggtccctgggccctctgtctgaagtgtgtggcgtcttcagcaatagggacttgcctcccacttctagggtgcagtagcaatagcctataatatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttgtctccctccctccctaaagcttctccatctctccatcccctctcaggtcgcctgcaccccgctagtcccctctttatggctcccacctctacctggcaatgggtttctctactttcctggtttctgcagttactccagaatatgtatgtactcacatgagaaaatttggagctaggagctctgctgagagagaacatggaacctttgtttttatgagtctgagctgcctcactcaatacagtcattctcagtaacagccgtttgcctgcaaagttgatgatttcattttccttgactctagctgttcttcttaacacagttttcctcttgagagtaggaggcctggagccatggttatacggtcagcatgcaggagggtgtgtgcacggcggcgtgtcaatgtgtttccctccagagcacttttaaaggtctccgctgttattaacaagaatttgttattcgtatttaggataatgctgatgaataatccatggtgtgtgcttgtgtgtgcgtgctgtgtgtgtgtgggctctgtacacatatgatgagtgtttatgtctgccccactcctgagtgttggcatctatacacagaatctggcatcttgtctctgtaggctgttttgttcatagtcatcttggttggctgagatacttcatgtctctcatcagtagcagctcatttaggcttgcactggggaggtgtgtccaggaacgacttgtcaagaggtgactgtgaagtcagaggactgggcagtgtgttgggaacgcacgcacgcagctctgcctcttgtcttggctgatgctgccctgttcagagcgggatggagtgctggttctctggcttggcttgttttcttccactgtgagtttctaatcaaaatgaagttaccaagcttgactgccccgtgtccatagctcttagctatgggtaaatgctacaacttctcaagaatgagcatgcctttgataacaacagccatggttttagtttcagggccatctatcttgggatcttccaccgtatggcgccatcatggcgcactgcttaggtctcaccacagtgggcacagctgatgcttgggtctttgtgggagttgcaggatttgaagattaatgactcacaccgtcctgcctgagcgtgtgactcacacagtgaggttcagacatctgagccttgcagatcgcacctttgatttctggtcctgccttttcttctcggtcccagtggccttatcatgccgaagcgcctgtggagacaaaccttgctttgctcactgaacatcttttcctggttttcttctgttcgtggaagggaaaaactgcattgtttataaagaagcaggagggctgtgtcctcttgctgtactgcaggtcatagaatcccctccccctacagtcttgtgtcccaagttgatcttgagtttgctatacagctgaggatgaccttgaacttctgagcctcccaactaccaggtgctgggattgcaagctcctgtccccatcccctgtccatgcagtgccgggaatgaatcccagggactcagatgtgctaggcaagtgctctgtctgtcaactgcgctgtgtcccagccccgcaggagtgttttaactgctattttccggtttgttctacattagccttgtggtcacagttttgttagacccttaactcaggaaacggcctgtacacttgacaggcacgatatgaaaccaagtcataaaaccacgccatttgggcattctgaaaataaaaacgtcacgtcatcgtcgtttctttgttgttctggttctacggtgagctcaagacccacagatgaccttctctgcgtggcccagtctccagtgatgacatatagctggcctgagagaatttctgcttactctcctcaggactcttcctcacaagctgcctcagctttaagcagcagagatggtgggtgtggtggcatacacctttcatctcagcatttgagaggcatggggcggctgaactcttgagtgtgaggccaatctggtctcatgctgacctcaacttaatgagttcaagaccagccaagtttacatagtgagactctaaaaccaaccaaccaaccaaccaaccaaccagaactcaaacaaacacagtgactgccaccagggccacatactgtctagctcttcctcagatggagtcaaatgaagtctaaggcctgccaggtacttcttggagttttttgggttttttccccccattatttctgtttctaactttgtctcatacaaggagacagggaagaggaaggcatcagcacccaagaactaaaggagctatgaccccagctttggtcattctaggctttgtaacaagctagcatttccccttgtcgcatactgtgaagaagctgaagaaaactgcaagccggacgtcttccaaaacccgcccatgacaagagtcaggctcagaagcagctgcggcgggacgggacaggagctatccccagctgccggtgcatggcttgccttcttcagagattcgaagtgagggtatgccttctcggtgattcaggacactctccagtccttcagatccttggagatgggatgtgatcagagtcccctgcttcctctggcctgaactcttggaatggcgggcgtcagcatcacagtggtgccagagttgtgtggtctgcactcaggtctcgtcaggcgggggttcactctgttacaggatagagcacagtcagtcgggtctgaggatctggtcttattctcaggtacccaggtattttgggggtggggggaggggacagactagttaaggtctggtgtcaggtggctagatacagcctgctgtctacactgtgagatcactttcctgctgtctgtgtgaactactcctagccagaccccttgatgttgccctcctggctgaggtcatctacctgtaacccataaacctgctatgtcctgagccaacattctctgtccttagcgtttgacccaaacggtcaagtctgctggcagcctggcactgcagtggaggaaagggcagaggcattagtgggtcagaggtcaaatggagcctgcaagctgctgggtatgggtctctggcctgtgtgtaagggaggaagaggtggcacacggaggaggagcagaagcagctgcaggaggcactgcctaagtccacctaacagtctgcaagtcaccctccttggagagcaccggcggtttggcttgagttcgagagtataacatgttttaaattgaaggcagatggactaaggagaggagggcttgctgtgtgaggctcaggaacctctgagccaaggtcctgtgttcagtcttgtattgtgccgtgtttgttaagccaatcaggagtgtcagaagtgctgacagagcctaagcctaagcctgttaaggcttggtctttgaaggttgtgggttttgatgagcagcaagagagcttcgtgttagagggatcggtggctgcctcagctggagagcactgtttgggtgtgaagagtggcagaactttgggtaggatgacactcagagcttagatccaggtgctcagcttccgtctaaatggataactgctcttggcacttagatctgccctgccatgttgtgtctgcaaggctcgggcctacgtggctcaccttctagtaggggtttcatctctttttcctgtttgttcccctactttctgtttcaggcaccaagctgacaggtgccgggcgggatggtggccttgctgctgctcacccagatggtgccacccagatggtgccacatgccttcacacgctatgaaactgctgggttaggtgcaggggtggtgtgtgaggtgttcagcaagaggagcagagccaccccagagggtagaggtcacagggatggggctgtgtctgctgcttggatggctgaagccagctgagagcagatgggatcactaagctgtggagatgagctgctgtgaggtatattcagggaaggggaagatgtgtatagttagaggaggaggggaacttcctgctgtggtaggcgtggcctctgaactggcattgttctggctctcaccttgtaggtccacaggggcagctgttctaatgtagcaccagtcactgtctggtactctgtagatcagccccctgcccctcagaacgttggacagggagaaagtatttagggctaaccttgttcccacacataagccatcactgcagtcacagctaggtggcgggttcagatcctggtgctgggagtgcaggcatagtctctcactcctcagggtaggtggaacgattttgtactgtactgggaagatttggtaagcagaggtctcctgttgagggttgaggcaggagtgcaggctcctcctatttgggaagtgggtctctgcaggggtgagaggttcccctcacatcccactgtgagctctgcccagctgatcccttatgtcaatacctctcatgccagactctccttagaatactgggaggttgtcttaatggtttgatttaaaattcatgacaaaaagcccttctgttttgaagaatggcgtgtatttgagctccttgcggcgggctgtgatgttcctgggcgatgcgctctgtttagactctgtttagaacgatttgtggtctgctctgcgtacgctgctgggtgtgggaacctttttgaggtgtgagttattggtgctataactcactcctcgttactgcagcattgcttacctggcatgaaacacaagttgtgttgatgagttctgatggagcccctgaatgcagagctctgtgagggtcctgcagccccagcacatgctgtgatggggaggtaggcacggtgcagcggatgcttcacacacatgcagttcttgtctcctctgcagctgctcatggcaaatctgcagggtacaggactggccgctgagttctttctagtgtctgtggagttggttctctgccacaggtgctgctggttcccatgtcccacccccttctcactcttgcattgactgtgggtgggtttgtgggtatgcacatggaagcaggagtgtggtttcctctacagtagaggaactagacagtatcactgtgtctgttgagagagggtctttcactgggacctgaagcttgtccgttgggctatgccggtgggtagcaaacctctgaaatctacctgtctccacctccccagcattggggtggtaagtgtgggccaccagcctgactttttttcatagatgcagggattcaaactctttgagctgagccatcttctcagctcatgagaaccccccacccccaggctagctagtggccttgaatggtcacagccacccaccctggcatgtgtttaagtcagaaggagtctccagcaagacccccttcctgaagtctgcagcccatatgagctagttctgttaactctggtcctgtgcccctgctcaagtccctgggaaatggggatgtttggggtgctgtcacggcttcacagtgtgcttgctgttcgtttgtagtctgcttttaggctggctcatttggaattagcaaactcgtctcatgctcagaatagatcgtgttgccagggatcaaagccagaatctgagtgtgggtatgctgaggctgttgctgcttctcaatgcccatctctcctgtcctgttgcctgcttactgctgaggagcgagtacagccatggaactctgagatggaagcaaggagtccaggtatcctgcagtggccacagtgccaatgccagcaagttcctgcactatgtgaatcacttggtgtcatagccttgggtctaaagaggcacacacagtccctggcccaaggcttggtagatgggtgtttcctctgtgactgcctgagggcagagactagctgcgcggaacaggagtgattgcaaccccaggatgtggtgagagcctatcaaacagatctgtatgacctttgtgtacctatttgtgaagtgggcacagattagggtagatgtcccatgagtggcttctagtggcttttgtcccccacagttgtcttagttacttttctgtcctatgaacaggaatagacacgaccaaggcagcttatgaaagacaacatctgattcggagctcacagttccagaaggtagtacagttcatggccgtcaaggcaggaagcatggcagcaggcaggcaggcatggcattgcagcggtagccgagagcttacatgtcgaaacagcagccaggaggtaagtggaggtagggttggtgcctaggctaactgggaatagcatgaacttttggaacctcagagcccacccctagggacacacctcctctaacaaggccacacctcctaaccttctcaaacagttccaccaatggggaaccaaggatcaaatatagtagcctatggagccattcttgtccaagctgccacagcagcctgaggatacttggagacctcttaactgtctggagacacctgagtacccccaccctcaaccctataataaatctcattgcactggcccggtggttcacatgccagcaaaggcaccttaatttctagcccacgctctgtgtgccgtgcggtgtatatcattgttggatcacagggctgctcctgtcttccctgggatcagcatcccataatttaagctagggatacactgggctcacacttagctgccaaggatctagaagcttgccatttaaccctaccgtgaggggaggtgcctcaggagaccaaggttgacacagccatttggcttccactggaaaggcagccatatgaattgcatgcctatctgaacagggaagtcctgtgcaaagtggggcaggcaggtgggagcttctcttctgctgtgtccccagggactatggctgactgtggaattcatactcaagtagatacggaggtgtcagcagaggatcctgttgtgtgttcagagtttggtggaccccggccaaaacacctcaagagttcgtgggacagagcaaaatggcagaccaggtcgggagactcagggaccaaataggaggaggatgggcgttggtggctgaatctctagtcaggaaggtagagagagataagggctccattgatcagaggatgctctgtggctaaccctactcccaagcagttcgcactgccccagaggacatagggtcctgggaaagctcgtggaactgggtctgtattccctccagcgggtcctagcatggctgtcactacctgtgtctccatttggggtttggcagggctgggtcttgataatgctgaggtcttaggcctaaataagaagagtggtgtgttgtcagccatcaagaaaggttggggtcctttgttaggaaggaaactttcttcaaactaaaggcagatccttccctacccggtttgtttcaaatccccctttcccttgaagtctccgggctttgctggggtgttgggcagagctttttggagacaagtgggcactagatgactcctgattgtcttgctgtactaggcctgacataggcaggacttctctgctctcaggaagtctgcaaaggctacgtctcagttaggattgtcagcagatgccccattggttcagggcctattgcccaactgtgccccctgtccctggggccacagccttgctgacctgtgtccctgtactttcaagggtacttacaggggcttctatgctggtggccacaggagagtctggtcttctgaagtggaagtgaactgtgccacttggattcttccttttctcgatgcagcatcaggaccgatctgagcagactcttccgtcttgtcacaggccctcagcatgggttagaactatattataactcagcccacactgacaaggaaagaggagggaaacctggtttggcttaggaacaaggctgtgtgtggttcagcttttattgtcttttgtgaacaaaagatgtccgttcccctaaattctggaagaaagtagagatttcctcctgacattgttagttttaaatcacagccagttctgatccctcatgaatccttttcaccttttaccccgtggcttttctttagtggtgacgtcacgagaacgtgttcccgctcatcccttgacttcctccttccttgtccctgcttgcaacaccgtgtttgggagcagagcccagtgtttgctgtgctgccgcggctaccgtcccgggagaccctgccatccggcaatttcccaggcagtgtcctgtccgtcatcctagcactgagatgaggacactgggtgaaagtacccggttccgttgctgtgtctgaagtgtgctggtggccgcgaaaagccggctgctttccctccatgctcctctcagacaagataaccaccttgtgagtcgctgtccaacttctgtgccccacaagccaggatgaggccaggacctgggctgaatcagcgcagggtgacacaggcttccaaaccttcacctccgccgcagcggtggctgcagagtccatggcccgctgcaccaggcctggaggagatgcacccactcacctccatgacctatggtgtggaagccggttgaaagggggcctgcctttctcagcctcacagcaaggctgggaaagaacacaggtctcgagtggagagctgagatggaggtttctgagaactggcttgttttgagtcattgtggaaatatctagtcagcatgagtttaagctctggaggcctgtgactgtgattcacaggctcatcatagctgtgtacagtgttggaaggtacccggaagacaaattagactagatcccttagagaccacacgactaatccacccaggaggccattcctccagacctcctgtcctcgggtgttggcctcctaacagtggggcctcatggaggactgtgggcagtgtggagggcagggagcagggtggtctggtgggttctttgttcacatttgtaggcagttctgagaaagcagtgtatgtggacatttctgtcagtaaacagtatgtgaccaaggatcaaatgtttattttcattctggcaatgcttggttctgacatgctgtccacagctgtcacctctgcacagagtgtccaggtagctttgactgggctctgcccttccggagataatgggaacatagtgactgtggtttcccatttgaagatactcctgttctgtagagatttggaatcagactttgaagttaagggcagtgcccccgggtgtgtactaccgtggccagttcccaggttagggcttttctgcacatgtgacacaattcttcttcctcctctctgcactctgttgttggggttacatagcctctcttctttttcagccttctagccctgtcccttaataattaaacccatgtttacccagtggtaagtcattgaattttgaggtgaatttagagcgctgtgtgcccttatgctgcctagttcagtgcccatctgtattccagggactctctaccagaagatagtgctgaagggagaaaaataagatccatgggaggctctgctgtctctggtcatgtcaccagaccgttctaactttcttgaaatactcatgcacctggggcaggaaccacaggctggacagaaacggctcagaataagacggagaggtttctgcttccgcctcctggggatcggtggtttccagaagctggagtgagcaggaactaggtcaccccaggagactggaaagagctggtttgtcttaagagatgtgggtacttaatattacatctggagggagagagaccttagggcgcatccttagggcgcgtggatgtaagctggtgcttgtgtgtgtgtgtgtgtgtgtgtgtgtgtgtgctgcacgtgtgtgtgtgtgcgcgtgcatgcacatgtacactgtgtgtgttttttgcacacacacagtccatatcacctgtctttaagcatgcagtttctggcattagtcacagccatactgttatgctgtcattaccatggtccctccatggactctgcttgtcctttacagctctatgactgagcgagtgctggtggacacactgtgtgttttgtcaaccagcatctttagggctcacctgccataggatgtgtcaattggcctccttttagggatgtatagtactctgctgtgggagtgcactccctgcatgtgttggtggatactgggctagtggtataattccacagcaaatataacatggatccacttccaccatattgtcccatcttcccgggttttcctggggtagacttggtgactatacttggcactctgccagtcagacagggaagtccttgtcaccccgttcagcctgaggtgagctgcacttgggggcaggcgctgctgtggacagggggccctgaaggagaagattctgcagacaccagtcagacaagggtgtttcccctctccctgaccagttctctctcctacacttgtgtcctgcttctactgtgaactaagacatcacaataaaaggcggttttaagagatggtttgcatgccagtatagttggaccctcttgcgtttgctgaggggaggtggttgagacgttgtaactgggaaaagcgtatatgatgggcagtcgattcctgaacagatttgaggcaagttttgtggtcctaagttctgcacagccatgagaatatctacctagatagatctacctatcacctgaagaggcaaactgagacagtctgtttttctcaaaggtggtgttagatatgaggcaactatagctcctggcaaggtagatgtctgtgtgacagtattcttcgtcaatgtgataacccatcagtgggacactccatcggtgggacactccatcagtggagtttgggagctcagcagaggccacttctctttatgactgcccctcagccagactgggtttatgtaaccatgtgccgcacaggtcttaacgtggtactcacacatcagtctttgaggtgatccagtgcttcctgggcacagactgtgtgggtcagtggttagggacttccaggcagctttgtcattggctactgggacaggtgggtaaaccttgagtggcctgctcccccatgggtgaggtgggtgtactgagagtgtagcttaggcatctgctgagatgtaagatttggctgccgtgggtgcagctgggtgtacggtgtctaaagcagcctgggtttccctgtgtagtgtgtttctaacttctgagagtcaacagtccttggcatgctcaaaccctctattcctttgtcaggcttggacttaagtgttccgttacatctagatttgggagcttcgcacccaccttttggtgtgcttgtgatatgaggtgcacaggctgaggactgacactagagacagagtggcgaccatttctctggcaggcaccagctccctgtagaattgtccattctctctgtgtgtgggtttgttgttatttgttttgacacagggtctcatgtagctcaggctggcctcatactcactgtgtagccattgatgactctgaacttctcatcctcctgcctctgccacggagaggctgggatcccaggtgtgtaccaccgctcccagtttatgctgtgctggggattgaacccagtgcttcaagcgtctagtcgaacactctgtcagctgagtgtcattattcttcatttgaaagaggcctctcatgagttaatcccagaggacatggcccctcccacttgcacgccactcatccagtgcccaggaaatatattccagaatgcacacccactgcccttccgtgtaaggaggtcagtgggaaaggaaggcctgagcatctgccataatccaggacagcgtggtgcccagtgtctgtctctgctgctcttggctctctctcctgagggttcctctttgctcctgtcgacccatggaagctcatgtgtcttggctgggctaaaaataaattcctttccctaggccagggatcggaaagacagcatcccctctgctgtttggaactggacacaacaagctgatgagataacaggctgttgctccttttcctttgctgtccatgggtgttggtgtggagccctgaggtgtcgccagggtggcggctgctcccatccatgtgtgtacaccgccatctgcttccccaggcttgtgatctgcccctgagtgtgaatggtgctttcatctgtgctagcagtgactgcagacctgcctctgccacttgcagaagcagagtgtgaagcctgcaccgtgtgctctttctggcagggctggctttggtggtgaagtgccaggtttggcatgttagctcacataggggtaaagagagggctgccacctggttcctggcctgtagtatatgtattccagaggaggctctgccttggcataccactggacttcttgggtctagcctcaaaggtgcggagacttctgaactaagttacttcctgtttccgtggtgattctggggtgagctctgtgaagagcacgtgctggagtggagtctttggtgtgtttggtacagcaatcagttataggcctttggtcgggaggactagaaagagtgcccaatggtgcgtgtgactgactggtactcacacatgcgcacctggcccccagacctgctcgcccaggtgagtgatgacacagggaacatctgcctgtccagggtgaggagccggagcagagccgtgtgcaagcatgaacactctgcccagccttcctccacaccagggctgattggtaggccctgagtgttccagcagggcacttttgggggtgtttcagcagggtacctttgggagtttgctaccacccacctgacacaccacctgctcttgaggggcttccctgccaattcagaccttgaagacccgccctgaagtcatgtgtgatggcttgctcctgtaatcccagcgcacggtaggctgaggtgggaggggtaatgggagttgaggttagtctggcccgcagtgtagaccatcccatctaggaatctgccctgattatgctgtgatgagctgtgcactcagcccaagcggggggcaaaaggctctgtagctatcagggaccaggtggtggcctctgtgtgcaggctggaccgagcccatgacttgcaatcgtcctgtctcagaggccttctgtccacgtagcctttaacccctgttcctccatcccctggaacttgcatgatctctaggatgtcttgctgagagagggctagtggagttgagttctcacagaatctcctgccacctcacaggtcctggctgccacctgttgatacagccctgcatgttagatctgagacagggtggtggtttgtgtgtccaccttggtgtcccgggagactccagatgatgcctacttcaggaacgtcagcacaggttgccatggagatggcttgtgatacagtacctttgtaaagcagcagtctccttaacaggcaggaatactgtaaagtggtcctggaagaatgtgctccagagcttcctggcttggccctgtgcccaccacacagactacagggatgaaaacagagtctatagttcatggtggcttcgcctgtgaacggaggctgggagggatcacacacaccccatcccccaccgggtctttgctcccgtgccccctgattctggcatggcctcttggcttcacctcacatgccatccagatgctaaggcaaagttttctagttgaaagttgtagccccatgagtagctcctgaaactgctatgaaaagcaaacagcaaacctagagcggtctgtgtgtaaatgtgggcagcattggatccttccacgggccgagtctgtgtcactgtgagcctgcaaggtggatggtcagagccaggccatctgcctggttctcttgcctgtgggtctctcgctgagcctggtctctcatgtcctctgccttcctgggatgcagggtgcttcacccttgtggtctcctcctcctcctcccacaggagggctctctgttcttcctggaccttcctccctctgatcagggttagctacgtcccctcctgccccgtgcctgctgcctccacgcaccctgagctgaggaaaaggtaccttcttttcatgtgtgaaacgtcacagtgttgactgtctttcgaatctctaaatggtctaaaattaaatgatgtaatcaagagcaacatactgtgccctgcctgggacagacacagcacgaagccctgatgtctttccctcaccacagggggtttctgtggcttcttctttctgtttctgttgtatacatatttctacacatcacagggggcaaaacaaaacacaaacatccacagcaatgtccatatagaagcaggccttacaatgacctagctgttctatcctttgaaaaacaacatcccgtttagtctgatgactccttcagaccaaccaatcaccagggtgaaggccccttccagccttccctgccctctccagagtctacacagaggtctgtgtctgaggttccttttgtcagacccctgagctcaggctgtctgggctgttccccacccctgggagatggattacagccattgttcttgaggcctcctggctgggctgaccgcaggggctgagttaggcggaggccctggctccccagaggcagtggtttgcattcatttggcctctgccttgtgtctggaattgatacgttaataaaagccctggtgcccagcccctcttacgcacgcatgcagatttattgtgtggtctgtctgcctgagtgtctgacttattaaagacaacaaaatgggttctttctcatccattatttgaagagaataataagtctctgtcagattagcttcttgggactcaaagctgaatagtggctgtctgtggagctcttgggccaagaactcatctcatcctgaagcgaaaattgtattctgggacatcttaaatactgtactgctcagccctggcagaaagcaagcatgggacatcttaaaatactgtactgctcagccctggcagaaagcaagcagatagaaaccgtcagtcgcacggggctatggtcttctctgtggggcacacttacacagagaagcagcacggtcccttgagctcgctggcctctgcacctgccctcccagggctggtccacagccaaaatcgccagacttttaaagatcaagccacggaggatgggaagggagccaaagccaagggagcccctgggacctccttttctgtcccctcaggaaaatctccggggcagtaagcactattctcccaaatgaaaatgtaggccagagtcctaatccccagggcctcaggatggggctatatttggtgacagggtctttgcagaagtctagttacaatgaggtcattaaggtggccctaagccagtgtgactggtgtccttataaaagggagaccatgggcacagagacaaactcacagaggaggccatgggaggatatggggaataggccacctgcaggcttaaggggaggagcccgggcagtcctctcagccccaggggagccagccctgtggcccctaggcctcccatgcccagagctatgaaacataaacaccttcccagactggggtcctttcagggcatcctcagattcaagcgatatcttctaggttataaattaacttcaagacatgaatgtagactataccttctcagtgtgaggacctgcagcctttgctggttagactgttgtctggggttttgtttctagcacaaagaccctctgggcaggctgaagttctgtcgctttgagtgcaggccctggggagggagcatgcttctctctgtagtgtagacatcactgggcttttgctgaggttctgctgggaagttgggttttgcccacctctggtgccatcagattccttctctgagtcgggggccttggtttctgctgcgacccataggaaacaggcctctgaggtcatggtctctcactccaggggccactacaggtgacctgtgcaaaaactgaaagtcagaatataatcctataggcagctttttcaggatgacttagttcagaggttaagatagataaagtctcaattatccatgtgcttaaaaaagactggtacttgggggtttgtggataggtctccttgcccaaaatgttatatgtatgttgtttagctgcacagagtctcctctgtgggactgttagaactctcccagttatgggcagagcatggctctgtgaggcctgcagttttctatgaaagcggatttataaccccagatcaggttccgaagaaacagcacccaagggatgggctacaggcctcgcagaacattctagtccatcacggggcctgaggagatggcttggttggtaaagtacctgctatgtaggcatgagaagctgggctcccagaactggtatgaacaggctgggtgtgctggcacatgcttgtactccttctcattgctgtggtctgtgggccgctgcacaagctctaagtcaccaagagaccctgtctctgagaacaaggtgggaagaccatgaggttggcctctggcttacacacacacacacacacacacaggcacacacacatgcacacacacgcatacacatgtacacacactgagaaagctatgccagagtgtagacaaaggttcgttagaacaaggactccctttgtatggaagccctgtgctggatgagaggacaccatctgctggttgcccggagcagcctgcagctgtgtgacagtgactgacactggaggcagctggctatggacttgaaaaaaccccttttgggtagtgtgtgtgtgtgtgtgtgtgtgtgtgtgtgtgtgtgtgtgtgtgtatgcagcagcagcattgggagtatctgcttccttgcccatattgggcagctcccagtggttatagggtgaggcctgcggtggcgtccaggtcatactcatgtcaggctgggaaccagcaccagcagccccacctgctgtttttctaggaagtcctttgtttgcagctgcctacaggtaaaggcagataaaggccctcagcctgtgggcaaggtagattgtcacacaggtgtgaactgaaggatggggagggccagccttgggcttcaggcttaggagaccatgctgttttctttggttatctgtgagccacagggcaggcaggcctgtgggctggccaggggctcctctgtgtgtgtgggctgagtggatgaaacagggcatcctctgacctcacttgacctgagcagggcactaaggccccacacgggggctgttgccctgagctgtcacccgagagttgctcttctctggtgaccttggcttctcatttctgaggtcgaaatgctcagtgcttcctggagctcactagaagcatcaggaaaaggcaggaatccggagttcagtgagcccaaggccgatgagaatttccctgcttacttcaggtctctctttagctcttgcttcgccttcctgccgtctgaagaagcccttcaggatgtaatctggttagatggagatccaccagactttcctaatggggggaggaggaagccactctgcttcttgattggtccctgagggccacatccagggtatggggtactgtgatttcaggatgccactgtatccagtgtctgtgtggttcctactaggtagactgttatgtgatgtgatgagcttatgatcacatgtggagtgtggccaaacgtatcagtcattctgaagagaaatagtgaggtcacctacctacctacctcctccagaacagcaacgcactggagggggcatagccagcttgcctggctcttggtaggatcctaatgcctgcctctggaaagggcataaccttccttgacatgggggaggctgagtggatatctctggaagccagtggtcacccaccaggtgcctggtgtgtcccaggaccaccaccaccatcctgatgggtctccctcacctctgtgccacaggaaggagtgttcctcttggtgttgggtttctacttgatattactgccacgtggtctattttagacatagtacctggaggttgtccaagtcttaagtgatacccactagcctttatctgcatttggtagcaaggcagctagctctgggaaggtgtcaagttagccaggaccacacatcgcagctagactctggcagctcaaggtagaatgttgggagtctctggcctctttcttctagtgtggtcacatgagagatggcatctacacataaggacttttgtcagcctccgtgtgcaccctctctcctgggtcccccataattacagaatagtgcagcacccagatccagggctactggctcaagctgtgtagatggcatcagcctttgtttcagagaggtttgacggtctaggacctgcctccacttgaggagcagctggagttgtctgtcactgtgcccacgaggccatagccagcttctcacccagggagggagggagggcagaaaaactgtggccatttctaacgcagtgcagtccattgctccaaaccagtattcttcatgactcataccaggatgtagtagtgccagacgtcagatcacgccagaccacgccagaccacgccagaccatgggtagatgggtaggaggctcctggcttcatttgagcagtagcatgtggacctgtggctttggctccctaggttttgtcgacattctgccacttcctttgaatgtgtcattaccccccccaacccccgtgtcaacctagatgaaaacatgattcctgagactctgggcatggggtgggaacttgagtttattgcaaagtgagtcccatgtagggaatcacccctggtgtctcatgaggatcaagcatggtgtgtgaccaccacagaggtggcttttaagacaggtgggaataggtccaaagttctgaaaatcatgagaggggatggccaggaccctgtgctgtctgagcagctggggaccagccagcatgtgctagagggtgaccatgtatctggtcagccagtctgtcccaggactgttcctgggaggcagagagagctggcaccctcccccagacagccacagtttcactgaggtatacagtgtttgccctcaattctgtgatctgggtctcagttttcttctctttggaatgggatgctggtattgcttcacagatgtggtaaagatcacacacagactacagggcacctgagagcttgacagccccagaaggtgggatgtccacaggaagcatccgcttcaggaaggcagtgccaactgtctcaccgaaatgcagatgtggcatctggtgggagcatctggctttctgtgcacatgtccagcctcctatgaaaacatcatgggctgatgttctcctaacagtccagccgtggctgtgtgtgctcacggggcatcggtgcccatagtcccctgacgcttagtccagcagtgtgctcatgctaatagctatattctcgcagggctactttggcttctccttggccagtttttgtttttttttttaaagaaaatagatttagtatgaaaagtggtgtttaccaaaaagacatagagacagacccagcattgctcaagtctagactgcaggggtgtctctgggtactcacctgaattcctggggacctttggagtctggcctattgtgtggactacacctgaggagtagaccagacctacagcatttctgcaaatagctctctagccaggcacagttggcaaccgtaggccaggcctggccagatcgtctgctgcatcagtgatgctgagagccatgtagatttatgattctacccataacatatttgtgctgggtttaaaaattattcatgagaataatttaagaacatgaaagagttggagaagtggaaacagcacccagcactctcagccagcatgagcttccccgtgtctcgttccaggctggtccatatggatgggtatttttagatagttgttttattgtgtacataaaatttggtctcctgcttaacataagcattttgcatatttgatgtggtctttatcattataatttttaacgaatgcataatatcctcttaaggggctgtaacataaattaactgcttagtggagactattttaagtttcttctctacttgtataagtaatactgtagtatttacgcatagaatgtgttccttatttggcattagttcattgtgaaaactctccagaagcccttgggtagatgtgggagggggggtgaagcccaatctcagggcctagaaagagctgcgcctgcttcgggttggggttctgatcactctcctcagggacttgcaaacactgagcagggtagccttgtcaggatggttggcactctggggaggccagtctttggatcaggtgtgatagatccacctcctattgttacattgtagcaaccaccttttcatcttgccttcctcatcaggaaaatgaggccagcaaaagcacaaacgcattgtgaacgaagactgtgttaagtaaaaggcagaccagatggggaggtagcagattaggctgtgctatttggggctccttcatctgggaccccaactggaagatgctggttctgctccaggacctgtgttgggctggcccctctgctcccctgatccagatacactgatggggaaagccctggatgcactgaagaaggtgtcttctgaagggccaccagggtccatggtggctacatgggacctgatcatccaagatacagtggatctgtttgtgagtgtttgaggctgacatggacagacaaacttctggtagtgaatagggcaggaagcagcatggtgtgataggctatggccacaccagccagggagaccccatctcctgctctgttgctctctgctgcaccctcacccttggctgtacactgtgaagtgctgtctgactgccgagcctttccaccgctttcctgtcatctgttcggaagttttactttattttaaaatgtgatcaactggtatgagtcacagggaaaagcatttgctaaaaaccactccctttcatgtggaagacattttctagtcaagcttttgacatgcgtcacttctgtaatatgaggggatctgcttcggctgagccggaagcccagcacaagcagaactggggccaagagagggctgttggcaccactgcacaagcaggatctccatttataggcagggaatggatgtggatgccacgcccaggtcacacccagctcacccacggacttcaccgatttaccatgaggcccctgcctcagcctccgagaacaggaccggaccgaaagctgaattggttctcatggctcccagacacacccaggtgtgatggctcctgaggagcgtatatttgggctcagagtgtataaggccacagtctctaatccctgccctcaggctcccgggctcctaacatgtcacctagaccctccttcctcaggagatgctctttaaggtcacacattcagtccacagatctgcccagacaaagccaggctgcagcaaggcactgtgtagtcagagactcctactgggagcaaggtggcattgcaccaaggccctgtggcacctctgatcctccagtagtgcagtcagagttgcctgaggtgacagagatcttccctactgagtctcaggagccctaggggactgctcctggcggactgggtctctggcagccatcactcttgcgtgtggctgagagcatttggacagaatgctttttgatggttgtgtgtgtgtgtgtgtgtgtgtgtgtgtgtgagtgaaaggttccatggtggagcaccagctacagtgctccagagggttgagtgctcctgatactgtcccatgagcacacatagtgaaataaaagcacagatgacctttgtcgtagtgtgcctgtgacttgtggtcaacgagtgtatacagagcacattaactcacacctcactgaaccttgatctccacaacctgcttggtacagtgagcatctctgggtagagcagccctctcaaggctgcctgggacctctcagaactgggttttcatctcctcccttaacggctgactctctgcatgggctgtgaagtctgttgcgggctcctcctgttcttcaggcgtgtcccagtgccacccctgtaaggtgaggcaggaagatttactgcttacctctgtgcacacggtgtgcaaacagcttccaaggagatccatggatccgtgaggcacacctgtggtgccaagctgcccctcagcagccagtgatggggaggagcacccctcatcttcaagccgtgctcccatcaggccttgagctcacaagtatagcccagttgctctccgaggccgaggggtcagtgttgctgaggtcgagttgaggaaacctgtaatgtagtgtggtcctcatgtgggggttgggggcctctcccagactgggtgcccccttctcggattagaagcacgtcgtccggttgggtgggtggtttggtgcgctcctttgggaggtttgtaagaattttaggagatgatgaggtatatctccacagtgcaggcctgggggctgtgacccagcctttctgccctatgtctgctccccagtctgctgttttcatctcccacggccacaggctgccccagccacacctctcctgggtgacgggccgtatccgctaaaaccgtgagccagagtcagtccttttcccttacgtggctgcttgttgggtattggtcacaataagagcagccagcagcgaaaatgaggctctgacacagtgagcaggaggtgccttgctctgtctggtgagccctgtctacagagtcctgtcatttgggggagctctgtctgggggaacatgtggggttttttctgctccaccatggtagaaccacctactccaaggactcagaaatagccagcagtccctgcgtccctctgggtcccttggtggaaatacctggctgtaagaggtgtggtctgtatctgggagctgttctgctccgcgagcctggctttgggctgagtggtaccttagtgggtttgggcgtctgagttttgagatgagctccaagtctgagtaagcctctttcagaatctggcgacctggctttttataaacgcaagtgctactgttctgctcagccccggtgataattactgaacagtctctaaatgacgctgacaggtgacattgaggaacccgacattcaggagtattttggggacttgttctgtgcctgaccatatggtctagtagctaaaaggatttaacatcgacaagatgtgtttcaaaagggaagatttcaaactgcctgtttattttctcccttcttccagaggagtatttttatgcctgttacaaacatggcagaagccatgtgtttattgcctccgccccacgagcacagacctgtcactaggcagactccgtcttccttcctcatagcaggagaagcacagtgcctggtccccagcctggacccgtgggctctgagcacggggcttcaccacctggaacattagggcattctcaacaggactgctggtctggtctagatggattgctaaggtctgtagatgcaggagcctccaatcgatcacgggatggcggggccggtgagaacggagcgtgtgaacagcattcttagatgttcgccacacacttgagggcaccacacaaagggattcgagacagttcctgggaccacagaggacctgggggtcttgaatgctacatgctgctgtgaaaggccaccaatggcagccacgggctcacagcagctcgcctagcctcccagttttaaagcccagtgagtagtgagaccctgttatcactgaccctgcctagcaccccagactcaggttcaggctgtatgggaagaaattgtgttgtgagagaaatgctgagagttgacctggctatgttgattctgtgactgccacagactagggctcgattggagccaccagctccggagaccgcctcagcgttccgtctcgttcaaggtgaaatagctggtccgggagccagagtgtttgagaggtcgaaagccctggtgtgtgtgtgtgtgtgtgtttgggagtattattagtcagaaaatttaacaaaccagctatgaaatagaagtgggctcttaattaaaagatagcaccgtgcagcctgccgggccggagtgggctgttttagtttttagcatcattccctccgttgcaaagccaccgtctgctgtgtttatagggtcactgtacagtcatcaccaatggtgggttggaagtttatttataacgcaataatcagaagagctgattacaaggatcgttttagaatcttctggctgcgagaaattgtaaatagggtccagatgcgtgctcaaacatttgtcactgcgtggaggcaggagcgctgggagtctggggaggctgagaagcgttggctaggtggtttggagcaagtgggtcagtgtccatcgttagcatttcccccacccctccccctctgcacacttctcccacccacccctttgtacacccctcccatgataaaccagccctatcactatactgcagaagccaggagaggaaggaaaggctacagagagaggaggcgcctagaacaggatggcttcccgtaaatgcagattatggtcagagcaagtgataccaggaggaaatctttctctgatccagcacagcacatagcaaagcacacacagacagcctagtccagagagtttggctacatggaaagcaggccgggccaccagggaaggtgcctactgccaggatccccatctgcaggaagtgggcttccacagggctgggcccatgggaggtctcctgtttgggttatgcacagaaacactttttgttcacagcaatcggatttaagtgggtagaacgtgcattaagttgtggggctgtggggctgttgtttagtttgatttaatgttgataaatgacagccgattgcttgcccagatgggtgggataaattccaccagaacttatgtcttgctctgcaggctggctccacggcagtcccctgtgagttcctggtgtaccatcagtaggattaatatgccctttgacatattagaagctcagagggcccagaccgtagagatttcccaggagccctggtcccatgactcagccactacgacagtgctgtgctcagcacatggctgctgtggtcctcattggagtcctgcagagattgtcctgcactgtctccctagagcgtagtctagacgtctctgggtgattatgaggattgccctacggtgggagcactccctgctctgctcgctgctgaggtcccggcgtgatggtatcacagaaccactctgaagcagagaagctgtgagaaggtgaagccacagaaacagacgactcactcggtgtctttgtttctccagggtgactggaatgacatcgactccattaagaagaaagaccttcaccacagcagaggagatgagaaagcacagggtgtggagaccctccctccaggtaccgtgtctgaactggggctgggcttccgtggacctcctaattgttaatggtctgaatatagtgccagggcggtggcttagggcggtggcttggggcagagagagaatgacttacgcttctggacactgccctttcctgtcaggacctcggtgtgtggtcagcagagtctatcgagagagaaacagagtagaggataaatgacaaggtctgagcttacaggtcatgaaaaaatttcaaactgacttgattttttttctttttctgttaaagagttttaggttcacagcaaagttggcaaaagatccagaatgttcacatgccatgcatgtagctcccactgcctgtctgtatctcaccacggtgggacacaggaatgggctgtgaactgcattaaatcagggtcaccaccagagtccacagtgaggatcatgcttggtggtatgtagatgccagtagaggccagaagaaggtgtcaggtcccttggttttttaagccacaggaagtgggacatgagagctcaaccccagtcctgtgtaagagcaacgtgccctcttaaccactgagccatctctccagccttagctggccaagttctagcactggatgaccatccactgcctggctctacctcagcttatttttgcattcacttgctgaatggtgtcttggttgcttctaagttttggcagttgcgaataaagttaatatataaatactgatatttcaaaacacagcttctgttccaaagggaactagcagtggctgattctaaacgagtgaccccagcctaggaacatgggttgggtggtccttgatgacattgtctaccagggaagagattctgtgagattttataattgtagaaaagagaaacatcatgagataaggcgttcccccgcgccaccatcaaggacagctgggagacacggcagcagagcggaatctcctagggtttagacagggagtttcagatacagggattggagactggctgtgaggagactaaaggagggagagatgatgctgactagacctgagatgtttgtgtgtggtctcctagaattttatttatgtctaaggcccctttgagttagtttgtatgaaagatgggagttgcctgtctagagtcctgaattgatctggttatgggtgtcagctgttgaaagtttactcttttgctgggtgttggtggtacacacctttaatccctgtactcaggaggcagaaccaaattattctctgagttcaagggcatccaaaatgaagggagggaggaagggaaatagacagacagaaagaaagaggcatgacactgagaccctggaggaaaggaagatggccttcagagagaggaagctgcatcttgctgttgtctccttcagtgctgagtctgacgagtccggagctttgtatgcttggatggagactgtagccatgggatttattaaactggatgcacaatgaaaagacctttctccaggttcaggagaacctgaatgtttatgaggatgtcttagccgcaggtcagtcccaggtgccatgaagaggaacacggatgcgagtgtgtacttatcaactggctcacatcagaggctaatgggtggatttgaccggcagcaagtggagtcctggcactagaactctgcttgggccagatgctgagaataaactgaagcttatttatttaaagttccagatgagttgctgtggaccagtggttttcaaccttcctaatgccatgacccacaaccataaaattatttcattgctacttcttaactataattttgctactgttacgaattgtaatgtgagtatccgatatccaagatatctgatatttgactccagggaaagggtggttcaacccctgagggggtctccacccacaggctgagaaccactgctctagattctaaaagatgaaattgttttttggaggttttaatgttagtaaactagagttattttcccctccattttacttcccattcctgcatttcaaagttgctttcccccctttcaagacttgatggttaatagaaacaatgtttcagacagcagggatccagtgtgatacttcaggttttccctgaacacttgcgtttgtcattagagatgtgttttttctaggtatcagggatgcaatgtccatacttaaatggggtgacggggagctggagagatagcttagccagtaagagcactgactgctcttccagaggcccgagctcaattcttagcaacccatggtagctcacaaccatctgtaatacccattgctctcttctgatgtgtctgaacacagctacagtatactcacatatatcaattttttaaaaaaaggttatgtgtgtttagaacaaagcaaaacagtaatgtacaaggcgaaatgcttttggataagtataagcctactgtatgacctttcttaactcgaactcttggccttaaatagtcgactgtttagatatttgtacaaaataaaaaaaattttttgaagagctaaaaaataggctgttgtgtgaatatgtgtgtagttgtctatgtacacgcatgcgtacatacatacatatatacatggacacaaaggagctgtctggctctagagtgttaaatctgccctgcaggttaaaccctccattgcaatggctgccttaaggaggttactagtcctgtacatatgtacatgtctatagctacactgcttcccagtgataacagccctgggaagcgtgctgcagtctaccagcatcagaatgtgtgtgtgtagcttgtatgtccacaaagctgctgtggatgtgatgtgagccatatgaagggtaagaagccgccgctcccaattagcctgctgggcactcaggttaaacaaccgatgcctgttagggtaggttggtggttggtaggttggtaggttggctggttgatggttgataggttggtaggttggctggttggtaggtaggttgtgactggtaggttggtggttggtaggttgactggtcggtagttggtaggttagtaggttgcctggttggctggtaggtcggctggttggtcggttggttggtaggttggctggtaggtcggttggtaggttggctggttggctggttggctggttggttatttctgttcaattgctacttgtattatggaaggcaaagcatttcctttcaatagtctgttatctttattaatgtcccccccccccaaaatgttataaaaatggaacagatctatagtttgggggcaaaatgataaaattaaatgtgtaggtaatctatttatatactgctataaagtattttctaaagaaagatatgcaaagaagctattacctatttcagatgtatatttaaagatttcttttacatcctagataccgggatataaagatgcacagatatatttaaccataacatactgtgattcattaagcaacacaaactttcatttcatggagtttatctgttaaagctgatttaaactgtgccttgtcctatcatgggggaacatgagttctggggtcagaatataaggaatttgaactgatgttgacttaatttttgctgtatcatcttttcacagtttaccttttctctgttttctttcctttgtcaaaagtcagcagactgtgtgtgtgtatttctggggtttttattcagatcggttaatatattatgtattttaccaaaaccataattattgcaactttatagaaagtcttaaatttgggtgacgtcagtccctgacttcattttttcttctccggaatggcactatcccttctggaccttccactgttccacttgaagtctagtctgtttatcgatagccacacagtagctcactgagactcgtattggtgttgcactggatctgtagatctgagagaactgacatctgacagtgatgcgttccctactcacagacgtggtgtatacggccacttatcctatttttctctggggtctttcatcaaagctttgtagtgtccttctaacagctcttgtgcatagttgtccagatttgaatttaagatccctttggggagttccagggtagatggtactgtgtttctgacttttactttgttcggtgctgatagacagtgacacgacctctctctagtaacccggtctcgtgtcttgaagtcttgctgcagttgcctctggatggtttgttgttgcttgtctcgtactctatatacaaataaacatggcctttgtggacaaagatggttttgtttcctcctttccatccatgtagctttccttcttctttcttgacttctctgttcactaggattcttggtgcagtgtggaagaggatgggcctctcaccttgtctcatcagtgagacagtgagtcctcatatttgagctgtgcacttgtnnnnnnnnnnnnnnnnnnnncatatgtttcatggaaaaatgtggtctgtagttttgttttcttctggtgcccatgactttggtgttaggccagttccttccagttcctgcccacaactgctggatgcccaactgaggagccaccgagctcccagaacccactcactcactcagcccacactccctgcagaagtaggatgttcacagtaagggatcctctgcactctgacgtgctcccaggggttgtcctctgggagcagggtttttagcaatactggtagatgaattagcgatactctggagatgactgaagtaggtggagacagcgttgagtgagaaccctgcagtaaatgtgactgtttctgtagagggcttaagagggaaaaggaactgcaggctagcctgagctacgtagagagacccaatcccccaaacaaacatgcaagcaaaagaatcctgcacaagttagagaagactctttggagattcactcttgcagatttggagctgagcaaaacctcatggatgtggagcagctgcctcctgccctctgtggagctgctcattcgatagcatcgataattctaagccagttctgtgcggctctcctggaacatctggcagctgcttagatcttttgatgaggtgcctttcattgctttgaatttccagttttttcatccctaataatgagttattttaggaagccttatttcaggagaggttccctacagtggcgatctgccacagcagacacccagcaatgctatccttcgcattcttcgctgtgagggctggcttgcttgctgccgtcttggccttcccttctgggctgggcgctcgttggagcagggacatcatgaggtttttcttttaagcagaggaaaattaggttcagtttgagatcagccatggagttgaggggcttcatagcatggtctctctttctgtgggtttttggctcgcttgcttgctttcccatgctgtcccaggagaaggtagtgctactccacacaggtgctctgtccagggggctggcatttgcttgagctgcctttgctggggagcccatatctgtgccgaactcagagccttggagcccctatcttgcaggctcctgtgtattgcagacacctgtggtgaccaagcatgcacccctcctcaggagcatgagttgggtaccccgcccttgcttcccaaagcctctaagcccatgtgcatgtgtatatcagtgcctggtttcaaacatgcacctagccatgttagtnnnnnnnnnnnnnnnnnnnngtctttcatcaaaagctttgtagtgtccttctaacagctcttgtgcatagttgtcagatttgaatttaagatccctttggggagttccacggtagatggtactgtgtttctgacttttactttgttcggtgctgatagacagtgacacgacctctctctagtaatccggtctcgtgtcttgaagtcttgctgcagttgcctctggatggtttgttgttgcttgtctcgtactctatatacaaataagcatggcctttgtggacaaagatggttttgtttcctcctttccatccatgtagctttccttcttctttcttgacttctctgttcactaggattcttggtgcagtgtggaagaggatgggcctctcaccttgtctcatcagtgagacaatgagtcctcatatttgatctctgacacttgtctcagacatgagtttgctgggagtttctgtcctgaaggagtgctgggttttgtcgggggcctttctgcatcgttggatgtggtcacgtccacacttttatgctttgttgattgttatttgtccagccaaccttgcataactattttaagtcccacctgtagaatggaatttcttttgtacattccctgatttaattcgctaatgttttgttgaagatttttgcatatgttcatggaaaaatgtggtctgtagttttgttttcttctgatgcccatgactttggtgttaggccagttccttccagttcctgcccacaactgctggatgcccaactgaggagccaccgagctcccagaaccactcactcactcagcccacactccctgcagaagtaggatgttcacagtaagggatcctctgcactctgacgtgctcccaggggttgtcctctgggagcagggtttttagcaatgctggtaggtgaattagcgatactctggagatgactgaagtaggtggaggcagtgttgagtgagaaccctgcactaaatgtgactgtttctgtagagggcttaagagggaaaatgaactgcaggctagcctgagctatgtagagagaccctatcccccaaacaaacatgcaagcaaaagaaccctgcacaagttagagaagactctttggagattcactcttgcagatttggagctgagcaaaacctcatggatgtggagcagctgcctcctgccctctgtggagctgctcattcgatagcatcgataattctaagccagttctgtgcggctctcctggaacatctggccctaataatgagttattttaggaagccttatttcaagagaggttccctacagtggcgatctgccacagcagacacccagcaatgctatccttcgcattcttcgctgtgagggctggcttgcttgctgccgtcttggccttcccttctgggctgggcgctcgttggagcagggacatcatgaggtttttcttttaagcagaggaaaattaggttcagtttgagatcagccatggagttgaggggcttcatagcatggtctctctttctgtgggtttttggcttgcttgcttgctttcccatgctgtcccaggagaaggtagtgctactccacacaggtgctctgtccagggggctggcatttgcttgagctgcctttgctggggagcccatatctgtgccgaactagagccttggagcccctatctcgcaggctcctgtgtattgcagacacctgtggtgaccaagcatgcacccctcctcaggagcatgagttgggtaccccgcccttgcttcccaaagcctctaagcccatgtgcatgtgtctctcagtgcctggtttcaaacatgcacctagccatgttagttctgtaaaaattcatcagaggttgatgcaattcttctttcaaggatagcatttaattaaaaacaaaaattttataaagaaagctctgcggtcttttcaaattcacttgtagatgaattgttagaaacttgacatcaactttcctttggccccgaggagtcctctgttccagtctcccaggcccagatcttggtagatagcatcccagggcctctgttcctgtgtgtagcaggcctatggatatggctgccagctgctctggccaagggaagttgatgtgggaagtccttgcactgaactggggagtccaaggatcgcagccagaggtgtgactcatgagccccacaggaggacctggagcagaaagagaagcctctgcagcccagccatgtctaactaagatgtttagttgtagtccagacctgcagtctcaacgtcaggaggcctctccaggagtcatcgtgggtaaagagtggaggaagctgtgagtggcctgagggtagacagtggccaggacaagatagcatagaatggcccagaagacaaaggcaggggtttcctcctaacagcaccattccttgggtcacctcttcatggcccagagggactcatcccttgtcttccaagggcgatggtggtccaggctcaccctttcctgactcagagctgttgtttccattgctgccatctgtgggctgggaatgacaggcaagggtgtccccacatcctcttactgttagcccagcccctcctccagcttgcctccattggccatcagagtccacagcagtgagtggacaggagaggaaggctaccctctctctgtctcatgtacctggggatggcattacagagagctttaaggtctctgaaggaagttgtttttatcctgaagaacctaagctttgctcataggcttcctgtttcctgactgccagttggccgtctcctggtctgctgtagagggagagcgagtgccagcgtgaagctgtgctgtgctcttccaagtcatactcggcttcagctgctcgttccagggtgagaccaccgtaggaaagcagtgatcaatcagcagggtctgtgacatgttgggtacctaggatgttaagagtaagaactagcaggtggccagggctctgaccaaggggttctcatcccatcttacggggagtgggagactggagtgagctatgaggatgaacaggaacctcatggccagcgctcctcagagggcgtagtcttcaaggtggccttgggctggttgtgcacaattttaagagaggcagggagccttgctggctgcctgaggcttgagtaaggacctgccagcccttcctgttccaacccaggcagtggaggctgtacatcactcttccctcctgccccactttgagacagggtttttgtgtgtaccagccccagccgtcctggactcgatttgtagaccaggctggtctcaaactcacagagatccacctgcctctgcctcccgagtgctgggattaaaggcatgccctcactccctgcagtacctcatttttttttttaatggctggtttcaacatacacatcagcatacagctcagcccagaggtcatgtctgagagaagtccactcatcaagcaaaaccccctgatgactgttttcacacccccggccagtgagtacctgcttcacaagcggcttgggtgatgtgccccgtccttctcatgatgtctacatgcatactttattcccgatgcctcctgtgagatgttatctcaggattttccattagcccaaggtggggtgtcggggaggggggctccgactggcggctggagcttcttccttaatcctatttccaaacctatcaaaagattgataatttcttgtctgaaacttataatttctaaaatggaacattttaagacgttaggagcacaagtagcctgtaaataccaggattcggttcattgccccatcctgtggctcgttctgcctggttctcagctctctgtacctggctgcctgcctgtctgtgtgggttgggctcaggtgtaggcctcacttagagggcagggccaggctggagtggaagacaactgagagatgagctgttctgttcccctgagctggcctcctctgctctctgcggtctgtgccccaggagtctccaacccgacaattctgcaggatacagaccaatttctacaatgttcttgagcccagtgtttttcagattatgggttccaaaccattattagatgatgaagtcaattttctgttacacccacgtgaaaacatcagctgcacctgtgcccgcccgtcctccctttgccgaggacgggcgttaactgtgaggctctagccatttgtaggactgcctcacagcttctgagggctgaggtgatgcgtgccatcgtgtcacagctagatgggtctgcaggccccctccgtggcattctcacaccctactatgctttctgaaagcaaatggtacaacatcacagcaaggtgggacctgtgtccagctgcaggcagatggtcatggtcagagggaggagctgctggagagtcctgacagtgattgagggatcacaggagctcctgacctcagtgcagacaggccttccgtggagctttctggtccccaggttcagctatgcttccctagtctgtctccctccccctcagaacatgaacgcttcagtggggccagacatgagcctgcctttgctcatctgcgcctttggaactagcatgatacccgcctgtgaccagtgcctcagagaccccgaggcaagtgtgtgagaggtcctgcaatttcatggtctgttataccacataaaaccttctccatgactacatgtcaccctagagaagacataggactcttgactctagtgaaagtgcccacaggaaggagctgaagcaagactgactggtgaatgtctgggggaggcgcaggctattctagagccttctccctaagaataggcctgcatatgaggatgactgggtcctgtctgccatgctggggtttctcgggcagccacactgttcactgctccacaggctgggtgtcctcacagctgcagagagtattcctaaggaggcctcacaggaggctgtgcaaacaccctgtcttaggctgtggcgttttctacactgtagagatgtgcccctctcccgatggccagtgattctgctgacagcagtgggactcagggaaggaacgttttaggcgtgttgagtgcgtgggctgttgcaggagtgagcagtgaatacccatagcccaggggtgtttagcctcctaggaccctcttcacagggagcaaagggaggagggcatggtgattctagtgaggtcagaacagtcagcagagctgggcgtggccgcaggagcatcatcctcagctacctagtgagtttgaggatagcctgggctacgtgaaatcgatcaaccaaaagaacagtcagcacgatgggtggtctaagtctagcatccaccttgcccttccctcctgccactcaccatagcaccatagccattgactctcctggagcctccatctgtaggaggaggcctagagtctccctctctctctctctctctctctctctctctctctctctcacacacacacacacacacactcttcccacaccctcagcactgtctcaggatagccttgccctgggctctggttttggactcccaacagtccaaacatttatcctgtggcgcctgattgcacagtggagtcttttattaatttatacacacattgtttcctttgcctgacggggattgtttggggacatgaccaaaattcctgggaaggtaggcagacagagaacacccccttcccagaactccatggcgcctgagttgccgactgtcttgcgaggcactgagtgaagtgtgtgcttgggctttcactcttgtcttgcagagtcttggcttccatgtgacgacgttcagggccctctcagctactcttgattacagttgtcctcctgtgaacgagccaaggccactgtcgctcaacctaacacttgctgccgtctctggcgacactctggtctcgtgtccgcttgtcccacaccctctgcttcgctttttccaggcaaagtccggtggccagactttaaccaggaggcatacgttggcggtacaatggttcgctctgggcaggacccctacgcacgcaacaagttcaaccaggtggagagtgacaagctgcacatggacagaggcatccccgacacccggcatgaccagtaagtctctgcaagcatgcggggagagctggagaatctcctcgaagcactggatttcctcacccaggtgatggtggttgtcagagcaggcaacatcctggagtgagtgaggctcatggctcttggccttctgcaggggcggcaggctgttggccagcagagaaagctgtatgggccttgtgcttgctgatcttttagtatttttaagctgcactcataaaacactttccacagtcttggaaagaagaaaatctaacttcctcttactggggacagctgtagttaggaacattctggaaaccggagaagagattaactaaggtctcagaacagggagggaccaggaggacaggagaaggtgctgcacccccaacactgtggagaagggccgatttcaggcctcgggtgggggcaccctgactccgctgggctcagctcgaagcactctcagacatggagactattctgccactgcttacaaggaaaggggtgccgaaggccttggtcatttcccccacatctgtctttatgtcccagagaaaaagcaggggcactggactaggaggtgctgacgacaaagccagaagggcaagcgagcgtctatttgacaggatcatagtcccctcagagaccggctctgctggatttgtaagggagtttctagattaggttcattgccgccgcgggtctcacctcacaggagcagcataagtgtgagctggggtcccaggaggaatagaaactggaagctagccgagcttcgactcctggcagatgtaaggtgcccagctgcctcacgtttctgccgcaggagtgccgcgccatggtaaactgcgcttagcattgtgagccaaaatgcacccgaatttcttcatgttgtcaggttattttttttatttttagtcacagaagtgaaaaaagtacctaatctgggctctcagcctcaggacagagctcagcagtcagggtgaaatgacacctggctatctgagatgactgaagtttgagctccgtgtgaccggtgagctttgtcaccagctggtgctagctggctttcccactaagatttcaccatggcttgctctcctttgagcaggaaaaggtgtggtttggggcttgtcggcagggggctgggctctgagctgctgcctctcctgtgagcttctgaaattccctcagactctgcagacggattttctttcagtatttctggaatgattgtttacccaaactaattttcctcccaggatgggttgatttctgcctggtctgtgtcggtcggcctcctttgctgtgttgaagccgtggcagggtgtgtgtgtttccccattggctgaattgggttaaattaaatcctgacaggcattggccacttgtgttggccccgggaatccatcacagggcatcagcggaaagtatcaggctttttcttcagctccctgaggtttctatagcagggacgccatgagcctttcgtgtgagagcctggctttaactctgaagacctcacacaacagaactcagcctcccatgtctgtggagctggaagcagaccaatgagagcagattcaggatgagacacccagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgagatcccatagccttctggcaccaagtcgggctcagggttcctctgtttcactttatcttgaatttcaaacattgggactttgaaatatgcttgcatctcaaactaaaaggtggttcagagattatggtgtccttctcagttcccctccccaccttcccatcccctgaggaggagcatctaaagagggtccgccctccttacaaacaaacctgtctgttcagcaggcttccaaactagagtatctcatctttgctcagtttgcacagcatggttgctctgctctggcagagagatctgacgtaaacccttcagaaggtctggctgtaaacagagctcacacttggggacagtacgctcctgagggtgtcactagcttcaagcaggatgtcataggttggttgggtgttggcatgctgtgtgtgcttgctgtccctgggtcatcagcactggccatgttcatgagggcctggctgggactggaactgtgtgttggtcatcgccccaactctactgctgttactctgtcaagtaaacacgctaatgccaagagtggggaagctgtcacaggagcccgcccgccagcacagacggaggcccgtgagacctaggactttccagtgtgaggcttaagacctgggcgagggcagtgcagtcctagagtggctgagcaaccagaggacccttggtcttcagcatcttatatatgtatactgctggcctgacatacttccattggcaggtgtcatctctctggtggggatgtcacatgaggtctccgtcctggctttgcttcctgcacacattctcagaccttctacgtgacatgtatgaaggcgcctctggttcactctggtgcctctgtcagctctgacaagccttgtcatgtaggaggacattcagtccttgtgtttgatgtgaactctggagtttaaggccagtatctcaaggtgtgccgagtcctgcttgctatacgttctcctcctgttctgcctctgggtgtttctcttaccagataaaatatcagctacgataaactagcagggttcaagctgagagaatgttacattttgaacagcacacctcaccacccaatttatctttctttataagcgcgcgcgcgcgcgcacacacacacacacacacacacacacacacacacacacacacacacacacacagtgtaatttcagcaaatacccttcatatccaagcctttcttcccattctcattccttgttcctccccatccagccttggccacttgtccctcggtgtccctgaagtaagcgttcacagtggctcctcttggcaccagctcagagcactagatcctattggtgtgtttcacttgtttctgaggtcctcccccagccccagctgagagtgcaaacctcttggttggccgttgcttttgcatctttctttgctctcagtcactgtgtttcccaccgttcctggtgaagatagctatgacttgttctttatggagcagtttgtctttgcttatagttgtactttaagatacttctctatgctttttagtaatttgtaagaatgtgtggacgttgccttctgagacttgagcctgtttggggtttgaagggtctgagtgccggtaacttcctcttccacccttgtgagcccctcctctgtccccaaggcccttgtcacattcttgttgggtattcccactggccctctgccctcttgcattctcattgtttattcctctgtctccatgcaccctgcttcctgcatgtattaagtctgcctgaaatccttctgtagacagagaacatgtagaattgccttgttctggtagtgaatagggacagagatactcgaaaggctatccctggtgtttccatcccccaaggaatataggctttgcagataacgtaggcagatcactcttgtgccatgcagaactgaaccacgggttgggtttctgttgggtgggagcagtctgaagtgtccaggcctttcttcttctaggaagcgctcctaggattgccaccctaatctcagtcccattgttatcagcaagtcctgacttgggtcctggcctcctctccacaaggccattgctctgttggatgtattctgcctggcaggtaaggggagggcagcagagggctggcccctctctctctcggggcatctggctgcctgcagtctctccagcacttccaaggcagtttccgcatctcatccctgcctctctgctttccgtgagtagttttgtccagagcaaagaactttattgtctctgaatgcagaggaacacctgagtgtttcatttagttctaatttagctgggaattcacagctcctgcatttcatcctgagcagaagtgtcatgaacatggggacggacggcgtggacgtggggacggacaccatgactctgttagtagttctgtcacttgttactctcagaccacggtgaaaatgatctctgaccccaggcttttatctgcagagcagtcacagtataaccgtgactgtccctcggctgtcagtaagctcggacatctgtggaaatacggaaaggcttgtgaacccctggcttctgtgccggtgttggtcattgctgtcctgtgaccagtggcttgtgggaatcaggttgagcagaccaggctgtgctctgggaagctttgttcttgactcgtgtggcacgccacgccgacctcgaggactgaccctgggtatgctgtgttgcttcattgctgtgtggctctttctgtagcagatcagcagaaaaccaggttaaggaaatacctttgaaaccatgacctgcctactactgagggaatcagagcagggaaaccagactcagcaggctggccggataaatcaggtcaacccaggctggcccccgtcggctgcccatttgaaagccttcacttcaccatcgccgagcagcccctggtgtatacgcgtttgtttgcaatgctggaattgaacccaggggctcatacatgctgggcaagtgtcccccactagggtacatctccagacctttttcctttttattttgagacagggcctcacacacttaccttgactgattttttaactcactctatagcccaggcaggccttaaacttgggatccttctgcctctgccctctgccctctgccctctgccctctgccctctgccctctgcccagctcggcttacaaatacatagtggcaggcccagttcttttgtctttgaaatggaaaagcctcgtgtagtgtatgaaggtggcagaatggcacgatacctttctgggtcaatggcctacactctacggttggtcacgtgatacagtgtctcttgctgatcagcagtcaaggacattgattaatgaatgatcctgtctgttgcttgttgcaaaccatgtgccctagagatactggaccttggtgataaaccccatggttgcccagaatcctcacttcagtctaaaaatttaaaataatagccatttaccttaatgatacccaaccaaccaaccacaggaggctggtgtggccagaatgtatgtgcatacacatgttactgtgtgcatgaatatgtgcgtgcctatgcacttgtatagcgaagtgagttcagaggcacgttgtgaggacattggcttgccctctctgtgtaggcccatttgtgccatggtcacagaaggccagtgcttgccagggtatcaatgtgtctctctgttccagagatcgcagggcagggcctgcgggtttgctgtctggagaggagctggtctccgctcccaggattgccccttggctgctgtgtgctccgggagagggaagcagaaggtggaggggtcgaacttcccgtggaatgatgtatgccaagagccatggtgcctgggcttgccccgtgcgcctgctcgttcctctcggggctggtgcgtctggcaccagtggcagagagaacacggcacgtgtctgacaggacactgcagacacacgggcatgcaggctttcttccagcatgtcaggcccctctcatgcgttaaaatttgctaccaaacgtgaagagagttgtccacccgtggccttttctctctgttatgatgtagccgtgggggactgggtccttactaggtgctgagaaggggagggtccatgacagaggatctccctggtctgtgcagagcagccagcatcacctctaagggggccgcggccactaggaaagctgtggtttgggggttaccttgaggtctgccttgccatctccctgctcatggctgttcctgtgactggggtgctggctctctggccactagcagagtccctcggccgcccaggactccagtttcctctgttgtggcgccggaggctggcacacacgggtatcctcgggcagaagctctgtgtcctcacctgagggcttacttcctgcatcatgcttggccttagtggtgccaagccacaggagtcagggtaatataatggcaatgacaatattggggacaagcgtgctggcagccaccactgctgctggacgtctctcaggcagatacgagctggatctgccacatcttgtatggaacagccttgagttgcaaaccccccttgtcctcctttctttaaacactcctagtttcttagactgccttttcaattattattttgagggtgtatttttttaagtaggtacatctattgtattttataaaaagcaaaaaggaaaccacaccagaaagctaagaagcactcacagcctccgaaggcctctgaaggcctccctcctgacttgtccttgtcctactgctgctcaatgccagggaagcccagcgcccatctgcctctgagcctcacacgggaagcaattcctggggtccttttgtggccatagcttccactccgtgtggctttgtgccccccagtttatgctcatgcacgcatctctctcagggtagacgaggactttcttttcttttgtccgtactgaccacgttgggtgaatgtctttagtcatatcttttgctgattgatttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgtttactagccagtccttgctttttttgtccctccagttggttgacagaatttgttttctacttataactcaattagttgccattttcagcaagagtagtaattagacaagtactggtttaatactaagaataaaactctgcccgttctttaatgaggagcacatatgcttgtctctgtcccaatccctttttgttctgtttgagatctgggcattagatagattatgacagtcatcttaatttttgtgatttttttttttaatttgtgtgcatgagtgttatgcctgcacgtgtgtctgtgtgccaccgtgagaacagtgccactgggttgtgagccatcctgtgggtgctgggaatttatcccagttctctgggagagcagccggtgccctggatcactgagccggctccccagcgccctgtcgtcgtccttccaatagtcgccatccttcttccagagagtttagtctggaggatggagaaatatcacctatgtctctcaagaggacgcaggtttcattcccagcgcccacacctggcggctcacaaagctccagggaatcccatgccctctcctagcctctgaggatgctgcatatacactcacatacacgtagagcattttcatttgcacagtgttgtacacacaggtccaaaactgcactggtgtgaggtggtttcatgcttcctcctgctttgtaacttgttgcccctttaagttttttttttttttaaatgtgattacacctttttgatgttatttgcgtgcgggtgcacgcgtggcagtgcacatgcagaagtcagaggacagcttgaggttgttccactgcctggctcccagggactgacctgcatttgccaagcttggtggtaagcgccaagggttgagcagctcatgggtgctgcctgaagagatggggtagtgatgatgtcctgtctatagcatgaatggtgacggccacctccacgcacccagggattaaatacctgtctatccttatctctgaaaacagaggatccagcatggcctgcagttgccagctgatctgtttgacaagggcagaacattgaaggcatctgtggtcaggcagttcccagacctcctgctgggcagagctcaggatcttggccatccgctccatgtagggagaatggccactctacagagctccgaggctctggcattcggcctggaagagataagcacaggggggaacgtaagctgctcacccaggcagttcatgggaaggttgccctggagctcagccacttggatgccagaggagcggagcaaacggaggcatggatggctccgtgtgaggcaggactgggccatcccacgtgtggaagctgtagttggaggatatctgcagctggggactgaggcaggcatctggggaacccaggcaggcatctgggggacccagacaggcatctggtcaagcaagggaaggagtgcattgtggttcctgttggctgctctgcagctgaactcctgggagagctctgtcatcaggaggaatgagtttaaagggacaggtcttgctttgactctcaggaatggctgctggtgaggtgttcttagggagattaagggagcgctcacagcactgtgtaaggctgttattttctcaaagttttccattaaaagctaacgtctggaaaacggaaggtggtggagagtgggtgatggtcctgatgaaagagtttcactgcctcctgcgacagctcagcctgcagaatgcaccccatgaggcgaggctctgcgggttcagacttcctctgtgagctggcaccacctcccaggctgcccagcctgaagtgtgccaggccagctactggccccgtctgtgcttttgtgctgaacccccagcctcccaaagggcacggagctttccgaggcagggcggtcagtgaggcaggcagcgtcttgtgccatgaggtgatgagtgctgtggttttgaacttggctcctctgatgtttgtggtatgtggtgccaggactatagggcgtgagaaagctgttttaggttaataatggtgacatgagataaacaaacccagggtgaacagggcttgtcagaccctggcaaccagaccttaaggagcctaatttcagagcagtctgcaaaggtcattaagtattttagggttcggctctctggtgttagaagacccagggcattctgggtagatatcaggactggctaggagccagctgggacctggatgtccgtcttgcccctgctgttgggagggccactaagcattttggttaagcaagcattatataacagctagtttggttcttttaactgtttttttttttttttttttttgatatctgcctcaatttctaattcagaagttatcaaattgttcacctaggcttctggaaaattccatagcaaccatcttgaaatgtagagctgtctgtgctattttgctgggcagagcttgagacatgtatctagctcaggtaggatggggtggggctgtttccagcaagcccattctgtgtatctgactgcggctgggtctgccgtatgtgccgttggctgtggttagaggcaggaactctgcttctgcagtatgctgctgccatgaatagcatctctccacacagtgtggaggtctctcaaaacaaaaaaaacaaaaaacaaaaaaaccacaaaaccatatcttctgacgacggagccataccactcctggggatttacctagaggacattcaagtcaagatcacacagacagacacttgcacattgacaattacagcagcggtagtcacagcagccacgttacagaggcaggccaggtgccatcagcgtggggaaaggcaaggacactggggttgttttcagctgtaaagaaggagccgtcatgccatttataggaaaattgaggcaatcatattaggtgaataagccaatctcaaaatgacagacatcacacgctttctcttatttgcggatcctagactttatatagactttatatacataaaatcatgtatgtatttatgacaggaaggtagaaatgaagccgtctaggttggaacagaggaggcgcttgggaagggagggagaggtatatgggaaacaggcttaacacaactacatgtgtatatgaaaacttaaaaaatagtttttacaaatgagtctaagggtagctgcctcagcacagcctggggctctttgcctggcctgcttggttacaggttacaatcagtgttccgcagagccaggcacctgcatgtgactcagctctgggtatccccggtgagcctgctatcccctggccaggtctggctttgtgatggtggtcagctgtctgtagctttccagcagctactcaccctggatgccagctcaggagtggggaacgtgtttccagctctggcttggctagcactcgggccacacaacaggctagatgactgttccagacactttggaaacattgtatcaattgccaaggcagccactgagatgacagatctgtcttcccccagctgagaggaactgtgggtcagaaggggtgggggtgggggtgagggatgggattcgggcttccagctagccactgcctctgctcagggcctacatcctcccagtgttcctgtgaaagcagtcctcactgcacttccgtgccccagctgggaagctgaaggatctaccttaagttcttcagggttttgagacttctgattgttagcatgctgtagagactcacacatcgtccggtgagtggcaaaggcagaaatcagaccagccacagggctcccagctgcattatcttcccacctcagcagcaggaacagacctcagctcagggcagagtggggcacatctcactgtcttcacagagccaggaggttttccctgttcccagttcctcttggcagaatatagaactccctacatctccaggtgaggactaaattcattcaagtcaacttggttctttatatggggtagcctggtctattccaactcaaggtgtcagaaccgcaggataaccctgaagcagaaggaagtgggggagggaggcaaagtgagcaacccagaggaaacagaggactgtgtgcagcttctctcagatacgcccccaacgatctgtaacaaaaccagaaacctcggataggttgtgtgttcatgagacacccagagcagctaagataataagacagttgcaggtacatgtctacgaaaagaaatgtaaatggaatagatatttttctaggaaaatattaccaaaatcactcaagaaatagaaggcacgagctgggcatggtggcacacacctgccatctcagctcttggaaggggagaagtgagaggttgcgaggccttgggcttgcggtggggtgagatgagagcaggagcgaatcacggcaaagggtgaagagcgtggagtgactcagtacacggttaccggtgctccttactccttgacggagaataggcagggacagtgtgtgtgtctgctcctacgtgggaacctgaccacagcagggtggtgtggcaaagctgtgtgcccaggcgagcagcgactgtgtgtcctctccgtcagctgagtcctcggaggttgataccatgctgtttaaggatgtatatatgccttttctctgtgtgattagttaaaagcatacctaggagtgacagcgcaccaaatctgggttagaggttccctctcccgacactgggggttggaaagggcctgaaagggtggtaactgttgcctgtgagctgccgtaaagacaggaccacagagtgaaggccctcctgcttgtcactgtccctacatgagccagtgagctacattactaatgtcctgacgtctgtcttaattagggttcccattgttgagaagagacaccatgaccaaggcagctcttagaaaggacaacatttaatcagagctggcttacaggttcagaggttcagtccattatcaccaaggcaggaacatggcagcatccaggcagacatggtgctggagaagaagccaagagttctacatcttgttctgaaggcaaacaggagaagactactgtcttccaggcagctaggaggagggcctcgaaggctacccccacagggacacacatcctccaacaaggccacaagtagtgccactccctctcccacagccaagcatattcaaacctatgagcctatgggagacattcctagtcagaccaccacagtgtcacacggggtgagaagaaacccagggaccctcatcacccttctgaccgtatcgttgctaggacttgaccctccccttgggtatgtacatgttctggccggtttcttcctgtgtaacctcagcttcacccgtgtgatgcccgtggataacgccaggaccagtaacatgtattactggccacagtgacatgtattaatctctgcaaatgacccaacggcatttaggatcatccagtgtatgtctgcagcatccgtctgtccctgggagtcagctggagctttgatttaatgtcagaaaaaggaaagccaagagaaaggaaaaccttttgtatgtgtgaagtgcgaggcacatccaggagaggcaggatccttctggaactctttagctaaactaagggttttcaaaatcttttaatttaactttttaatttccatacacacacacacacacacacacacacacacacacacacattgtatttatgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattttagtggacaggaagcttccagaatgacagtgccagtaccaagtctttggagcctctagtgaaccagggcccagagtggggcttctgcgtgtgtctgggagaagagactccagctgcctcgttctcttgctgttgctcgctctccatcctgcttggctgggaggaagcaccctacagctgatggacttgtagcagctgccaccctggttcccactgcctccagagcagctaagactggctgacagggccaagcaagactctttaaatgcaaaattaattgcttctctttttaaagcggtttggttcctccggggcctcatctgggttgagtgtgggcttatctggatctgtgcgcacactcgctccacccgtgggctgtgagagccttcagctcgcactccttaagaatgggatctcgctgaagctcctgagtgcccagacctgagcctgagccttaggaatatgcagaggagttttaataaaacgctgtgtggcagcagcctgcttgttccagcaaatgcttccagagccccaggagacttccaaaagctcctggaagatgagcttcctgcagagacgaggagaatgagagactggggcgtgattggatgggcccggaatccagcgctctgagagtgaaaaatgctatctatcttctcatggtcccacttggccccgtgggtccctggagtctcccaacccaggtctgctggctcagtcactcctgggctatgtggggacccgggtacagagggcagtgagcctcgaagcatggagcctctcccccttacagcattacagattggcctcttgacagcgaagccatttggtaatttgttcacagctgaaacttgatagatttttcgttcatctaccttcctgctaatttttatcaattggcttgtccatgaaggctcatctacagtgagatcagatgctaactgtagaattcgttccctgactccccacaaacaactgctatacaattttttgtgtgtgattaattaaaaagaatgtactataatgactaaaattaaccgacgacaccccttctgcaattgcagccctaattgctttataattgtgctgcttttcttgctgctgctcacagactgcagggctgggctcctctcgacagtcctggggaagcactcatctcggggcacctgccttgccctctccacacctctctactggtgtctggcggctgctatgccagcatccagctcactgctcagcagttgagtgttgagccctgactgagttccagggttcttccagaatccacctcctttcccactgatttccattcaagataactgggggaatctgatgagctgcagggtaaactgagtcttcggtgtgttggacccatggaaggctctgccacttgaagagatgataagggcaaggaggggtccagaggcagggactggatttgtgggttccctcctcttcagtacgccctgtcaacccggctgctctgctgggctccttctcagtctggtgtcactggcatcaccattggccacttgggactctggctgtactcagacacagctgacagtgtcccaaggctctgacaaggtcttcaccctcctaggggagttgtgtagagactctgggacactgctctctgcctgcatccccagagtggcctggaagagtccacgtgagttctgctgagctgggtcttactttactgagtattttgaccatgttatacttgttatcctcatcagaagaggcgtggctttaaaactggtcttcattggctcaagtgtaaggcgtccacagtcaacgcagaggccctgtgcggcttgccatctttgcaggcctaggttgttatggccctgtacgtgagacaggcctaaggtgcctgcccacctgccagtccggcttccatgacacagcctgctcctctgtcaccaggttactgggagaaggcctggcaggcagtatgaaggacggcaggcagtgggtcctttgatactgtgagagccaatcacccaataggcaccttgcctgttgtaggcaaagctcaaggtaagaagaaagcaatggctggctggcgtaggtcccccaaggggggaaaaaatgctgaggactgaggcaggcgtgtggctgaggagtgtctgtctggaagtgggaggctatttcactgctttagaacacgtgccttacatgttagaaatctcttctcagttcatacagcttgcagaacgcccttgtctgtaagcagaacctggctgtagctcctgcttccatatgtgcgtctgtgccagaacctcccacagctggcaggctaaccgcagcctctcggtcttggcagcccactctgcttatcgagcagggatgatccgtcattgcggggtgtatcctttgttcacagggccggtcactctgtttcctcaggtgtcagcgcaagcagtggcgagtggacctgccagccaccagcgtggtgatcacattccacaatgaagccaggtcagccctgctgcggacggtggtcaggtgaggccaacggatagctcccagcgtctcatgggaagtgtttggggcacctgacaatggctgcacctcaggtgcatcagctggggctacagacaggacatcagctgccaagcatggggtagctgttggctcctcgagccaaggccggggaccaaaagagagaggaaacttccaagcagagctccgcccttacaaggctccgtccctctgtctttcctcagtgtcctcaagaggagtccacctcacctcatcaaggagataatcctggtggatgactacagcaacgaccgtgagtttcatcagccttcctggtttggggtgtctgggaagagtgacctaatacagtctggagtggagtagggacctaggggcaggaaagagatgtcctctggagaccccgggggcaggactttgcataggtgaccaagtatgtggccttccagctcagaaccccgtgtagactcagggatcactattgtccacctcttttctctccttagctgaggacggggccctcttggggaaaatcgagaaggtgcgggtcctcagaaatgaccggagagaaggtaaggaggtcccccctgctcgtcacttgtgaagcagcgtgtctctgccctcgtgagatggtgtgtctctccatgcctgtgcggtggtttctcgctagtgtgacagatgcagtttaaagaaagaagtgtttattctggctcatagttccagggatgcagtccaccgtggtgacaggaacatgaggcagctcgtcacgtgggcccacagcaggcaggcagagatgggcatgggaactcagctcatgggtcctccttacacaatccaggaccccggtccatgagatgctgccacctacttctgacctaaccttagaaaattcctctcagacatacccagatgtctgtctccttggtgatactaagtcctgtcatgttgacagtcaagactgaccattacatgccagcctctgtgtgagtgcaataccctctcttgctccagagggaagaaaagaaaagaacgctttattcagaatcagatatacggaaacacagagcgagtcagattgttccgaacggctgctgtggtggaagaggggccgtgtgcttagtcacagagtacaaagtcctaagtcggtacataaacaaatatattggtagggacattaattagacagatcacaatagagcggaggagcctctgccgtggtgtcagatgtattgtggttggtggttaacagtgatctgctggcgatccggcggtcatagacactggagatgcttggtcctatatgaagcttggtaccgagtggacaggccgctggggctgagagctggctcaacagttaaaagagcactggttgctctccgggaagacccgggttcaagtcctgtctgtaactcccagtcccaggggatccagtatccaatccttgtctcttcaggaagaaggtacatggtgcacagatacacatgtctgtaggcaaaataaacccatacacatacaattaagatttaacaaaaacagtagcggccaatgacttacgacctgcagcattcaaactttcccttaagttctagtcagtatttatcttctacacagatatggcttcttcagattccagttcccacccaccttccttagcccactgaatctacttcagggaaatctcagtttatgtgtctctccctccaccagagccacccaagagccctgtctcagtagatgcaggaaggatagtcaaagcctaagttaattggaattgtttgtacatgaagctatattttcaaatcacatttatatttacacatttggaaagttgacttctgtcttctgcctgtaaagtcccatcagtggcttggctgcaaaggtttagagaaaatgttaaagcctagctatgaggaatacagtgtctccatgttccaggcatgccatagaatcacagattcaactttgacagctcactgaaggagaactgtcccaaactgggagagagagagctgtcatctcatgctgatgtgacactgcagacgccagctgtcagtctcatctgtgtgggaagctacgggaacaactgccttcccacagccaggtctggaagccccttggggcgtctcgggtgtgctgctgctgtttggcctcaccctcttccagtttccagcagttacagagagatgacactctggacactccactgtgtgaggctgacgtggtcattccctggtcggctcagactctcctccaggtctccatgtgtggctccaggcacagcaggaagaaagatctttttttctttttcctcttcttttttcttttccactttttgcgtatgggtgttttttcctgcgtgtatactacattcaaacttggtgcctctagaggccagaagagggtgtcagaccccctagagctggaattagatagagttgtgagccgctgtgtgggtgcggcaaatcaaacccaggtcctctggagaaacggccagtgctcttaactgctaggccagttctccagcccagcaagaatctttttctttttaatatttaaaaattccgtgtgtgtatgcgtctgtgtgggtaggtcacatgtgcaggtacccatggaaaccagattagggcatcagatccctaggaaccagagttagagaaggttgggtgctgggaaccaaacatgggttcactgcaagatcagtgagtgctcgtcaccactaagccatctctccagcccccaggatcttaaaaaaaattaattaattttaaaaaatcatgtattaaacagtgtgtgctttgcactgtgctagacgctagagaatgcaaggataaattgtgacagttattcttcctgcccctcgggtgcttgcattttaattctggaaataaatacacatgtgaaactatcatgcagactgctaaagatcgcagggcagcacattagtcatggtgggctccgagcactgctatgtcactgataagactggcagccttaccgtccactcgtgtctcagcaccaccagtggggaccgaggctttagcacgtgagctcgtgtgcagaggggtgggctcaacatctcagtcagacactgaagacttggtcctacacatgacgagggtgctttgtttgcacacgtgcatttggggtagatcccctatttatctaacagttgagctctaactgtgaccttctgcagtttctgtaggagggcagagatgttttccacactttgtttacttggcaaggctcaaatcccaaaccctgtgtccattggaggagagagcagctgaggcctctgccacctccggctgtggccgtccttgggctgctctgctcctgtggccccctgagccaggagctgttagccacaggcttccaggacttatccccagattgggggccttcttttcctttccagcctccgtagaagccctgcccttggtctgctgacacctcaagctaaaaggactgcactgcagcagaggggagggcaagcccatgcggacctgggccttgctgcgccgttcctgctttcaggccttgaatcccctcaaattccctttttgagtgacttcttggaagccctttcagacagtttccacttacgttcagctctgcagttgtagcagttacccgaggaagggtttgaacggcttggagttggaaatctcgtctttttaccctgatgtagcatatagttgataagagtcattgaaaatccatttttcttgtttataaaggaacttaaaatactcgtccttgctcattgtaaggagccccatcctgcccaggtgcaaagtgtcttctgggctcagtacatggctaatgataagactgtacatgaagtacctgttataattgatcacaagccgttcgggcagaatggggccaaagatgaccctggtttttgtatcacagccacacgggtttgactcaataccctgttgtctgaagacaacgctgttttcgatgcagttgccaggcccaccagacctggcaccattagctctcagggtgtagtgacacctttgctatcccagccaagtagggacctggagtctcgacagcagggtgctttaagccatcctctgggtatttgacaagggtgatgtctattagatgaagaaaggcctttttcagggacagtagccttaggaaagttctctttcccgtcacctgatgagccatttgaagtccagcctggaatctatcccagtgactgctggcgtacagctcctcggtgatgaggcacagggactgctaactgtgccaggctagctctcaggtggagctcccacccctcatgcactttgaattatctccgcaggtctaatgcgctctcgggtccggggtgccgacgccgcccaggccaaggtcctgaccttcctagacagtcactgcgagtgtaacgagcgatggctggagccactcttggagcgggttgctgaggtgagcctctgtcacacagagggtttgtgttacgtacactggctgcaggtttccttgtcactaggaaagatgtgatgccctaaacgttgtttcccgatgtcccatgggtgcaggactgtcactgcaaccaaagacagctttcatggagctggcagaagcctggcaagatgaggtggctggtcacctgccacacacacaggcatgcatgtgtgcacatgtgcatgcaaacaaagagaagcaaacaagctagcagagtgccccggcgggcttgtcatgtgacctctggccatgctgaggcacattccaccttccggaagtgtccgcactggtactgtgtttagcccagtgttgttttccttgccctctgcttgtcttattgactttctttccttgctgctatgaaagtgcttccttgggggcaatgtagcaaatgaaaggaaacaggatgagacgctctgcccgccaccatagcacacgtagcaacagcaagtcacaaaatacctagcagccaagagctgttagaagtccactctctgccctttactggtctcaggcagccgctaggtgaggagactgggcttcagggggtcttcagtaacatccggattcacacaggaggcagggtcaccactctctaacacactctcctgtgtcctcccctgtccctgccatgtgtcccccagcttggccagctgaggagagtgcgggccaatgcgatgggttcctgtgattctcttctcatcagaaggaatgtaaagattagtcttgtatatccagggccagcctgatgggagcacaggggtgggttactgagtgatgctctagtctccatggtccaaagcttgttttcctgtcaacctgcaagcatgcaggtggggcggggctctgtcatgcccttggagagtgcttctgagctctgctcatcctgttgctggcccttcagctaacaagcgttctctaagtaactcaagagccacactcgctctctctcatgagcagtcagcgtgaggcagcactgagcaggaaggtcagaggaggtcggaggcctcatgttggtgctcacacagtggctctgtggaaggtagccatggtcggtacaataacagagttgagttcggaaatggaaagtgcagtcagctgctgtgaggtgatgaaaccccttcctctcacgccagttgtacccagaaactgtccctggctttgtagtgtggacacgtgagcctgagctatgctggtgcagctcacgagagggcaacaggcataacgtggttgcgcttagttctgtgacactgagatctccccttggagccactgcacagccctggtctgtgacagggagaagaggcagcagaagtgtctagtcagctgtcccctctcatgccgccaccctgcacaaccttgggacagtggtgtctgttgggaaggcctgttgggatggcagctcttgcttcactggggtcgtaacttacaagtatctttccttcctttgtccccctcaggacaggacccgagttgtatcccccattatcgatgtcattaacatggataatttccagtatgtgggcgcctctgctgacctcaagggtggtaggtgtcagccttgattggtccacctgctggctggtcctctgaccattgctgtcccatgatcagctgtgacagtgatagtggagctcacactgtgatgtgggctctggctggttcctaacagaaaggactggccatgcgtccctggcaaccccaccccccactgtgtctcactcgtgcgcgcgcgcgcgcgcgcgcgcgcgcgcacacacacacacacacacacactcactctctctctctctctctctctctctctctctctctcccctctcccctctcctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgactgggcctggaacctgtctctgtgtcctctgccagggccaggcttcctcttgtagcctacatgcccagccagcctgccagtttgctgccctggagtcctgccatcctgccactggcccatcactgcccacccaccaggcagcagtcctacctttgtgttcaagtctggatgctggccctcccttcccagccgcccagccacagcctgcttcaccagtgggtggcctttgtgtgaatggaccagtgtcttgtaggaccacacagcctacaaatgttaccttctggtaccgctctagggacccaagagaaatttgttcaagcttctcctttgcctcttgggaattgcagaggctccagtacttctctggtgggagggagactgcagtagacataactgaggggtcactgctacacacaacgtggagcaggttatactgttcctgatctagcccctaactcacaaatagcaaggggtagggtggcctaaggagctaagctggccaggaacacaagctcctcctgccttagcatctcatgagcgctgctaggattacaggcctgcactgtgaaacacagcatgtcagattgtgggagcagttttaaagttagtcctggtctaggcctgaagaaccatgggtcccacagagacactatgtgctgcgctgtggttctgtgagccaactgtgattcatccagctctgactcacccccccaggtccacaggcctgtgtgcacagagcagccctgtccccaggttcccaggcctgtgtgcacagcccttgtaggtgcaatggcatcacacaaacaccagtcctcgtgtttcacatttgttctcacatttgaagattagaaaaccccagccaggcatggtggcacatgtgtgcaatcccagaactcggggggctgaggcaggaggattgctacaagttcaagaccaacctgggctatatagctataccctacattaaaaaaataaaaaaggttagaggggcaagaaagctggttcacagggccagagtgcagtccctaacactcaggtgacctgtaaccccagctccaagggctccagccctctcttctgactccacgggcaccagcacccatgtgcacataactgcacacagacatacctgtagtttagagtttttagaggaaaactcagagccctgtttgctttggagagctgggaagatttcactgtccttcacacccaccagctaccaagttctcctcccccgtcccctcctccctccccctcgttcttttcttctccccattgtggttgtttggttggttggcagtgagttccatccacatgagctcattgtcaactactcgggtgggaaagccaggagtgagcgaccgaccgtctcttcttctcattgccgccgttcttttctgggctggcaggttttgactggaacttggtgttcaagtgggattacatgacaccagagcagaggcgatcccggcaggggaacccagttgcccctataaagtaagtgcggcctttgcaggaagccctcctaggagagcccagactccagcccctgttgcagtatgcatccaggacagtgaggctctgtgcctcccaccctctgggttcctggcctcccttcaaggccaacatctgccaccaggtcacacagtgaaggaacttaggtccttttcctcagtcactagctcccaaggcatctctgctggttctgtattggctcctgtttatggtgaatgctatctggagcagagtggaactgtatgccatggccttaagtgttacttctgcggttcttagaattaccttgtaagttgaggcatgtgagtctcaagggtcccagcctctgtgggaccccaagcagtgactagaggccagtggaggaatgaaaagacccctttgagagtgcagcagaggatggaggtccagcctgtggtatggtctaaccttgcccttgctccctcatcttctcagaactccgatgatcgctggcggcctcttcgtgatggacaagctctattttgaagagctggggaagtacgacatgatgatggacgtgtggggaggagagaacttgggtatgtgtgcccctcccccgcccaggccccaactgcaccaaagcgtgggaggcagggtgtcatgtcagcatttagggaggcccagagcagccagcccctccgtggacaacccacctcctacacacctgaccacggggatgacggtaagacgtgtgcctcctgtcgggtcatccctgcacagacagcagatgctgtcgcctcctttgacctaggggttctctcggggttcagaatacatgcctcccaaactgagaaataagccgtctccagggctctggttaactgtagggtgctaatggggtcaggcagctgctgttttgcctaaatgtaatcgtgcatgtcatgtggatgggctctgatattcagacccttctccactacttttaggaataattattatttttttaatgacccttggagatcatgtttgcccaggaatgagacatggacgctgtacaggtggcggtctgtgcaagtgtcttgcgtgacgaaggaaaagactctacttagcttgttcagtctctgctccctttacttgaggcctttgatttcaagtgcttgtcgttcagaacggactcctctcactatcaagagtttagtttccttcgtccttacgcagttgtgccctgggaggagaggggaccaggacaaggagggaaagccacattgctgtctctttgagtgggttttcttgtgacagagactttgatagcttctgttggcttaaaagagcagcttcagctagcctgtctttcgaatgtgtcctttgaagttgaagttgatggagacgtttcatctggtaggacagctctgcccagcatgatgaaagccactgccacctctggctccgtggggagaaggacagggtggagagtccggctcctttccaagtttcagtgcagtgttgggcttgggtggagttttgtgagcaagaaaggctttgtagtgaacctgaaaggtccttgagcctcttgtactgtaggttctaacagctggagccacccagtgggccaatgtgtgtcatgggctcaggaggccacatctcagggacctgagagcacagagtgacagacatagtcagcctccctcctgtgtgtcttgctaaggttagggcaggtgactgtccctggtcactaccctggaaacttggttgacatctggacctgctgatacatgagagaaataggcagggactcttttttttccctgaaggaaagcccagtgcatcctggtactcagtcagttgacagtaagtagcgtggaggaccatggtctgtgcacacatctccagctgacagttgctgagatacttgtggtcttagtgtgggaggtgtctgctttcagaccgagagtcaccgttgggagacctcttgtcccacagagctttccatgcgtgttccgtcttgggtgtgctgtggaggccgcctgtccatgatgccccagtgtctcctctataaaagctccaggtcctgctctgcagaggcacccctcatgggtccccccccccctcccccagcagttgaaagtgaggcatggtaggtggctacccacggcacggggacagcaattatgagttctgatggttaccaacttcccttcctgtcagagatctcattccgagtgtggcagtgtggtggcagcctggagatcatcccgtgcagccgcgtgggccacgtgttccggaagcagcatccctacacgttccccggtggcagcggcactgtctttgcccggtaagacgtgaaaggccagcccagatgtctgctgtctgctcagaagaccctggtactgtgtggggacagtgatccttgataggcacggcccctgagctgaggaaaggaatagcgactagcatgccagatgggattccagtgaggggagccggctcagtgtgccccacagaggtctcaggaagagggagcgggggcgtggcagaggagggtgatagctggagttatcctaactgggacatcaggggatgacttccattggatagtcacaaaaacctcagagggagagcctgggtttgtgctgtatcacctcacggtgttaagaacagggttgcgttcgcccatcacgtactgcagtaaacaactgctgggttatcacaaggagctgcattgctaactaactgtccgggtgctgacgcatctgggacccacgtgtcagcccctgccaagggccgtcctgatgccccacgtagtgaagttagggtaagacgtgaggatgaggcacagaggaacagttccagtctggtgacaacagagtcccacggcccggccactgcttcaggctcctacctctcagtgtcatctgatgcaacacgatttgagcctgagttctggagagcagacattgaaaccttctcagaaggcggctcagactgcactccagccaggagacatcaaggctcatcactgatggattaccaatcagcaatagatgttaggaaaccgaaaggccgcttggtccaactagatttcccctggaaatttttcccagttctgacattgtagcacacacctttagtccccgtgctcagaaggcagaagcaggtggatgtccgcgagtttgaagtcagccgaggctaagacggtgaagccctgtcttaaccaaaaacctgtgagtcagactcacggggcagacagacagcaaaacccatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccaccacccccagtaatgcggccttattttgactctgcctaggaaggtggctagtggtcagtaggtcagagccttccggatctcatcattctgctcctcatagacacagcgggacccagaggtctgtgtccgtcatctgggtgcttctcagtgcacagacctactcatctgtgagggtgcactccacagccaccccgcagggctactaggttttccattatcaactgaaatgaggacatttccacatgcgtaccattcctggttatcaaccttgaggtaaattctgggcttagcaccaggaacctaaggatgcgcacatttacagtgtccggtctctcagtggcggcagtccgcccctcccccattcggggactacgggaatatttgtcactttatggggaagacggaggccccaggtggaaatgcatttagtaattacagctcagacagtgtgacaggttgagcattcagaagaccttactgcagagaaaatgattcacctccagggcggccactgcaagagcatggtgggccatgtctcccctcgcctgagcagagggtctatctgcggctacctgtgcttacggcgacccttcctaactgtcatggaagcaagctctctttatgctctagagctaagggcaagtctccgcaggtctggggcatcacgctcccacttctttctactgccgtttctaatctacacatgatgaaagggcaagtctccgcaggtctggggcatcacgctcccacttctttctactgccgtttctaatctacacatgatgatacctccctcagaggagaggcagagggagttaggggaacctagttcactttcccagcatgccagtggtgccatatccactcacaccgtggaaaactggggtgaccagagtgccataccatggtctctactagaggccccttctccgtggtgcagcagagatcatggcgtacgagaccgtcagtatgtctgtgccctcctgctcctgctccaggctgactcgtgctgagtgatgtgacttcagctgagcacttcccacagaccctgaggtagctgtggctgcaccatgccactctggaagctctgtcattcacactcccacagacggacagggacaggtgactccagggaaaggatgggagttatagctcaggatggcttactttgttttcaggaacacacgccgggcagctgaagtctggatggatgagtacaaacatttctactatgcagcggtgccttctgcacgaaacgtgccctatgggaagtgagtaccgtccccctatccttctaatagagacactggcagaggtggggatagctgccaccctgtcctcctagtggggaccctggcagaggtggggatagctgccacccctgtcctcctagtggggaccctggctgaagtggggatagttgccaccctgtccttctagtgggaaccttggcagaggtggggatagctgccaccctatcctggtggggaccctggaacaggtggagatagctggtaccctgtcctcctggtggggaccctggcagaggtggggatagctgtcaccctgtcctcctagtggggaccctggcagaggtgggaatagctgccaccctgtcctcctagtggggaccctggcagaggtgggaatagctgccaccctgtcctcctggtggggaccctggcagaggtgggaatagctgccaccctgtcctcctggtggggaccctggcagaggtggggatagctgccaccctgtcctcctggttgggaccctggaacaggtagggatagcagtcaccctgtcctcctagtggggaccctggcagaggtgggaatagctgccaccctgtcctcctggtggggccctggaacaggtggggatagctgccaccctgtccttcagtggggaccctggcagaggtgggaatagctgccactctgtcctcctggtggggaccctggaacaggtggggatagctggcaccctgtcctcctggtggggaccctggaacaggtggggatagctgccaccctgtgtcttcctttcctccagtattcagagcaggctggagctcaggaaaaagctgggctgcaagcccttcaagtggtacctgggacaacgtctacccggagctgaggtaagtctggggcctgagtgcactctgtgactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggaccacataacaaatcccacaggctgggccctactggtcaaggtctcatctgttgagaaatatgaagagtcagatgtgacctctgtgagcggctttctaagggacagccaacagcccagcttgttagtaactctcccttaccagaaacgagggaacatctcccatttactgttttgagatggaggggcatgccagggaaggttcactctgtagcccaagctggcctcaaattctcacagaaatcctccctcagccttctgaatgctaggattacaggcatgtgccatcatgcatggcccatttaacagtcttaaagagttaggaatccagagactggggccacatcatgttggggtgacatgaagctgtcctctgctgtctaatttgagaccatgtgcagaggccgtggcgagcagaaagcacagggctgtggaggtgaccttggctcttaacaatgaatgactttcagggttccagaccaccaggacatagctttcggggccttacagcagggaaccaactgcctggacaccttgggacacttcgcggatggagttgttggaatttatgagtgtcacaacgctggaggaaaccaggtaggtggggagtatgcttgcctgcagacccagaggcctcatctagacaccctgggctctgtaggaagccccagccctgccagcagcctcagaaccagctgcgatgttgcaggtattgaatgaggccttgagcagctggctcatgctgtgggctgcactgcactggcgaggtactactgaggtagcatcagcacatgttgtctaggctgtgacttcccgccagcttcgccgtccctgcagagtccactaccatgtactgcacctgcatctgcaccctgtttgtccctgatgggtacctgcttagtgtgtgctcagcctcctcaggtgaagggtcagtgcctgatggtgaagaccaacagatgttgggttctgatccttggcaggcttggtgattggcacagtttataccactcaacctggggtacttcaccccacaggccatctggggtccatgagcccctcctcagtgctagaaatgttgtagaactatagctagcaggcacctgtgcacctgagctcctgagatgtgcctactgtgaactaagtcttcagttttatttaactatcgaatttaaatccaagctgccacgtgtggctggtggctgacactccagtgcttggaggggacccagaggcaaaggtgacactagcaggagtccccaccatgactgagtcaggtgccgcaaggatagggttcacccttcctgactctggcacagggcaggcagcatagatgggcgctgttacctggtttctagctgtgcctcagcagcaagtaggaaatgaaagaatgatggccacactttttaaaggatggcagcttataaaagcatttcttagatattttacaaattcaggttgctgaaggtccagcacaaggtggccagctctgcttcatgtgtagccaagtcaggtttttggagttcagtgtatttactatccatcttaaaataatgaagtccacaatatccacatgtgaccttcctggccagccacatttgtcaaataagacagtctagaccctcggtgctcagaggtccttgtgactctcctgaccacaagtaggtgtgtctccagctgttgcccacacataggtgtggttgggaggggttctggacttccacatctacagcagcagaccggggacatggagttgcatctccacgccctggcacatctggaaggaagcacactgggtagagcagacagactgtagataagctacccaccacccttcactgtggagacagaacagcctaagagagaagggtccttctactcacatcccacgcagtacatcacggcatgggaggatgaggaagccagccaccttgtgtccacagtctggaagtggacagaaggtgaggctgacttcagaagggcctgccccagtgactcacagtgcagtcaccttctgtgaagaacttccagtggcacagaggaactcattccacggcagggatagagacagaaagaaagatccatcaggccatcctgcctccaggctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaccagctggggcccacacgtgcccaccaaaacatagcggttaccaaggttacaccttagcagccaggcgtagctttgtccctcagccgggagcatcctgctggctctgagttacccctggggcctgagtcaagtttcccacgtgactgcagcttgacttggggtgtacctctgactcgtggtctctcccaggaatgggccttgacaaaggagaagtcggtgaagcacatggacctgtgccttactgtggtggaccgttcgcctgggtcactcatcaggctgcagggctgccgggagaacgacagcagacaggtgcgtccgaggtcccaggctttcatagcgtcagcagtgatgggggccacgtgcttagccacctcacacccatggtccagttcatccccgctggaggtctcatgtcacacggtcccagcctcctttccttcctcatgccacagagcgcttgatgtgaaattacgtcatttcttaagcaaaccattcataagttgcttgttctcctgcttaactttacagaaattctaatctgaatggttaacaagatgggcatgggtgggcacaaagacttagctgcagagtaacccatattctaccgaaagtggactttgggctttgactctggatcgtctccatagctggcagttaggtagtatgttttcctgaggtttggggccacagcagcctcctcagctccctgtcagtctccttcataaagggagtggccactcccctgcggtgccctgggctgtgtggctgagcactggggggtaccacttgtcttactccgagcttacagtgagatcagaatcttaaccgtggtaacagttgagcctctctgtatattgcttcttccgtggaccagagcatattgcaagccttggaagccagttctgtctggcatattctctgggggtcttggacaaagcaccttcctaagccctgcagtgacaatcacagtgcaggcactaaccgtcccttctaacttgctacaggggagtgcagccagtctccccacggtccctccccagaagacaaatgtagggggaaactgaggcacgagggcccccagagcacggctcagcatccttccatccacctgattgcacaaacggaagcagaggcccaggttccccgcctaccaccacctagcaggtggtatggggccacagtcagcgtccagttcctgtttagatcctaggtgacagagaaatgcttgcaaagggtcctgtctccccagtccatccctaaatctattcccatacctgagtgccatgtccctgctcccagtccaccctgtgttcactctctaaacatcggttagtgcagtttataacttgagtcagaccctatagaataaggttgtaaatgttgaaccagggaaggccactgtcccctggacccacctaaaacacagccaggctttgcgactgtaagtcagtggtaaggtgagactttggtctggtctgttgacctttaaggaagaggaaatagaaacacccgtcccacgttctgtggggtccttaactgagcttctaagacagggacggcttgggcgatgagtccagcctccagctgtggagatgtgggagcgctgctccagtaaacccaccacactgcagcatcccatcaggtggatgccagcgttgaagaccaccttccagggacagctgggagtgacttcattattttcttagcaccctctgtctagtggatgcttcgacacatgacagacagccccaccccaggagccagagtcggagtatgttctctccgcacgctttgtcagactctaggcatgctttccatgacaaggaaggggacaccaaaaaactgacagcagcggggacaggcggtgcaggttggcagagcctctctcagggtgaccgcctctgacttccacagttggcatctgatgagcaggtggaaaatactccgagggctgagagagccactcacacacacccccatccccgtgcttgtggcaggtctccctcatgctgcgggtcctgctttgctgccccctggcccgccactgagaggcagctccttggcctgtctctgtggcaccgcactgtctggccagtgagaacattgtgcttcctggcacgtgtatgtgtgcatttgcacagtcaaaaggggaggggagcaagagtgagaaaatctcattccaccgtgtcagggatttttcagaaatacttatccaaggaaccttattgcgtgtataaaacaataactagagccacagaccttgttgatgagagaggagctgtggggaaagaaaggaaagtgcgtgtgattttaaaatgaaagcataaatgtttaggatgttcctatcacttgctaaacagcagggtcagagtgcttcagacttcttgaggctgttaggtctctgtgctggctacggttggtcgagtgtgctagcattcggaggaacatcatggaggtggcatgtgctccaagagtgacacgtgaagcatggggcacaggggcagccgggattcaggagcagagagaaagaggatggagggctggagagatggcttagccgttaaagactaggctcacaatccaaaatataagagaaagaggatggaaatagcaggtgtatgcctgcagaccctatgctgccctcaacacctccccctgctgtgctctctctgttgcagaagtgggagcagatcgaaggcaactccaaactgcgacacgtgggcagcaacctgtgcctggatagccgcactgccaagagcggaggcctgagtgtggaggtgtgtggcccggccctgtcacaacagtggaagttctcactcaacctgcagcaataagaggcccccggggcccaacgtccacccgcacaccggcccagtttgttgatcacgtaattacgtttctgaaactttccgcaaaactatatacctcagtgttccatcacggtctgacagtcttaagtctcaagtcttcatcgaggcatgagcggggcagacagcagtgcagaagaggaaaggagcccctggggctcaggacagagggtccctcccaaggctggcgccctctgcctccctctttctgcttcctgctcacaccccagcactggccggaacaagtgggcaagcagcaatcatgtttatatctcagacagaggaagcaggggcaggcgcccccacagcgagagctcaccaatctccactctgttttacctattcaaaatcgtgtgtgtgtgtgtgtgaaccaggcatggtggccagtgcctgtaatcccatcactcaggaggctgaggcaggcaaggccctgtctaaggaaaaaaaaaaaaaatgatttccacaaagctggcctttccttgtctgtccctgcacccgggctcagctggcctcccagccacgtcccctcttccattgacatacttgctgtatttgaacgtgaactttcctctggtggacactaaatagagataaagagaatcatggtccgttccctacgcttccccgacatcatcttgtgaaccctgcaacgcagcgcagcccagagcaaaggtgcatctctggggcctcaccagccggcccacgctgctcctccagtaggggcatccccaaaccactggccccgcccacaagcgtcaatgtttaacttcagcgaggggatcgcagctgggttagaaagtctgctttgtgcccattgtcatctgtaaaactaaataggtcacctcttttggcaagtattgctttgggttttcttttaaaattagatttcttttctttaggaaaactcaaccccacagcttctaactaatgtgagccagcaggaccctactgccttgtgacagaccagggacactggacagctgtcacccactatccctaggctcacagtggtttgagaccctgtatgttgggtctttggtactaagctgccggcagagcacagaagagcagctcttcagcctgtgggtggaccccacgtgcccgtagccctggtgtgggtaatacccccggtacatccacaggcaactgcaggaattatgggtagaggtcagatcacaaggcctgcgcactcccactgaggacctaggcatgtgttagccacagaggtgacctggatgtggggaagtgacacctggtgggctgcaggcatcatacgtgctcatctcgggtatcccagagatctcgggaatcagagttccaggtggtcagagggcctgtaggtgagtgctgtgcctcccgcctgctccagaaggggggtagctggtttcttctacctgaggggctccatgtgtgtactcaccatgtgtgtattcgccatgaccatggaccctctgcgaaggcctggccaggtgctgaccctctgtctttctacccctgccaagcaaccaacagaagagacattgtaacagacagggtgcccacatgtctaattaagttcatacaatgtccaccttccaatgtaggctctgggaactgtcactcccaggtacaggtgcaaagctgtcaaggacaaggcaggagtttgctggagtccggtcaccacgacctttgctaaccctgacactactgcactgcttctatcagagtgactccacagatgtgagacaacatggggcgtcccaaccacacgtgtaccccaccccaccctgtggcctcttaacctttgtaccatctgattgtctggccaccagggtgccaactcaacccagctccgagcagaggggggtgtgggcagggcccgtcggtgagccatgtttacatgacagtgtgccaaagtgactcgccgagcttgtattgctttgtagtcatctgggctatcccaccctcccaactcctgtttttaaaactaaaaactcccaggagccctgggcgcacacaggcaaaggtggctgtcttctgtggtggtccttgagtctccgtgaagctgaaaatgatggtgtctgtgagtatgttttgcaaattcaaaatatagtttggtaattttttttccagttgatttttaaaaaaacaaaacaaaaaactgctgtacagagcttgtactttgtccattttatagatggaaaccatccttgaaattgtttaacttaaataaagagaagatactttatagataatcctccgccgctgtcagtcttggtctccaccaggtgtgggtggcaccaggcagagggctggaacctgggtcttgcttctacccacacttctatttctcatcgcccccttaaaacacatctctaaggctgtgaatcctggacctgatgtattcgtgacaattgtttgcagcgtggaacagttgggctatgctggacacctagccagcctcagcaatgctctgcctaaacttgccctgatcctgcacaagccgcttcctgtagtctgccctgaacacttggcccacactctctaggtaccaaatttcttatacctcagtatttaaaatgcacagtcctgctcagcagccatctggggctcccctacctatcctgatctcgtacatgtcttctaccacaccttcatgtgactggctacatacatatccagggaaataaacactagccggttgtcttgcagtttgaccatgatatgacagttaagggactggccatcacaccacaccgcattcacttcattttgtgagacaccaaaaatttggctctgtgatcgtctgagagacaaaggcagtaacttataacttggcaatgttccagagccttggggtatctgaagagactaaactacatttctaaaaggtctagcctgggagctaggaggagggttccaggatgggtggtcaggaggcccctctgggagttagacttagaggcagctgctgcatggagctttgtgaaggggtagctatgggtggtttctcttgggcatttcagtgaggcccagaaaggcacaggcctctgaagatcatgggaggagcccttggcttgccaaaggatatcccagaaggccccttgttacccttgagctggagaggtctcttggaaccaggccttctatacaagtagttcagatgtatgtgttccttgtctcgtaacaagaaacccaagagaccggatttcagctcagtgctgaacaaactcccaagtcccaccatggcataggacagtcacctctgatcgggagtccccttgtctagaggcaggatatgggtctcaggagtttgggctaccctcgtgtgtccttgcaaggggctagaaaagaaactgtttgcagagccacacagcctcctggactactatgttggaagggtttgagcctctgtaggatggatgggaccgtgataatggctttgagagggtagctgctggcctactaagctccttcctccccttgcctttggtgtctccagtacctgctagcagctcagggttctcgggagggactcaaatcaaaaacacatggcagcagaccacaaaccagtcatagtaaacaccgtgacctgcttactatcagcacactaggtaacgtcacgtggtctcattactgtgtgtgattccaaagccgcagtgaacacagagtgaatagaaatctgcaataatgggtggaatgaaaatagccgattcttaaaaagaaaaacagagaccataccgtacgctgtctgcaagctccagtcatgatagaacaaaatagtttcaggaaaaggtcatgaaaaggaagggaggctctcagaagtatgtcggtgtgggtgggagagttctagtctgagcctcagcgcgccctcatgagcgcccccatgtggctggtaggacacctgcatctcagcaccccctattagagaatgtgacttcccatctctgcctttcagagaggggcttgattttagatagtctcttgcctgggtacaaggatgctagatgtgtcaagcagaaactggcccgagagcgacagatcaagtgggaacaaccgtcctccatatgatagcaccatttagccatccagtgactctgatagaacagaaatgtgacctctcaggagctgggactctctccatcctgtgcattggtaaaggagccataggttctctggcccttgggttccagaaacccctggtttccaggcctgtgaacatgggctgagcaaacagcccgggtcgtctccatctccacgatcagagaagctgcctgtgtgtaactattggtctgttaggaatccctgacaccagagagtttcaaaacacccacgggtacagcctagagcaccaggctgaggggcctgggttatagctaagtcatctctccaccttggaactgtatcaaaagtgaggtgggtgagagagagaacaagaccccaggagaaagaagagactgtatgagagtgacccttggccgtgttacagtacctatgtagcgggtacaagggctgggggtttggggatagtggggtagacctaccctaggcctaactccagctatggacaaggcaggtacacgctgacaccctgagttccactcagatccagtaagaagatggaggaggaggagagagtccagtctttatactgagttatcacatgtcaccagggtgccacacacgaacaaaggaaagcttgagaggcaggagtgggtggacagaaaaggatgtggagttcccatgttaggactggttaggactggccagccctggagaatactttgcctctaattttcacaacccataaagtgtttccctatttggcactgggcaagctctagcaagccagccatgaacctgggtgacttgtataggtcacatgaggcaccagctctgagactgagcctgtcctggggcaaggggagggctcagtgttgtgctctgtgtgacaagaggtggtgagaagatggcagtcctccaggagagaccagggcaagcagcccccttgtagcagctagcacatggcagttctcaagagctggagagcatcagagaaggcttggggattctgaggggagagcgaggacctaaagaaacctcagtcagtttgggcttgcacaccagacccactccttgcacactagacccgccccttgtacactagaatcaccccttgcacactagacctgccccatgcacactaaaccactctttgtaaactagacccaccccttgcacactaggcacaccccttgtactctatactgccccttgtacactagacctgccccttgcatattagagccaccccttacacactagaaccaccctttgacactagacctgccccttgcaccctagacctgctccttgcacactaaacaactccttgtaaactagaaccaccccttgcacactaaactactccttgctcactagacccaccccttgcacactagatccgccccttaggccagtccaaaatgggaaccctgtgctcacttgcaagaggggcattgtgggagaggtgagtgaggagggcattgtgaccctgtgttacacctagtggccctccaaggagcaaagacaggactgtgaactcatgaacttcccactggagacattgaatatgctcttcagcaaattggacaaccttgcagactgtagctattctcatctgtctctcggggaccttcagtgccctggtgggagtagaggtggggctgtccaggagtcaggaggcacagccccttacctgctcggctgaattcctgtaagtcagtcatggatgctaagccatttctccatggcaggaaaaactgtggggctagataagagtttttcaagagagccaagttgtctggcttgtgacgtaataaggtgctagggaaaatggtgggctttgggtgtgactagacctgacctcctccttctcatagctgagccactagcctgtgtcattgccaatctccgctgtaaactggagggctgagatttgggctgtgcacagcccaggtccaggtgaggtccttggcctcatccagtgtccctgtgatggtggctcagcttgtccagtcccaaggttacacttgctactcttctccactgtaggctcccatcagatcggggggtggggtggggggggagggcggcatgacaacctaccacctctccccgtctccaagatccagttgtccttcggcacactgtgagcttatcctctactggaaaatacggttgtagcatcacggacccctcaagtgtcccagtgcctcacaaacctagacacggtgaccaggtgaaggactgtggggctctgcagctcctttcctttcccatccccgccaggtcacccagttagtcccagtgaccgtgttgttgctggtctcacgtggggctgtgtcttctataattccagctgcccacactccccagtccacaacactatttggtctgttttgtgctaatttgaggttctgctgccctctgctggccagaccgggaacagcctcacccagaggtagggacatttcccaggaaagaaaggcaaaaaaacctaggtttagaagatcatgggatccaggtaagatcaggctgtcagatctgttgctgttttgttactctgacacttttgaggttagacacagcacctaaacctgcccctctcccaggcccagttcagtccacccattccaggtcaatagccttggattcttaggtaccctatactctaatgtccttagaggccacagtgactccttctcaagatcttcagatattgtgcttggctgcatgggatcataaaggaattccccaccacataccagcttccctgagcccgctcagaatcagacctgattgcagagtccacactgtcctattagcacctggtacagacaccaaggttaccgtgggcttcttgggtctaacacctactcaccttctagagagctaacaggtgcagtctcagcagccccttgccccgcagaactgtctcgaacacgttgagctcaggagcatccctgtggggcagctcagaggtgctggccccaaatttgccagggtcacataaggtttgctccaggaacaaaggcactcagcttgtgaagtaacacctccctcctgacctgccacagtacctcggacccagtgacagtgagtgacagcccatgtgccccaagccttggcttttactgttagtgctctgggcaagtgagagatctggttttctcctctctgctgatgagtgttcttcttacacctcggggtctgggatttggtgttcctccgtggtttgatttaatgatggttgtagtctgcttgcttcaggtgcccttctctctcaaggcagccacagccatgtgttcccatgagccccagctgtgccttgaatgtggtttgtgccccccagccccaccccaatcccacccccaccggaccccaaccctctacatgctcagcttctgtttggaggatcttacttctgacctgcatagtccaggctgtcctcagactcacaataaagttcctttcaccgtgtactcacacatgcacacatgcgtgcacatgaacgcacgcacacgcgcgcacgcacacacacacacacacacacacacacacagggatgacaggtatattccaccatgcctaactatgtgttgaaattcagtgcccactgggaggcttcaaggggacaggactttagtccgactgtcacccagtcagggctctggaagggggatctgaataggcaaagtcatcagggtggtgcacctgacagtcctggtggctttttaaaaaggactggctatggggccatcccttgtctccatgagatggctgagccacctcaggatgctgccagccacaaaccatcaccagctggagcacctgggctctgacattggggacagtgagtggaatcaaactttacaaagcaacctagctttgagcacatcactagatcgacaacgacgacaatgagaaagagaccgagacagagagagacacacacagagacagacagagacacagagagagacagacagacagacagacagacaaacaggactaaacctgccctcaaaagcctataccactgagccatatgaccagaccttagtacccatggtaggaaggctgggactcaggattagtaaacgaaccccaccaggccacctaacttcaaggtctcttttccgtcagggtgtatctgccccaggaaatctttgatctaaaagtaccactctgacattactcccgtggaaggacagctgagggcccagacctgagctctgagccagagggagagaggaggatgctggtgtcctggcccctagtggccatctaggggctcgctgagctcattctctgggatggacaaagaattgaacatccaggaaagagcgaagtccaagccacagagacagggcctctgacttgggaatgtttctatttaggagtatgggcgctttacctgcatctatgtctgtgtatctcatgtgcctggtacagaggccaaaacaccgagttgaatccctggaactggagttacagatggtcgtgagccgccatggagataggtgctgggagctgaagctgggtcctctggaagagcagccatttctccagccctgggctggctattttacagggtcctctattggtcctgtttaaagcactcagccttgaagctgtttcttttcacaaggtctcttgagaataagccaccatcaccttggggacctgctgtcacattccctgtcaaacactctcaatccctgctgttcagagagcaacagccactgctgtcaggggcaggggtgatggctgaggaaaggggcatcgtctcgggggagtgcaggtccaagaaaggggattcttacgagacgggctcccatatggggaacagtgaccccacgtcttgaagatggctgaggttctctatgcgtttacctagaactcaggttgtgtcttttctctagagaccttatatccccttatgactagaaagttggggggcccttgagtctctccctagattccccacagaggcaaaggtcatgtacatgttggagcgaggtttttatggggacttgaccagtctcggaggtcctgggagaaggacagtccaaatcaatccttggagtaggaccttccaagtgtcttgtctggccttgccagttggttagcttctttaaaaacaacagtgggcctgtctcccttggccgcaggtcagggctgcagtgttgagctgagacaaagtcacggtgtcccctatttagttattaagaattcattagtgagaaataattgtctaaaacatctcatatgcaattaaacctaatatctggccttatgattccccctggactgttaaattagcaagccaatcattttcatctttgattatacattcctcctgagcgtttaaaaccatgtcagtggccagaatcaatcaaggccagttgagaatctactccccgtcactcctggcctctggatcctctagagccccatccccaccccctcaccgtttatcagtttttccgtctaggtgaggttaagttgaaggccttgtttgaacattttcctccatattgatcatcctattcatagactggaccctgctttgtgctaattggatggggtctccatggcttccacaaacaagagaacaggtggtcccctcatagttacacaacattttgagataggtttgcacagtcccctgggacctacttgaccttggagggcaaggtgaaaaacagcctcccatttaatctcattagtatggcctccaagtgtggttataggaaacccagaaggccagttaccccatcttatatgctttaactgctgtgtaatagttagataaagcttgggcagaaaacaaaccttgaaactaagtagacacatcttttccttttaagccagtccttgtgattgctatagagttgcccagcaactccatcgacctaagctcagatttgatattaatgtattacactttgactcttctatagcttatgtaacttgcttaagttttaagacaatggtctttcccattctggaaaaacatctggcaaccttatgaaacatagtaacatcgcgaagtcaacagcaagcaagcctaactttgaagatcttttgcaagctggcacttctggagtcatagagagagagggccagtgtttagtttggaaaatatcacagtgcaacatcaccttaataaaggaaagctgggaggtggagagatggctcagtggtcaagagcactgctttctcttccagaggatccaggtttaatccccagcacctgcacggcagctcacaacggtttataactccagttccagtggagctcgtgcctcccacacatgcacatgcaggtaacacatcaatgcacacaaaattttaaaaaagaaagaaatctttttttttaaagttgaatagtaacacataatattacctgtgtgcatatggttaaactatagggcctgtaagttcccaggtgacccacgacagccttcatacagcacagagtgatctaccacactgtgtgctttcagtgttgaatgaatgcaagcaaggaggagagttatgtcatgagataagcactagtcacaatgcctttacactctggctgcagctaggagctgtgggattgaagtgagccaagattatggtgtcccacctctgggcaacgtctttctcatcagggaaaaaaaatcattaggaagaaatagttgcctaaatattgtctcacactcaggtaagcatcaccccccaaacaccccttagactatcttctgtcacctcctttcttgctgccacagagtcggggacaacctaattcagcaaccaggattttggaggactattttataacagatgcttgaagtctgaagttggagacccaaatcctatctccaagccaaatggcacagggtaatttatagaaaaggtatttatttgctcctctataaaactgagcccagggtcctaaggcaactactgcccagtgccacatagcacagtgggacacagcacttctgagatgaccccagatacccagagccccaggtgccgctaggaggatgagtgtggggagatggacgagaaagagaagcagaacagagtgttcaaatcaagagggcaagaactggaaattccagggtagtgagggtgaggtcctggccactgtcaggtcctggcccaagctgctgctgagagccatgtctgggtgcctggccctacagcagtaggggtctgttaccaccaaaggccacatggatgtctctagtctgggatgctgcctgagccatgttgatgtctgagggctgagcagagagggccacagccagcccctcgctggctatagaactcaggcgatcagccccacacctcacctggacagtacagtagagctggcccttctgggaatgagagtgggtgaactggccctgcccctcacctgggcattgctggagagctggcttaggttggtgtaagcat

SEQ ID NO: 1988 - DNA, 3152 bp, Mus musculus
atgcggcggcgctcgcggatgctgctgtgcttcgcgctgctactgggtgctgggcatcgcctactacatggtgactggaatgacatcgactccattaagaagaaagaccttcaccacagcagaggagatgagaaagcacagggtgtggagaccctccctccaggcaaagtccggtggccagactttaaccaggaggcatacgttggcggtacaatggttcgctctgggcaggacccctacgcacgcaacaagttcaaccaggtggagagtgacaagctgcacatggacagaggcatccccgacacccggcatgaccagtgtcagcgcaagcagtggcgagtggacctgccagccaccagcgtggtgatcacattccacaatgaagccaggtcagccctgctgcggacggtggtcagtgtcctcaagaggagtccacctcacctcatcaaggagataatcctggtggatgactacagcaacgaccctgaggacggggccctcttggggaaaatcgagaaggtgcgggtcctcagaaatgaccggagagaaggtctaatgcgctctcgggtccggggtgccgacgccgcccaggccaaggtcctgaccttcctagacagtcactgcgagtgtaacgagcgatggctggagccactcttggagcgggttgctgaggacaggacccgagttgtatcccccattatcgatgtcattaacatggataatttccagtatgtgggcgcctctgctgacctcaagggtggttttgactggaacttggtgttcaagtgggattacatgacaccagagcagaggcgatcccggcaggggaacccagttgcccctataaaaactccgatgatcgctggcggcctcttcgtgatggacaagctctattttgaagagctggggaagtacgacatgatgatggacgtgtggggaggagagaacttggagatctcattccgagtgtggcagtgtggtggcagcctggagatcatcccgtgcagccgcgtgggccacgtgttccggaagcagcatccctacacgttccccggtggcagcggcactgtctttgcccggaacacacgccgggcagctgaagtctggatggatgagtacaaacatttctactatgcagcggtgccttctgcacgaaacgtgccctatgggaatattcagagcaggctggagctcaggaaaaagctgggctgcaagcccttcaagtggtacctgggacaacgtctacccggagctgagcagggaaccaactgcctggacaccttgggacacttcgcggatggagttgttggaatttatgagtgtcacaacgctggaggaaaccaggaatgggccttgacaaaggagaagtcggtgaagcacatggacctgtgccttactgtggtggaccgttcgcctgggtcactcatcaggctgcagggctgccgggagaacgacagcagacagaagtgggagcagatcgaaggcaactccaaactgcgacacgtgggcagcaacctgtgcctggatagccgcactgccaagagcggaggcctgagtgtggaggtgtgtggcccggccctgtcacaacagtggaagttctcactcaacctgcagcaataagaggcccccggggcccaacgtccacccgcacaccggcccagtttgttgatcacgtaattacgtttctgaaactttccgcaaaactatatacctcagtgttccatcacggtctgacagtcttaagtctcaagtcttcatcgaggcatgagcggggcagacagcagtgcagaagaggaaaggagcccctggggctcaggacagagggtccctcccaaggctggcgccctctgcctccctctttctgcttcctgctcacaccccagcactggccggaacaagtgggcaagcagcaatcatgtttatatctcagacagaggaagcaggggcaggcgcccccacagcgagagctcaccaatctccactctgttttacctattcaaaatcgtgtgtgtgtgtgtgtgaaccaggcatggtggccagtgcctgtaatcccatcactcaggaggctgaggcaggcaaggccctgtctaaggaaaaaaaaaaaaaatgatttccacaaagctggcctttccttgtctgtccctgcacccgggctcagctggcctcccagccacgtcccctcttccattgacatacttgctgtatttgaacgtgaactttcctctggtggacactaaatagagataaagagaatcatggtccgttccctacgcttccccgacatcatcttgtgaaccctgcaacgcagcgcagcccagagcaaaggtgcatctctggggcctcaccagccggcccacgctgctcctccagtaggggcatccccaaaccactggccccgcccacaagcgtcaatgtttaacttcagcgaggggatcgcagctgggttagaaagtctgctttgtgcccattgtcatctgtaaaactaaataggtcacctcttttggcaagtattgctttgggttttcttttaaaattagatttcttttctttaggaaaactcaaccccacagcttctaactaatgtgagccagcaggaccctactgccttgtgacagaccagggacactggacagctgtcacccactatccctaggctcacagtggtttgagaccctgtatgttgggtctttggtactaagctgccggcagagcacagaagagcagctcttcagcctgtgggtggaccccacgtgcccgtagccctggtgtgggtaatacccccggtacatccacaggcaactgcaggaattatgggtagaggtcagatcacaaggcctgcgcactcccactgaggacctaggcatgtgttagccacagaggtgacctggatgtggggaagtgacacctggtgggctgcaggcatcatacgtgctcatctcgggtatcccagagatctcgggaatcagagttccaggtggtcagagggcctgtaggtgagtgctgtgcctcccgcctgctccagaaggggggtagctggtttcttctacctgaggggctccatgtgtgtactcaccatgtgtgtattcgccatgaccatggaccctctgcgaaggcctggccaggtgctgaccctctgtctttctacccctgcc

SEQ ID NO: 1989 - protein, 539 aa, Mus musculus
MRRRSRMLLCFALLLGAGHRLLHGDWNDIDSIKKKDLHHSRGDEKAQGVETLPPGKVRWPDFNQEAYVGGTMVRSGQDPYARNKFNQVESDKLHMDRGIPDTRHDQCQRKQWRVDLPATSVVITFHNEARSALLRTVVSVLKRSPPHLIKEIILVDDYSNDPEDGALLGKIEKVRVLRNDRREGLMRSRVRGADAAQAKVLTFLDSHCECNERWLEPLLERVAEDRTRVVSPIIDVINMDNFQYVGASADLKGGFDWNLVFKWDYMTPEQRRSRQGNPVAPIKTPMIAGGLFVMDKLYFEELGKYDMMMDVWGGENLEISFRVWQCGGSLEIIPCSRVGHVFRKQHPYTFPGGSGTVFARNTRRAAEVWMDEYKHFYYAAVPSARNVPYGNIQSRLELRKKLGCKPFKWYLGQRLPGAEQGTNCLDTLGHFADGVVGIYECHNAGGNQEWALTKEKSVKHMDLCLTVVDRSPGSLIRLQGCRENDSRQKWEQIEGNSKLRHVGSNLCLDSRTAKSGGLSVEVCGPALSQQWKFSLNLQQ

SEQ ID NO: 1990 - DNA, 235070 bp, Homo sapiens
  misc_feature (1)...(235070): n = A,T,C or G
agccctacatacctgttagagtttctaaccccacagctccacaatgtatgcttgctctgtctctttctaaaatccctgtttctactctcctttgtctacttgcattggcaaatggaaacactatacactagtcagctccactcttggcagttctgattcagtaggtctgggatgggaatctcgagaaattttatttttaaaaagctctccaagatctgcaatctggcagggggaggggggaatggaaaatccctcatgagttacgtggtctgcctacacagctctgcacatcttatgtatatgtgtttgtgggtttctgtaaaatgtctccaattatctttggaagtgagtggagtataaactataaataaacgagagactttctcagaacatctatgtgcggtgggaccagtcttggggactctgcagctgaaggtgggggacggtggagagagactgtgaacttgaagggagatgactggctgggtctgtgtttggtgctgccattggctaattacatggatggttttggacaagttgcctgacttttctgagcctcagtttgtcatcctctaagatgagcagagtaatatgcacctcatgagaccttgaggtcgtgcatgtgaaagtgctttgtaaactacctgcaggagtctaagttgagccagagataagttcacccaagagcccggatctgcctgggggcaggggcaggcacacaaggaactggctaccggaggagctgcggggcgtcttgagaagaagcttaccctaaaggaaggtagcaaccacaggcaggaggggtaggaaatgggaaggggcattgctggggttaggtaagtgtcgtccggggctaggaggattccgctggctcctttccccaggacgaagggaggaaagggctctgatacaagagtgtacacgaacgaaaagcactggctggagatcatctatgtggaatgtggacagggcaaggtgcccgtagcccctatggctgacagagtaagtagaacttctcactaaagtacacgtatgtccttaagtctggggctatgggggcgtctttaaccatgagtctcctttcctagcactcctgacactggcctcctccttcctaggcccaactctcaggctcactcaggggcagcctgggctggtgaagcatcagcagaggccgtagtgctatgagtgctggctggcggcacggcgacatattccctgggagcctgagatgagagggttacacagcggggaaggtgggaacaagaagactgcctttcagcagaatgtccccaggatcccctaagcccccgtgatgctgtgctcggtcgctttcctgccccaccctctccagatagctgctgtcctgcctaatgggaagattcctttcccccaccggcaagtgtgccaagtgcctcctagtgactcagtctccctgactctgctactcgctgagctgccttgggcaaggcacttaacagcaccctgctataaaactgaaatagtgagagcatttacttgataggactgttgcgaagatttaataaaataatacacaaacagtgcctggcatatggtaagcacatcattaatgtttatatgttcagggcaatcgattcctttaacctaaatcacatttgataaactatttctcagtcacaattcaagccaagcaatttctgggaagaccgcagcaggtggttaacactgtccccggggtgtggggattttgagcttagtgtcactaagagctgctcactgaggatagaactgtagtacttcaaagtgtcccctctcattaaagacagcccattgtgggtcctgggagtatgacagggcctgggcaagctcttccatatcttctttttataataacctccatagaaatgtgctttcagtttggtgggaggggcgtgcgaacgagttcccattatccaatttcagtgtttaatattttgttccttttaagcagtcataattttgtttctccttttctcctgattgggtattgtccccctttaaagtattttagaaaaaaggaaattggacaatcagattataagaaaggttctattgtgcaaagtcacaatgtatcattaaattgtacagggctcccgacaactctgacaacagtaactggtacagtgaattggcagcagaaacgctgaagctgtatttatgtgctgctacaaatatgtagctattcttactgtactatacagtcaggaaaaagccctaagggcttctggcatgaaaatgttacattgataaatgacagccacggtgctgaacagtactaggggctgacaaaaggcaagtcaatgtatatagagtttcctactcattaccttacctgtaaacactagaagtcatgcacaagtgtttgaaagtgtctgtggagatgtgttaggaaagtaaatgaaggtagaagaaagacaaggagcgggtgtttatatgccagccgtctagggaagcaagttgtagtatcttttagacgcttgggctgtggggttgttgcaatggaatgtttttaggtttctgccttttatctaatcagcagaatgaaacttcagggtcaccatattgcatgtaaaaccacttttaaagaaaacgatttcaaacttaccaaaaaagttgcaaaaatagtgcagagaattcacctatgtcctttacccagactcgccattttaaaatattttgccacttttttttatcattctctctctatatttttcttgaatcttttgaaagcagctcgtgtatgtcatgcccccttaacccttgatactttagtttatatttcctaacaaatatcatatttcctaacattcttctaagcaactatagtacagttagcaaaatcagaaaattggacattatactatttaccatagtgtaccatggtatatcagactatgctatagtccgtagtcctgttttattcattgtcctactcatgttctccatagtatttttactttccactacaggggctttattgcatttagatatcatgtctcttcaggtccattaatctgggacatttccttactctttctttgtctttcacaatagccaaagtgacatttctgaagaatacaaaccacttactttacagaatgttccccatttttttcctgatatttattcacatccttggccagaatacatattttcatttgaatatattctcccttggacaccttgtaattattctttgtttctgggatagtttttgtcattattttcaatttccttcttgaatttgctcaacccttgtttatatacatccttggccagaatacaaaaaccatgatgctgtcaccttctcagagtctctccgcagactcaggatatccatctgaccctcataagtgatgctagttttggtcacctggccaaggtgctgcctatttctccaccagctactaaatcccccatcccctcaccaccaccacccccacccagcagtgaataatatgtctattatccaactaagaaatgtctgttgaaagacatttgaagaccttgtaaatctcctccttttcatcaaactcttcctcccctaaccacttcagcatccattcaggtgtcttctccaaacaaacctttactgcgatggttgtaagatggtgatccactcttccctgaatgtctatcagttggcattctactcaaagagttctccttttgtccatttatttattatcattgtgtatgcctagatttctactttattcagtgtttattttgatgcatatatggtcttagatttagccagtggggccccttcaagctggctcctatgtccttttaacattgtgctctctctctcctctgcttctctctttctctctctctcgctctttctgcccttccttactttctagtacaacaagatgttccaggctcatttaataccctctcaaccccagtcctggaatcaataatttctccagtgaactcttacagtggagaatggtatttagaaaccaagatctgggtgcaaggggtgctcattgctactgggatattattaatcggggccctttaagtggacagatctaggaaatatgtatgtatatttgtttaaatatgcatacatatgagcatagatgtgtgtgtgtgtgtgtgtgtgtgtgtctgtatgaaataatgagttcataccgctatctctaattacaaatctactccacaggaatctttcttgccttcttccatcccattctgtatctcccttcttccatagtgaaaagcctagctccccaaaacaatgtatttcctgatttgctcaattgcataccatgcataaaataatacaattgctatacccataacactatgaaaaaaataaagggctttaaaattctttccagttctaggctgagagcacatagctggcatactttgtttaaagttatgaatatttttttaagctttatattattcatttataatataattggattcagatatttctgtttggattcagtttttattcctctcccctcagctttcttgattttattttgtttttttaatatagagaacactatcatgtttccaaaatttaagcctggaaaaacagtatactcagagaagcatcaattcttctcctatcccttctacctttccctcccaccccttctaggtaaccaactcaattgttttctggtttaccactattgtgtatgtgagtgtgtatgtgtgttttgccaaaatatgcagatacatgtgtcttttcttttctgcatggagtgctttccagtgaaaaccagcaaaccttctacacaagttctaaaagagctataacacttacatgtatgttttcttctagtcccttctttgttacagataaagtagcagatgatacataccctattgcaacttccttttttcatttaacaaaatatcctggatattacgctatatgtgttcacggacgtcttccttatttatttatttatttttgtagtcttgccaacagaatgttttgtcaaacttttgattttttaccggtttgatgggaggataaatagtatgtttgtagttttaatttacaactctattaagagcaaagtttaatgtctttccatatgtttatggactctttgtagatctttactatgaattgtctgtttatgcttttcgccattttttataggagatttggggtttttccttaatgttaagtactttatatgtcagagatattacctttttatctataatgttgtggaaataatttctcccaacttgtcatttgtagttttttcaaattgtgatgaaatatacatcacattaaatttaccatcataaccattttaagtgtataattctgtgccattaagtacatttaccatccatctccagaatgttatcatctcaaaccgaaactccgaactcataaataataatgggaactcctaattcctctcttcctcaagcccctggtgactgccattttactttttgcctctatgattttggttactgtaggaaactcatataagtgaaatcatttggtatttgtctttttgtgtctcgctcatttcatctagcatattgtcctcaacgttcatccatgttctggtatgtgttagaattttcttcttttttagggctgaataatattccattgcatggatataccacattctgcttgtccatttatctgttgatagatatttgtgttgtcccaccctttggccactgtaaataacactgctatgaatgtggatatacaaatatccgtttgagtcgctgctttcaattcctttatgtatacaaccagaaatggaattgctggatcatatagtagttctaaatttaattttttgaggaaccactataccattttcaacagcagtgcgtaagggttccaatttctctacatcctcaccaacacttgttatttatttatttatttattttaaaaatgttttataggctgggcgcggtggctcacacctgtaatcccagcactttgggaggctgaggcaggtggatcatgaggtcaggagtttgcgaccagcctggccaatatggtgaaaccctgtctctactagaaatacaaaaattagcagggcatggtggtacatgcctgtaggcccagctgcttaggagtctgaggcaggagaatggcttgaccccaggaggtggaggttgcagtgagccgagattgtgccactgcactttagcctcggcgacagagcaagtgtccaccaaaaaaaaaaaaaaaaattttatataatagctatcctaatggatatgaagtggtatctcactgtgggtttttgttgtgttttgttttttatttccataatcaacactggaggtacattacagtttgtcctcatgaattctagttgttctcatgaggtacattttgtccttgcagttttgactttgtctttgaaatgccccatgtcacatctagctattcttctgattcccaggtctagaaactacagtgacttcagacctgccccatgtacaatggaaagacttccataaccttttttcttctacctctaacattgtctaaagtttaatctctatcatacatcgcttattccatcaaactaataatgattttactttgcagatcaaatcctaatgatatacaattgataagtgtttaggaagggaagttttgggctataaattgtccctcttcatctcatttaatgctttttggcctactctgttttgtttgatatcagaatcacagcacctgctttttcagagttggggtttccgttatgcctacatttgaaaatcttttattttaaagggtgaactgagcccacttataaattgttatatctgatgtgggttggtctcagctgtgtcatattgtttcctattataactactgcatcactgtgccacacttactgtgtttctttcattatttggtatgtattctttgctatttttagaacttttggggttttggaatagggtttccaatatttgggaatacatatattttgttgtagtgatttttatttatatttttaatatattacccttaattcctatattttgtttctaaccttttaacatctggtctgtctgttttatatggtatcctttcactactacctgctactgatattgcagacaatgatattattctattttcccttcgctcttccccttctcctccagttgtctttagttgcacctgttctaagtttatcagaaagtataatgtatatacactagtctttcaccttctgaatatacaaaatgctctccattagtcactctgctggcttcctcagctgtctcttggttggaggaagctcattctctaagattcctcatgaaaggcccatgtgagtcacgttctctgaatttttgcattcaggtcatatctgtttgcctacaaccttgacacttgagggctgggtataaaaatcactgcctggtacttttttgtgtgtgtgtcatggagtctcgctctgtcacccaggctggagtgcaatggcatgatctcagctcactgcaacctctgcctcccgggttcaaatgattcttccacctcagcctctcgagtagctgcgattacaggcacctgccggctaagtttcatattttttttagtgatggggtttcaccactttggccaggctggtcttgaactcctgacctcaggtgatccacccactctggcctcccaaagtgctgggattacaggcatgagccactatgcccagcctgcctggcacttttgttccttgttaatgctgctccactgttgcctggctttgcatgttgctgttcagaagtctgatgccagcataaatttttatctctataagcaatttgatcttttttgcctttaaaatctaatcgttttactaaaatatatttaggagttgataattccagatcatttcccaaggtacatggaagtcacttttgacatgtacatttaaattttcccttattcctggattattttctggggttatagttttaatattaattaggttttattgtttaatgtttgtactttagggactccacttaacatgtattttggtcttcctttcctggcttttattttaacctcttctctctgaacctttttacttctatctttatattattttcaatttcttgattgttttcttgccattcttcagtgtccttttacatattttcatttgaatatattttcccttggacaccttgtaattattctttgtttctgggatagtttttgtcattactttcaatttccttcttgaatttgctcaacccttgttgcatttcttcctaatttttgtctagtctgtcttcagttcttgaaatttcttatcctagatatgtgtgtgtgtgtgtatgtgtatacaaatacgtgacactttgttcagtttgacatgtggtattacaattttcttatgcttcatggtttttattgtgggggttttcatcagcgaaaatgttatgatttattttttatcatcagaaatgtgatttctgttttctttttgcagaatctttaaatgcagttgatttgatgtttttctgttactaggcattttgaggcagggttcccggttcaagagtgttttcttttatctgtgtactgaaatgcagtttttaatagataatgttggtgtttggggaggggactggctgtcttctctttcatttctgcaggatttgtaattttcccttctgacttccttctttcccttcattgtcaggcctctgaaggacattatcttcttttcgtatttatctgactttttcccagaaacaaggctccttcaagcctctcacctcttgtcccattttctttcaaatctcttcccttgatcaataaggcacctgacctctgttcagtttttagttcttggtgttggactttctatttataaagaggtgacaaccctgtacttcacttaagtccttggcaatagtggagggagctcagttggaatttggtatcttttctttcttctacttaagtaatttaatgttcagttcatggcattctctctaagtaatgctgaaggcttgtttttgtttcgttgaggatatgggtacggacttatatcaggcagctgccattatcctctgaccgagaagctcctgaaaacatttaatatatcaagttctaagtaaaatttctgtctttcttaggaacactggaagctttgcgtgttgcaagggcatcaccaaggttacatagattatgttacaagacagatcgttttcttgtatcgttaaagatgcttaatgtgctttttaaagaacgcaacgaatgagaaagaaaagattttaaacaatatattattgctttccttcttcctcattttgtgtttattgaaaagaacaactctaccattgatagctctgtcacccacagaaaaatgttcttttgaaaattaccttctcagttcctaccaactcaaaacctccacatctgcctatatagataaataaaatcgataccagcgggtcaggaatgttttgctgcaagattagtgagaaaactgcagcaagcagcagcaaagtcgggttcaagcgggcggtttgcaccaaaaactcaggtcagttggccaataagagcaagcccgttaagggtctgaggtggccccaaagaccaatgctgaagaggtgacagtctgggcaggaagcaccgaggccactaccgcccccgtaatcgagaggccccgtgtgcgtgagcaaggctctttgcccacgtgtgcgcgcgctccagtcgggtcccggggcagtcacctgtcactcacgggggagggggcggccggcggggggagcacgnnnnnnnnnnnnnnnnnnnngtgcttcctgctctggtgccgcgcggcaccgacggcccgggacggagctcgggcgccgagtgcgtgccgccgccgagcagtagcaccgcgcgggaggaggagccgccgccgcgcccttccccttcctccgctcctcgcccggcccccaccgcgcccgcggccggcccaggcagcactcgcgagcagcggcggccccgccggcggccgagttgggagaatgcggcggcgctcgcggatgctgctctgcttcgccttcctgtgggtgctgggcatcgcctactacatgtactcggggggcggctctgcgctggccgggggcgcgggcggcggcgccggcaggaaggtgagtggagcgccctgccgcggccgggcccctgcgcccaccccccaccctgcgcccctgtcccctgccctctccgcgccgcccctgcgctcctccgcccggacctccgctcgcgtcgcccgccctcgtcccgggcctccgcgccgagtgcccagggcaggggtgcacccggcccctctgcgcacgccgggctccgaaagggcggcccccgcagcctttctctgccccctctcgtggacgtcgcccctctctctgctcgtcgtaattcgagtcttgtccggccgccgggagccccatcccctgcggttggaagtttagggatgggggtgttgggaaacacaaagggggtggggaggagaggagagagaggcgaccgcttttccaacgcgtcatgtacagcaggagagaggagtccaagtttcttttcagccctttgataccagcggctgcaaatcctcgtccctttccccctgtcactccgcggggcgtgggttccgtgtttctgccaccttctttgccctttacctttggggggcaggggcggccgctcccgtgccaagtaaagccccagggcccgtgcgagccaggggccagtgcgcccctgcgccccgagcgaggccagtcccggccgttcccttgcggccccagcgttaccctctgcccaacccggcccccggccctcccgcgcgagccggacgtggcctcctgcgcttgcattttccatccccactccccgcttcagggagaatccctcttctgtggctgtgtttttaacatgctccaggggccgagtgatctggctgtggggaccgtgtgagccgctctgcggttccgcgtcctcgtgccgccgctccggacggccgggccctgggcattcgggaggatggtgagcgccgagaggagccgggacagcgcggtcctgcggccgagcgccggccgggagagcagggcgtcgggctgtgtgctggagcatgccggcaggggacgtttgtagtgttttactggctcctcggctttgaaagcagcgttatcttttccgaattcctgtaaccctcgttactgtgacatttagtgtcaccgcaaacccagaaaattctgagttaatggagatggactacgggtggttgggttggaacaagagagtggtatcctgaaacaagccagagggaactaactagatgaacagacttcagttctgaagtcagacccctaaatgtccacgccggggtttggctgcttcagaggttttttctttgcttcattcattcattcatagccgaagatgttaggtggaatgggtgccttatgtggtttctggtaaattacgtggatttgttttatctagaagggcagaaataaagccctctttccacgtgctgaatcggcctagcttctgagctgacattgtactcttagcgttgtttttgtaaaaaatggtataggtagtatatgtacgcgaagacttggtttattcttgaacagcaaagagcatgcaggcagcaaaagccgtgcagtccattcagagatataatcgtgtaaaactggaatgatttttaaaactttgcttcccggtaaactgtgccttggccactctgcatagcctggtgtgctggtgagacctggcaaagctttctgcctttcatgcaaagaaaaccaaacacataagccacccttggcgtttctctttccttagtctgccactttcattagtacacgtgattagaaagagcaagcgtgctcgttcgcctcccggaggctgattcctcactctggtgggcttcagttcctggatggtgtgaggggtcttccatgcagaagtcttcagacactcctgaagtgtgtgattcttagtttgtttttttttgttttgttttgttttgttttgttttttttaaagaattcctggtggcaatatagacaggtacggagaccaggtagaaaaagtgggggaaatgaacaattaattacacatggattggtgatttgggattctattctttctgtcaacgaaccataaaatttaatgctaccccttaggatgctttagtgatttgtcggttgaggaagaggtgtgtaaatgcaatagcttttgaaattgcagtggaagactcattaacttcgtgtggtggacccagggttaaagagaagccttaagatggtttctgaaggaggtaaatagagccctgctgtcacgaatgcctgatgtataggaaaatcgtgtagtcttctttcttccccaattgtttccatggatttagacactagaagtgtctctaaatttatttcattctcataccaaaaaaaaaaatgtggtttgtttggcttgtaaagtatggacataaaaaaagatagcgggccatgcacagaaaggcagaatttaaaagctagctatagttttttagagataagtggacctatattttttctcttgcctcatactgttcaagtcagggcttttattccatatttagccagtttctgcacatcctgacgtttttcatagggtactaggctgcagtattgggctttagggatcgtctgaggggagtccaactaggatttctgctgcttcagcagcccagcccaggcttgtcattgtgtgccctgcctgttaagtaactcatcacagaactgttattctccacttggcaaaacccagagagccagctcacctcagattgcaggtttagtaaactaagcaggagggagtgctgaagaccaatctcaggcactgccgcacaactcgggactcaacacccaggctcaggacatgtatgttaaagcagtttattcaaaatattgtttaaaattatgtttcatttacatttgtgtccataccctttccccccatattttgctctttccccctaaattgatgatttgcacttcaagcgtgcctttcctttgagcttcttaaatgctttaaaattttaaccatgttaagtctcccctgggctttggtacgttggcagtggatggagccgcagaagagaggaagggatttctctggaaatgaagctgcctgtgggtgaagtgtggctgtttagggtggaaagggaagggttttctctctgctgtaagagtgtgtggagcctgagaccccttgcctgtgtgcctgcatgctgggaggtaagggacggtgttagttgagggacatgatccggagccctgggagcctgtccactttgcacagtagcatcacccttattccctgagctggcacgagtcctgtggcccttgcccgagagtccaagggtgggggactttgggtgggatcttctaggaatcatgcggggaggcgggcaggttatttcttggaacagtgaaggaccttgccgggctagaccatggtacacatggaggggaacgttagggtgtaaagttggagaaattcagaactaaattgtaacgggcttcaaatgccaagctgaaccatttgggaactagtaatgtttttgagctagtagtagacattaaagggaaatggcacaaatccacttattggcattgagtgagacctagctgtttacctctttgtgcttagtgaccttcactgatgcattgaacctctctgaccctcagtttcctcatctttgcagtgggagtaatcattcttacctcatggccttgttcggagagttaaatactgttagtgggtgctgaataactgctatctctaaaagaggaaaatgaaaaaataaaagcctaaatatccccttgaaagtgtagtgaaccaggaatcttaagttcacggtattcctgatacaattcttgatttctggaaaatagtcgtctttcttttttttatccgttacccccacctctgagattgatctgactggttcatttggggtttgggctatgaatcttaaatgctgttagagacggactttttgggaagttgtccagacaccatgccagctctcttgtacccaattgtggtgtcagaatggggatcccagtagtgggcagccatcgggaatgtgggtggagggtgcagcttgccttggcggttaggcagttgtagtgtccaacagtggacagacgtgtccctgaacgaggggttcctgtggtgggatcccaggttctgagctccactgctctccctctgtagccctgcccctcttgttagaagggcaggtcgctgtgatccctggaagcatgcatgacttgaggtggagcatggggccctcacgtggtttaatgggtgccaaaaatctgtgagcatcttggtggatgcggaggggaacacacataccactccttgccacctatcatcagtttggagtttaaagaaagtccacttcaaatgagagtttgaagttgacacagggaggacagtagcagggaaaaccactgtatagccagataatccgacagtggcactgtaacataaacttctctctttaaagaaaataaagtttcccaattctggagtgaagctgtggctgcctctgggtcagcaaacataatggaaacagattgtgtgactgctgaacagtgcaaaagtaacgagctcttccctagacccttgagcaaaaatgaaaaagcaactgctttacccagcactgagtggggtcagcttgcccaggctctgttggaccttggggtgggggacacctgggaggctggtgaaggttttatgagtcttcagacccgctgtcagtttccccaccctagctcctgtttggatgaatgatgggtgagtggttggtctcctgtttggaacagaggaagaggtggtcagaaaaatgatgggagagggggtgggggagattgggttggggaagacataatttcttcttgctactgctcatgtttcttagggctttggggagagggaagtcagtttgggaagatactgattttagtgtcaaagcaggcaaggccactgtcctgcctaacttctagcaagtccagaggcagtgggcttagtgaaagcaggtgtggtggggcgggggtggcggggggtgcggtgaggctgcctgggacagagacacaggtgtaagcaggagtcgactgtgaggctctggctgagatcccaggaagggaagctaggtattcctgggaaaagcctgtgaagtctcctggagtgcccagcagaattcacgtgatgagaaaacacacaaacctggccaagtctatgctccctgttggtttttgtgcttttgtccttgtgaagcctcttctggaagctctgcatgggtgatgctgagccatacaagtcagtggatatccagatggaaacacactggcttagccatgccactcacatgtaacagtggggcacttccatgctggttgttaaatatgctctgccttgagaccccctgagtgccctccggttcctagctgccctggtctttccttgggatctctttcccatgttcagcaatcaaagggttgaatcctgacacttgaggggcctcttggacccacttctgtgcctgtgccatagtgaacatgctgattgtcacccctgcaaatgtgccacttggatagaaggaggcctagccccacttccatgatgggaacaatcccttttccctctgagtaagtcttgattcactgttactgttgagagttctggttccaccattgtaatcttgtggccttgcctctagactgccttatgggtgaggtgtttttaaggaggagggatgtcttggtacttccatatgcaaacccccctgaatgggtctgggataggctgggcctggcggggaactctcctctatggagaattacattgaattcattgatgtgtgctcaccagtgatcactcctgtccttagagtggaacttgaccttgttctcttaacagtgtgaagattcctttaccttggccctgtgcttgatcttcatgatgaacccagtatggagttggcaggaaagctgtcttcagattacctgcccagtccagaaagcctctcccacctttctctattgtaaaccatggaaataaaaggggctcaagacactaatccatcttccctgatgggcccccacctttctagggttccctgctctaagcaggtggcactgtgctcctgcctggctcttgcctcctgcagcacagggtgaaacactggcatttttgcacttagtcatgtctactagtatgggccccagaagcatggggtgttttatatggattaggtttcttagcatgctgaaatgtagatgacagtgattcatcagggccggatttggagataaacaaaaactgtcacatagagtctcactcataggcttacatttaaaaagctttcccaggctatgggagttatatgagccccttgtctcactgaggcgggctgtcacaaagaagcagttaagggctggctgcctgggggctgggaaatgggccgatccctcatggctcagcctgcccttgctggctgcttgccctggtcaactgtcccttctgccgcagccttccaggagctccccatggaacagagagtctctcctaggccactctgctgaccacctcctcctgcccatggctggcagttttctgtccctaactcttagggaagaggaatggccaggagggttgggggtagagttactgaatttccagagttcaggtcaggacatgcatttgggcagggacaagggtactttcgggaccgtggttgctctggttcagtttcttaactctggcaccattgacatttttggctggctttttttttttttaagacagttgtactctgccacccaggttagagctcagtggtacaaccagagctaactgtagcctcaaactcctgggctcaggtgatcctttcacctcaccctaccgagtagctaagactataggcatgtgtcaccacagcaggctaatttttaaattttttgtagggacagggtttcactatgttgcccaggctgggctcaagcggtcctcctgccttggcctcccaaagcattgggattccaggtgtgagcgactgcactgggctggatcattctttgttgtgcaaggctgtcctctgcattgtatgatgtgtagcagcttccccagcctctccccactagatgccagtagttctcccacccctgatcttccaagttgtaacaaccaaaaatgtgcagacattgccaagtgtcctggcgagggtgggaggtgggcagaattgcccttggtagagaaccactgccttagtccgttaattttgatttcattccttctgtctgagccattatggttagaccttcttgtaatgagactgcctttctgtgtggtctggggtgaaccactgtggggagggctaatatattaatacgttttaattttcaaaatttaataaacactttcatggcactcactgtgcatagaaataaaagggctgcatttcatctcagcccttttatttcttctagtgtactgatgaaactgaagcacagaaaggttaagtgactttcccaaggtcacagagctcacaggtggcagacccagggttgtctggtggaagagatctcctcagggcctctggaggcagtggggtttttctgcaactcctggccgagggtttctgccagccagcagtgaacctggcttgctcctgctccctgggcctcccatgccccttccttgcattggcagtgccctcatactgcggcctcatttggaaagttcctggaaggcatcttggagcagatgcacacttgataatgctttgatagtagtgctggtctgttttgcttttttttttttttttttttttgagacaaagtctcactctgtcgcccaggctggagtgcagtggcacaatctcggctcactgcaacctccgcctcccgggttcaagcgattcttgtgcctcagcctcctgagtggctaggattacaggcacctaccaccatgcccagctgatttttgtatttttaatagagacagggtttcaccacccaggctggtctcaaactcctgacctcaagtgatccacccacctcggcctcccaaagtgctgggattacaggcgtgagccaccgtgcccggctgctcttttcttcatttttaccttttgctccatggaatttgtgttcctaccctccaggcctctgcctgtcctgaaggccgcaatcctcagctgcccctccggaaggagcagagatgaaaactggctctggttcttttcatttattctttcagtgagtatctcttgagaccctcctatgtgccaggcactgcttgagtgtttgggagtacaccagttgttgtagcagacacggaatccttgtggtcttggagctttcattctagtggggggctgcggggagccagacagtagacatgaagtcagttatgtcgtgtgcagaaaggtgctgtgtgctgtggaaaaaatagagcagtgtatggggattagggatgagggcggaaggatagttgcagtattaaagtggtgatcacgtaggctcatggggaaggcaggattggagctgagactaagagggagccattgtggttccctctgcttcagaggtagcccctggtttcatcttcgtccagcctctttttcggtgatctctctactccttggtttcttttgctaaacaaatgagccagttttctttcccgaaggatgttgcctttggttggctagtggtggagtttccctccatgctgtagacatcttggtcacctgttcttgttctggtctcctcgatgaggcatgaatgcatcctggttaaaaggttgtgtgtactctcataatcgcttcccttactacagacctgcagctgctcgaggcagttttaatttagactgctccagcagtttaatttgctgatcagcttcgtgggatatgcttgtggaacaatctcatttcttgattcctgagctgacttctgtgaagcaccaagcatcgggtaagtcattcattgttaggtgcaccattgaagaacagtacacattcttaaagtgctttctgcacatattgctgtttaacgagaaatccccctgggtccctgtgcaccttttccagcacaggatttccgctgtgatgtgatctttgggagttgctgcgggtgggagtggggtttgttgattcatatttgcaggaaaccagagatcagatgcctgcctgatacccaggctttggagaggggggttattcttggcaatgtgggtaacactgagcttctgtgatagatagtattgtacttggggacagtaaaatggagatgtgacttcatggccaatctcagggaggcggaactgtgggaagttgtggctggtcctggttctcaaggtgagggcatgcaggtgcttttcatagaggccattctcatttatgaagggtcattagatattttatcggattggtaggtaccaatcccataaaaccattgggatggttaggcaccgtgcgtccagtgtacttctggataaaacaactggagcatttacatggcgggaaaaagaacaggtaatttgagaggccttcacattcaagagtggccatcaaggtttcttcctctctgcgtcagagaccagtccagggagtgaactcttttctttctgacaggctgctgccctagaaaaatgacgcacttcaaatgaagggtctttcttagctaaattgccctgtgagagcttgaggagccggtgcaaattaaaggcctgtgttttggagatgcccatgaattaagtactctgttatcagtatttgggtaagtgtagatgactgttgggtaggggcatttgtatggctgtcctggatgatgagagggttggcccagtgtgggatgcctcccagtctcattgtttcctccttgctgcctctggggctttccccttgacctagatgttgagcttttgctctgtgaccttcaaaaggcctgccctgccgcactctccttcccctcctgcccttgtcctgccccatcccctgtgccagggagctcacttagttgtcttcctgtctcacttttgatcatcactaatttcccctgtgtctggaatacaactttttcatcaattccgagaggccattatttgtcaaacatgccattattttgtggaccactaggaaagaaaaaacactgtccattgacctgtgacacaacgggttcttatcagttggcattcttattttctacttattgaaagagctctttcagaccgagacatcaatttttccatatatcactctcgggcatagatagatacaaaggaaaatacaagtgaaatacattgagcaaagtgttctaaaagtttttcagagtccaagcactctgagtcactttttgactcagatgttagtgcctattttcttcaaacagagtcatccactgtgccaccaaaagcgctggtgatgtagcatttcctaaggaaaaaaatccataaaaatactaagagccattggttctggactttgaagacagcttggcaatgaagtcgaggtagccagcctttgactcttctgggaattttgcctaactcctcaattcaccatccattcctatcccaccatgatttggtttttagggattaagagtgcttgcttcattgtcgtttcttggattttcttctaagccattgacgtatatgtcctgcagatgtggatgattgagcatgggctggtaagaatgcatcatgggccttgcccagcccatagcattgccgacgtcattgattgtgagctgcattccagtcgggggtggtggaggaaagggcatcttagaattgaccaattacagcctttctttttctcgtgtgtcacattgcagttgggccttcatatctgcgggttgcacatctgcaattaaggcaattcctactttattagtggttatattattaaaaatccttattttttgaagaacaatacaaactgtggatacaatgtgtcgtatttggggggggatcatggaagaagccagatgtgctgttgaagttgaccagtgggttcatggagttcattctactgttttatttttgtgtacttttgaaaagttcatttaaaaaatttaaaaagatatttactcatgtatgcagcataaattaaagaagcagctgaaaactagtatttttgtaaaaagcagctcaaagggtttgtgatcgtattagtccagaggtgcttctgcctcacagctcttctgtagtttgggatattccacagtgattcttttcatagggagcatcagagattacgttagatcctgacttagtacctgtatcaccagggaagcattcttacattggttgctgtttcttctgtgaggagtatctacattctttggaaattgctaatcctggtgcagtttctggtggtagaggatgagctcaggcggtctgtgaggtcatttctgcctaagcagactgcccggtggaccaaagaccctgttacccaccagagttcactgtagatgttttattttattttatttatttatttttagagtcagggtctcaccctatcacccaggctggagtatagtggcatgatcatgatcatagctcactgcagcctcaaactcctgggctcaggcgattctccacttcagcctcccaagtagctgggacaacaggcatgagccactgcgtccagccagatgttttattatcttgactacacccttctcatttgccaggcacctctttatgttcagtctttctgccagatttttcactcatgctaggcagctttgcttgtggttataagctatccatcaggagctgtggatgacttgggaagctgagtgggagaccgttaataaatatgtgttagtccttttggttctcccaacaagatattgatgctaaaggctattttacgtggtatttgtcaataagagattttggcaaattatgatactgcgtatcttctgtaaggtataattcctggtacttcaaatttatgtcagctttgtctctgagatgtctgaaatgctttagagccattgctcatttgtcttgcttttcagcatgcctgggagaatgaacagctggggagaaagaacagcttttcttcccacattcacacacagtttctgatggacccacaggttactagcctgccccacgggtcatgcagtagcaaagttgggactagaatttcagtgttcctccacctgcctaaagtacggctctggagaaagtcagccctggctgtcctggtcttagtaaagctatagttcgtgaaacatcaggttacaaatagcaggtttccctcttgctgacgcagagctgcagcttcaggcttggaaggtgctgattactggggctggtgatctactaaccctttattgaaactgctgatgtggatgatcgagaagcagagagccgggaggagaatgtaattcaagtctgggttcttggatggtctaagctccaggcctgaggctggccgtcatgaaaggaacataactgtggctgtccaggcctcataattgggctcatggaggcagacgggctcatgaggaatgtccctatggagagggttgctgaggctcagcctccatctgcacttcagtaacttaggagctcacacattcttatgggtcaagaagtaatctgggtcactaagcatttgcctaggaagatgtgaatttggcgtcctttgttttagaaagaaaagggatagaggtaaagtttcccctcttcctggtaataaatgtgacttggcatatgtcataattgcagtagtgtttgtacttaagacataggttttagtttagaggatttttctccctaactggcagtggagagtgtgtggagtcattttccttgtactggccctggaaggatatttttggtgatctaatttttttattccagtgttgcaaagcgccgacatcattatcaaatgtgccatagttgtttggaagcgaagctctcatcagctatgtaagtttttattttaggttactgtggagaaggggaggcctcggtggaggactgatgtgtgttcagagtcggagctttctgcagaaattcgagtcctgttgacccagggagcaggccttgacatcaggccccgtgcatgaagcagtgtgatgtcccaagcagtggtgctctgaccacttgccatttaggtcctggtgccagcgggaaggtctagcatcagcaggttgccagggtgactctgtaaatccatactgggggctttggaaacagttttgcctgtttctggccctagcctcgtttgacagcagaagcccaggaggcttgtgcatgggagctcttggtggacagctagctctgggtgtctttctggggctgctgtgacatggcagagaggatgcatagcacaggggccactggcctgggctccggagcagactctgggtgtgcattctggcttatccagttagctctgtggcctcaggcaagtcacttaacccttcagtgcctcagtttccccattcacctatcatcaggttgttcaatgatgaataaattagtttatgtaaaatgctcagaatggtgcctggtacatacatagtaagtgcttaaaagtgttaactgctgttgctaatgtcaactgtcactttgaaggcggggaggtgttgacacgggttcttggggaagctgcatcagtgtgctctcacatcacatgtgacacgtcgcaggcattcacgagcccagaggctcctgttccccagccagagccagcctcctctgccaggtttgaagtgaaccaacctactttcctcgaaagcgcctccagcctccgcagaccatgcctgaaactgtcattcctaggtaggtgggttgttttggaaggagtgtgaggatgaaggggctcctgcagccctttgcttcttccttgggtggggaatctgagccccagacagcatgaggaagctggtcagggtcccccccagctggtgtgaggaccgagtggcccctggggttctgcaggtagcttcaggccagaaccctttccccatccagtgttcagtggccaggagattatttcccaattccacccttaatcttttccagcttgtctttgaaaaattataccgagatatggttttaagtgcgtgctgtttaattttttaatactcttattggcaattggatttttcaacatcttgagctgttactatctgaatatagcgtgttatttgaaaacttttctgcaaggttttaattaggaaatgttctttcattagttcagtttctggcttgcttttgaaactgcagatgagtgacaagtggaagacaaattaataattgtggcaatgcaacaaagcccccctgtgagggctgaggactagttctgtcaattagaaaagtgctcacgtggctttgctgatggctctaattaagacaactcacaactggattgcagatcaatagatacactctgtgatgattttaaggaggaatgacctgtgtgaaaacccacgtttggtcatgctaaccatgacgaggaaggatggcacagtggttgggagcctggcctgtcatgttagacctggttcagatcctgctgttactacggagtagctgtgggacattggcttgcgtttccttgtctggaaaagagagttagtgagttgatgaagatgatgctgacgagcttagtgaggacgtttatttgtgcttgctctcccttcctgcaggtacttctggggctggtctggcttgacttctctgacccaggacgggtcttgcttggagcagacctgcaggtcagtggtgacatcaggtgtgaatttttggactaggagtgtcagtcggggtgcagaggcacctggtgaggcaggcttttccatccttcttctctagtccgtgtccctcctttgggcaatgtggagttgccttcaatctgggaaggtctctgtttctttgtgtaaggtgaagctgtggtgctgaatgaagcaggtgtcacatttgggttacatttttaaggttctctaatcggtcaaagtgctgtgtaagtttccaggggcaccgtagaacaaagcaggcttaatggattaatggacatgattgagtgagctgatgggttggtgatttcataggtgtctggctttaagccctgccttgcctttgcagttccacagccattcaggctggtcatctcttcctagggcctctggagttggcctaccttggagagatctccaatgtgccattcctcctgcagccgactctccttatccctacttcctcagtgctgagccagaggagagtaccttttatcacttctgtatcatttatttatttcgggaagggagtgtagtggctgccaggagagggaggcacacatataaattgtggacaaagcctagaaacctaggcattgcccctgctcataggaagtcatatgcatggaacatacgcactggagtgctagttagacagctgggatgatagagcaggggatccaggctgatacatcaggggaacttgcagagagaataggggatccaggatgatagagcaggataaggacagctgtggatggagcaggacgactggataatggagcatggagccaggatgatggaacaagcagccaggatgatggacagggagctgggatgatggagccgggagctgggatgatggagcagagcagctgggatgatggagcagggcagctgggatgaaacagcagggagctggaatgatagagcacggcagttgggatgatggaggagggaagctgggatgatggagcagggaagccgggatgatggagcagggaagccgggatgatggagcagggagccaggatgatggagcagggagcctagatgatggagctggcagctgggatgacagagtggggagcaggatgatggagcagggagccaggatgatggagcgggggggccaggatgatggagcggggagctgggatgatggagcaggcagccaggatgatggagtggggagcccagatgttggagcaggcagccaggatgatggagtggggagcgaggatgatggagcaggggagccgggatgagggagcaggcagctgggatgacggagcagggagtgggatgatggagcagggagcgggatgatggagcggggagccaagatgatggagcagggagctgggatgttggagcagacagttgggatgatggagcagggggctgggatgatggagctggggggcccaatgatggaacaagaagccagactgatagaacagaggaaatgatctgagaaacaactttgaaaggtcacctgcagccccctgatgcttgcattatgttaaaatgtttgaaaatttagaatcctcattttaaggcattgatctttccttcagaaagctgtccttgctgttaaacggtgtccggagagtaaggagatggtcagcactgagcatttagtttcttcagaggaatgacagtgggggttactctgtttttacttggagtatctggattgttcaggaccaagtaaaactctgtaagaaagggttggaaatcctggtgggcctctgttagcccttccaatagaagggggccggagggggcccactgtctgtgtccttggacctgcatgcaagctgaaggaaatggtgcctgctgcacatggaggagctggagccgtggacaggcctgagctcatctccatcagcacccggatgttggcgtacatgcctgtgaaggtgagggtctgcacttccagcagccctccccctttgtatgtcactttggacacccgagatttccctgatttgcctggagcctctgtgtaatttttaatttgatcccctgcgtcccagtggactgtgagtgtcttgaggccagcacaggcttggcccctcccacagcagggagacagtggggagccaggctaacatgggcccagggatgtatattctggaaggagggcaggctgggggacggtcacgccaatatcagagtgtgaagtggggctccatgagaggtgagtcctcatcaggaagggccgaggaggggacctgtgggcgaggcctgttgaccagaatgatccagtgtggcagaaggctgtctgggcttggagaagatcctgtgcagagatcctggggccagaatgaacttggcatgtctgggcaaccaaaggaggagggcaagctggtgaatgggacgtgaggtcagagagacagccgggggatggtgagcatttaggatctgattttgtctgccctggcacttcctgtgtctggctcagcaccgagacgttgctaggtgagggagatgaggctgagactggtgggctcgggggagaatggctgagagccagggttgtggagggtctgccacatgggggaccatgcctcacaggttcaaggcatccctggcccctggctccctcctactctccttcagctgtttgcctgctgggtgactcagctatgggctaccaagtcattttgcccttttctgctgggatctgcgtgctgagtctctgactggtaacatgctgtggtttggcagcatgcttgggagttgacatcatttctgggtgcaagtctggctttttctccctggtgcagggtgaacatgggattaggggagacaagaatgtctgctttttcgtccagacatgctgccttgctcttgcagctgaacagaccccagctgtatttgtaagttaagcccttaaatcctgtgccctaaaggtggaggtgccatttcatctccgagaagtggagaaagattgtgcagtgatgctgaggtacaggagagagctgatgaggaatagaatgatcagttgtttgtaagcaatctcctctcttctggctctctttagcaaaagtttttattattaactctcctttcaccactgcggatggcagacatacctgacggcaaaactgaagcataccctgacagtgaccctgtggggcagacacacctgaatgtgtgtttggagttttgagctaaggaatccgggagtggccaacctggagattcattccttgtttatgaggaacatctgagcccctatcctgtcccgtggaacactgggcatacagatgagcgaggccctttgttttgggttaaatgaaggttgccccgtggaggctgttagaggatgctaggtggaaactctatttataaaccacaggcttcaagcagttgcagttttcctgcccagtccactgccactgggccatccctgtgtacaggtttcccactcgtaagcccctgtgtctcatttgctggctctgggtctccttcagcttcttggacctggtgccgtccctgtaggagttcattaggggtctggcatgatccagttcatcactggaaaatggttctgaatgtaggcggtaatgtttgtgattgtctaggttgaagtccggggcagtctacctgtttaggcaagatgcaggattaggcatctgaggttctcttattcattgcattttggatcttctggagctcctcctggctggttattttaatgctctataccttagccaaccacttacagaactgttttgataggccactgacttctggtgtagacgttgggggtgaaggatgtttgacagatgggacggagatggatttatgtttgtgaaatgttggggaaacccgaggcaatacctggagcccagaagagtgggctcaccgtatgtccacagctctatcagtgcccctaaggtgattggaaactgcttgctgacctgcctggttaaggaacgaactcgggttccaccagaaacgtgctgagagatttccgtccaccttcatggaattcacagaacaaatgacaagattttaatccaggtcttggtattcctagggtgccagaggtgaaactgagaaaattttgctctcaattatttggcgagtttgtaggtagagaataatacgagctcctggagggctggaatctggaggcatttcagcaagggtttagaaagggtgggtgatggtgactagggatacagcacgttgctcagctctgggctgagaggtggttagttcagcctgacgacccagcagagcacctcctggtcattctgccggccctttatctggtgaggtagggcaaggagggagttggagtgaggaaaaatgcctaagtcaagggaatagagggagggcaagataagagatggcccttgtgcgagaactgtctgcattgctcactctttggagattgatgctttctccattttacagtttttagggggatgttcttactggcaaaggaggaaaacagctgtaaagtgagcagtttttttttcccccgtgtgttaagggaatttattttccttttcattctttgttcctccttggctcacccctgctcaggacataacttttgcagaaatgaggattttgctgcagcctgaatctcctgggttggatctcttagagcaattaataacttgttattcatgtgttcggggcacagccctttgtactcagtggtgcgtccgtcatgctgtttgtgctattggggaccactaagagtgctctagaaagttggtgtgggcagtgctgagctttggagtcatggagtggctcaggtgtcagccctgccacttacctgtgtgcccttagacaagtacctttctatgtctctgttactcctctacgagatggagtttatcacagggtttactgcatgaagctgtcacaagggttcaacaagatgttgcctggtgagcacttaacccacaccaggcacgtagggagaaagagctcagtagagtgtgtgtgggaggggtcttcttccatcccagggagggaggtatttcacctgggaaggtcctggctgggagctgtcttctaccccttctttatgcagcgggctctaagccagcatctggcaccgccctttccaaaccagtgcacactctccccatagggaaggggcctggcctgctggggcatgcttagtttctgtattttaagagctccctcatctgatgaccggtactaattaccgaatttcacaaatgaaatatgtgcagggtgaaggaatatgcctgttgattgcactcgaattactgcagtaaaattaaatttcaaggactgcaggagcctaagatccttctgctgtcctccacttcccccatcttaattggttttccttgccatctgtctttcttgcctttactcccccataactgccagcccgcactgttaaccagcggttttcaatctggctgtacgttaggaacacctggggaaaactttgagctgtagatgcctatcacccaccctagactgattcagtcagaatgtctggctgtggggcccaagtgtgttttagaaaaagctccccatgtgtgaatgactctcacgcagtcaggtctggggacagctggttaggaaggcgtcgctgagagtctccatcttttgggagtaactgctgatggtcatggagcccttgaatatctgtttggactttttgagggctctgagcttgagcttggtcttctcttttggaatacttgggtgtttgctttaatattcagagttaaatattgatgggcatataatgaaatgcctactggattactggacgatgcttttagctatgagtacttactctggaagctctgagaataataaaaacgatgaacagcagatattaagtgacagtttagaacagaagaaaaatacaagttttcttacaggctcttggctaaatgaatatgggggtggactggggtattcagtagttgagcaatcctggattctatttttccatatttgcatctccccccgcccccaatgtttttgctttatttaacaatttttggggtaaaaaccatgtaacataaagtttactgtcttaaccatttttaagtgtacagttttgtagtgttaagtgtagtcctgttgtgaaactttgtcatcttgcagatctggaactctgtatccattaaacagtaactcccattctcaccagcccctggcacccaccattctgctttctgcctctgtgcacttgacacctctaggtgcttcatgtaagtggaatcttgtaatatttgtccttttctgattggcttgttttcactagcatgatgtcttcaagattcatctctgttgttctgtgtgacagggttttttttttaattcatttttattgaggtgaaattcatgtaacataaaattagccattgtaaagtatacagttcagtgacatttactacagttgtacagctaccacttctgtctagtttttttttttttttctttgagacagagtcttgctctgtcacccaggctggagtgcagtggcgctatctcggctcagtgcaagctccgctacccaggttcaccccattctcctgcctcagcctcccaagtggctgggactataggggcctgccaccatgcctggctaatttttcatagttttagtacagacggggtttcattgtgttggccaggctggtcttgatctcctgacctcatgatccacctgcctcagccttccaaagtgctgggattacaggtgtgagccaccgcgcccggccacttctgtctagttttaaaacattttcatccaaatggaaaccctatgcccattaagcagttgttccccatttcctcatctccccagtccctggcaaccactagtgtactttctgcgtctgtggatttatccattctagatatttcgtataaattgactcaagcactgtgtgtcctttagtgtctgagttcttccacttgccatagtttttgaggttcattcaggtagtggcatgtatcaactttcccccccgacagtttttattatggtaaaatacatataacaaaactgaccattttaaccatttctttctttctttttttttttttttgagatggagtcgctctgtggcccaggatggagtgcaatggtgtgatctcgcctcacagcaacctccgcctcccgggttcaagcgattcttctgccttagcctcctgagtagctgggactacaggtgcacaccaccatgcccggctgttttttgcgtgtgtgtgtgtgtgtttttagtggagatggggtttcgccatgttggccaggctggtcttgacctcaagtgatgtgcccacctcggcctcccaaagtgctgggattacaggtgtgagccgcagtgcccataaccatttctaagtgaacagttcagtgacattgtgttcacattgttaccaccatccgtctttagaactcttttcatctagcaaaactgatactctgtacccaaaaaacagtaactctccattctccctccctgcagccactggcggccagggttctaccttctgtctctgtgaatttgactcttctaggtagctcatgtaagtggagtcattcagtatttatccttttgaattggcttatttcacttagcataatacctacaaggtttatccatgtagcatgtgacaggatttcctttctttttaaagctgggtaatagttcattctatggacatacaacgttgtgtttatacattacgctgctaacacgtgcaacacatttgctattcatcctactgtgaacacaggtgtgcacatttcccttcgagaccctgcttttcattcttttgggagtacacctggtggaactgctggatcatatgggagttctgttttttaatatactgaggaacctccatactgctttccacagtgactacaccaattttacattcccaccaactgtacacaagggttccagtttctccacatcctcaccaatacttgttattttctgttgtttgatagtagccatcctaatggatatgaagtggtatcttgtgattttgattatcatcttttttttggatgagggaaagtttgaccccatatgtgggtgtctgtcaccaagatagaatgaatgtaatttccaaggaaaaataatcccaggcaacctcttctggattatgtcccaactgattggaaatgctgggaactttctgtggttgaaggaccttgacatttgttgtcaaactgcctgtgagtcacttatcttctgggggaaaataaacataaccgtgtcttccagtctgaagtggggtgggtgggtgatatgaagcattgcacacagcagagcctgctgcccctccacagcctctgcaaatgccgtgtgaaggtggtggacctgctaccagaactggtgtcctgctgtctctgtagttaactcttaggagaaataacggttgtgtgtgtggaggtgaagaatgggaagggaaggaggggtggggagggctggtgcttctgaggttcccaaagttcctggactcgaattttctgttggcaaataagctggtcagaacttaggaatgtggtaagttgatccaggaagaagttgaaggtttctatctgtgtttttctgtgcggttgtgtatgtgtaacacgtttgcagaaatagttgaagcttattattttcttcaaaagatcttattttctagtgtgtaaatcacaggtaattaaatatgagttaaagtaagagagagacccttgggctatctcagacttagctttgagagagagaatgatcatgggtctaaggcatcactcttggttttataggtttggaaactcaatgttattagttccatctaggagttatcaatgggggattggggtttacatgcatcagaattgtaagatactgctaagaatgacagttcattaattgatgagaactgtgcctcgctgagaaagccagcactcctggggtgtgtgtactccgcagaccttttcttttgtttctttctttctttctttttttttttgagacggaatctctgttgcccaggctggagtacagtggcacgatctcagctcactgcagcctccgcctcctgggttcaatctattctcctgcctcagcctcccaagtagctgggattacaggtgtgtgtcaccacatactaattttttgtattttttttttttttagtagagacagggtttcaccgtgttggccaggatggtcttgatctcctgaccttgtgatacggccaccttggcctcccaaagtgctgggattacaggcgtgagccattgtgcccggtcctcagcaaaccttttctatcggcctatttctatctattttctatcggccaccttttctattggcctatttccatctgtctgaggaatcttgatgcatcggccttctcgttctggggatctttctgtgtatagaatcaataccctctccttagggtagtgatggagattgatttttcaaaaatcccaacatgtaatttatgaaattattgtttcagctccagactctgtgctctgttctgcagtgttggagctaggaccgcacatcccagctgctttgccagtggcttccgggccacctccatcagcaggaggcggtagaagcaccagcaagatggggctttggtccttcctgttggcttcctgttgccccagctgtagctgttgaattcagtcttcagttatcccagcactggccagccagcctcatcgtccacactccctgcagatcccaccactcctccaaggaagtctctacctcagggccctttggctacgcttctaaggttaagtctaaccggttccctcaggcctaggggtggtggctgcttcctgtcgttgctacttccctgatatctagaattttcctttttctacccagttacctggttactgactttctacccagttaacaatttatattaaagcccttctgttcaaaaagcttatgtagtttctgcgttctaattggatcctgactaatacatctgactttcaacattctttagtaatcagtcagcaaaatgatttcatgagatagacgtattatatttaattggattacagttcaccttatattcctttagtttttttttgtttttttttttttgtttttttttttgcactgatctttctgattttcgttaggctcgtctatgtaatttgagacataactcctctcattagctactttctaaatcatcagacttgagttctttcctggaaagatcaccacagatggctaatgtcattcattttgttggctcttttggctttatagtagagggtgacaattcttttgtttttggtttttttttttgagctggggtcttgcatgacctcactgcaacctctgcctcccgggttcaaatgattcttctgcctcagcctcctaagtagctgggattacaggcacgcgccaccaagcctggctagtttttgtatttttagtagagatggggtttcaccatgttggccaggctgatctcgaactcctgacctcaggtgatctgcctgcctcggcctcccaaagtgctgggattacaggtgtgagccaccgcacctggccaagggtgacatttctaaaccttatctctaaattctgtgtccattattcagtattcctttaacttgtagagcatggctattacgtgtttaagcaacatatatctctaaaaagattcgaggccgcttataagagaaagtatattatgtgtaagcacagattcattaaaataagagtttaaaaatctggggtcaaatttagggggtagaggggatgagggataaaaaggtgaaggaaaaaagaagtggatggagaattaaagaatgaaggagaattaacactgaacacccacccccatggagccagatcctggctaggtgtttgccatctgtgtttagtttaatgctcagcataatcctgcgtggcaggtatgttacccccatctataggtcaagaacctgaaacccaaagagctggccgattgtgctctagtccccctatacatttcagcttacgtctactgacactaagccaaggggagctccttcagttgaacgtgcaattgtatcttggtagccaaagcaagaaaggaagcatgttgggttgcatagttctcatttgataatacaatgaaacattttcttgagagagataaacattttcttagccttcaagcttgataagaatctagtggatattaacttaaagggcactgaacatgataatagtgtccgtcagggggagaaataacagaaaccaaaagcagagatgcacacgtggccgtttatttaaatcaaacctgaagcagaaggaggagcattagatcacagtgtgtaaaggcaattctaggagaaaacgatggactgtagctagctttctgcagtcctgacctggccaagggtaaaactagatcggctgcgggctgtgttccctgggcttcctgctgcttcactcctgggaggcagcacagagtggttgttacggggaaggttttcctaagtgctgtgaatccaccctgggccgtttactggccttgcacatgtgggcaaggtacggtcaagctcagcatgatgacattttagccaatgacagatcgaatacccaatggtggtctcataagattatatactgtatttttactgtacctctgtgtttagatacacaaatactattatgttatagttgcatacagtattcagtacagtaacaagcagtccaggtttgcagcctaggtgtgtagtaggctataccacctcgttttgtgtaagtgcatgctatcatgttgccacaataatgaaatcacctaagggcacatttctcagaaggtatccctgtcattaagcaacacatgacagtacttaatctctctaagccttagcttcatcccttcttaaatgagggtaataatactgtttcgtccacctgtgtgtgtgtgtttgagatagggtctcgctctgttgcccaggctggaatgcagtggcacaaacatcactgcaacctcgatctcctgggctcaagcaatcctcctgcctcagcatcctgagtagctaagaatacaggtgtgtgccaccatgctggctaatttttttttttttttttttttttttttggcagagattgggctttgctatgttgctcacgggggggtcaaactcctggtttcaagtgatcctcccaccttggcctcttaaaatgctgggagtacctacgctggcgtcccatacactcattaaagaggttgcaccatnnnnnnnnnnnnnnnnnnnncagcactttgggaggtcgaggcgggtgggaggcgggtggattacctgagctcaggagtttgagaccagcctggccaacatagtgaaacccccctctttactaaaaatacaaaaaaattagccaggcgtggtagcaggcacctgtaatcccagctacttgggaggctgaggcaggagaatcacttgaacccgggaggcggaggttgcagtgagctgagactgcatcactgcactccagcctgggcaacaagaatgaaactccgtctcaaacaaaaacaaaaacaccatatgctttcccaacacatctggacagctgatattaaaaaagggtgtatgtagtagaattaaaactattacaagagaaacagagccagacagtttggggaagggagaaaacagagaggttgtgggggcacttaccttgaatcttcttaggtcccttgtgtgttgttttgcctaatccttcccacacgtctgcaaagaggatgatctccccacgtagagacaggaagcggattccgatacctcgccttccctgtgttagatgtgccgtagctcctactgagggtgaggattaattggagatgatgcaagtggacctctaagcacgggccgcgatgatgtcgtagttcacggtcacaggactgtcactgctgttacaaactggcccttctgctccgagtctgctggtcctcatacggttcctttctgtctctggttgtgttggttaagacagagtagctgcaatcagggagagtgtcgaccctgaccccaacaagcagggagagctagtgcagaatgtgggcagtggcagcagacccgcggggctgtgacactgtcctttctgtggcttgggtggacttcagggtgacccatctagcagagtaaaaatagtaaccccacatgctgaccatgtaccccctgctttcacgcacttttatgggtgaattcacctatccgttatagaaactccatgaggcgtttttattatccccattttacagatgaagctgtcagggagagaggttgagttgccggcagtctcacatgtagaagtggtgaagtgggaattcagacccacccctgcgggctcctcagccaggcctgctcttagcatcccagtgtgctgctctgtgatgagccccagtattgggatccactctccagatgaggtttgaagagttccgaagtggaacgtctttctgggttggctggctgtagaggggttggtgactccagtgtcctgtggtggtagacagtctccagccaagggcatgtacttctcacctccctgcctcgtgaatctggtcagtctggtgtcaaacttgaaccagtagactgctgtggatgtgacactgggcgtggtgcaggctctgtccttgaggggcctggtagccccacctgggtcccctggggcccaactgccatgctagaagacgtccaggctgctctgctggagaaagaaaccgtgtggggttgcctggagggtgagacatgttggaggggagggagggagaggccaaggcctcagacaggtgagagagccccagccgcgaggcacctgtggtctcaccatgggacataagaacttgtttaagccatgacgttttgggagggcttttgtgcaggaatggcacccggaactcctgcttcccatgaacccagggctgtgggcctggctgctgggagtgagccatttgctgggccagggatttgccctgctgcagggacttttctaacccagccgggccaggctcacctgggggcccttttgattttgagaggacgcatacctcagcctgcattttggtgtcctcttgctagcacctgccagctgaggttgagccatggtggacaatttttccttttaagacgattctagttactgaaccaaagatattaattatgtgcttatctgtggtaattacaactaaagcattctttatcactgcagcttagtcatttgcttacgtgatttaaatgtgatatatgttaatatgcatatctcgtcaaagggagtcatgggggtggcatggttagagcatgctggctgagggcaggaggccagaggtgtctgcgtctccctcgtccatctcgttctcccctcccgccttccttccccattcccctctctcccttctttctgtcccaccaggatttctttaaggtttgtgtttcatcaccatcatcctgtttgaaagtttttttttgttgttaatccatcagtctttctcaattcataattaatttcttccaacctccctccctgctcccatccttggcagcctgggggcagcaggttgggaactaccaccaatgttgcaccttcttaatattcttttatgtatctcttctcaaagatagaattagtttggtctgaattatacatacaatcatagaatcaaagtgacttgaaacttagaaggtgcattttcttttagggtttaattcactcagaggtcctccaacccagcctctcattcagtaaagacttcccttcagcaacagatggtaaatagattctgcagaatgagtaattccttcatttctgtctgaatggtttgtttagaagcaaacacaatgattccctctccttattaaatttgttgggagaacatcaggatcatactaagttactgtccaaagctacaactgtgaagagggggtgcacggtgacaaaaaagagaaatgtcgcttgacatttcagaattcaggcccagtatcatcggtgccctcataacattacacgccaaaccctttaataaaactgtcaatccagattgttaaaacactgagcggtttgctcaggagatagaatatttatcatactgaggttcccagtttttaatgagccaaatatatttccttatttttttcatgatctttaatttatcatcttaaccatttttaagtgtacaggtaagtggtattaagtacattcatattattgtgcagccatgtccaccgtacatccacggagctctttcaacttgcagaactgagactctgtgcccattaaacacaactcccactccccactctcccagctcctggcaaccaccattctactttctgtctccgaatctgactactctagatacttctattagtggaatcatacagtatttgtccttttgtgactggctcatttcacttaacataatgtcctcaagattcatccctgttagagcgtgtgtcggaattgccttttgaaggctgagtaatattccattttggaggctgagtaatatgtacatgtgcacattttgtatatccatttatctgtcagctgacttttgggttgtttccgctttctggatatcatgactagtaatgctgttcctcacattttaacattcaaatgacacatcataatttcatttattcttgatatctcaggaaaattttaaataccgtttaatagtggagaattatggtaacacgcaccaaatgtacattatatttttaattgcttggcaatttgggacaacttacaaattctgtctttaggtttggtcgctatacaacagataatgctgctatttctgctttagtttcagggatcaaaatgagttaatacgtatgaatgtcctttgtaaagagagaatgtaaatgtttgtcgatagaaccagaatacattctgaactttcttgcttgtattctgggtaggtagacatttaaagtagagatttggcataacttagttcttccagaaacttcaagcactttacactcactctttttagcccaggtttgaattatgtggggtcattcatggggtttatgaggtttgaagacatacttaaataacatgtgggttctctagaatgaatgtggaaggaaacattgtactcctgtggaatgctggcaccctaacaggagtgactttctcttttctctctcttttctccttttggtcaactctgtttgtatgtagtgtgagctctatactgtgggatagcattctttttagaatgcatgcatgtgaattgtgtagtgcagagatttgctatatccatttccagaatgtacatattgaacactgttttgcgaaaggcaggtctatgcaaactaccccaaagtccgaggaagctgagaggctgaaggaagagcctgacaaatcccgtttcttagaaagaaacatttaatagagacctacaagcagaagccgcatctgtgtctagggcagcggtaagacgagatgggggagccccacgccattaccccccagacccagggcttctatgccatagcggggagggaggagtggttccaaagggatacgtaggacaattgaagtaagataacatcaaggttgtttgatctgagggcaggatttactgtaagcacctgctcttacacaggaatagtagataaatgggaagtcttagaggccttcttggatagggggttaatcagaagccaacgtggcagattagcatccaagatggagttgctttagcctccacaagcactgactgtatgccaggagttgaccatgatgtgttatgaggcactggggaattcattcctatatgaatctgggtgattgacaagaaattctagtggaagtgacatgtaggttgagctgtgcattgagcgggctggtcacgtgcccccctttagatgttcccgatcgcgcggaatcacgacatgagaggatgagatcagagttctgtcagcttcatgtagccaaggactttcaagttcttccttgaggagttggccctccctagtctcctctgttacaccagtcattgctacgttagcagctttgcaaagtaggtatcacgctccatgtgctctgtgcctgctgttggcctgaagcattgtcatggccttgcccaggtttgctttccttaagggcaccatttggtcccttttgtcaaacccatttgcttacacaggctgctacactatttctatgattgcaattccagagtttccgagtcccgggatgggggtgtctgatgttagtagcatgccatggtcagatgtcttggggaatctgggggtaagcatagttgaatacactctctgctgcaagtttctcaaaaatgtgaatacaccaatggtgtttcatgaatccaccaagaccatacagcactatagctttgcctggagagttttctctcctcagcaaagctctccacctgtcccaagctgtgattcccaagaaatgccagctgggaagcctggtttgagggtagcatatgctccattgccatggccaagtcagtacaagccttttagcaatggtgcgttccctcagaaggtttgctgtggcccatttagccatattttggctttggttcctggaagggaggtgtctgccttcttcctagtggtgtgctgcccaccaggcatgcccagtggctcatctgtctctgcagatagcttggctgaacccaaaagggctcagtccttcctgtgggcttgatgcctgtaggaagggccagtcttgtccccatgtctgcagtgtgccacagcctcctttccaatttgtttccattataggattatgagacctcctgactctaaggaactgttttatctggggcttggtgttgcgggcacagcacctgtgaatagttaatgacattttttattcccaaccaagacctaggctcctttagggcaagggccagtgttgatctgaggatatattcccagcttctcacacagtctgtggtgcagactaggagttccatagatcgttgaatgaatggtttaaaaaatgaagggatcaagtcctggaagtggttttaatttgctgtgactccaggtagcttgcttaaacactctatgttttctaaattttaaaatagagctaatatttctcaaatggctccataggacattggtgacactcagttctgcaccagctctttgcctggtaatgtgcaggatgggggatgcccagggtatctttttattccttttttttttttttttttttttgagatggagtctcgctctgttgcccaggctcccaggctggagtgcaatggcgcgacctcggctcactgcaaactccgcctccgggttcaagtgattctcctgcctcagcttcccgagtagctgggattacaggcacctgccaccacacccggctaatttttgtatttttagtagagacagggtttcaccatgctagtcaggctggtctcgaactcgccacctcaggcgatctgcccgcctcggcctcccaaagtgctgggattacaggcgtgagccacagcacccggcgtttttattcttaaaataatcctgtgaggcgtatgtagtgttcacctgattttgtaaatgtgtaggcacagggaaccgaataacttgctcaagatcacaaaggctttaagtttgagaagtgcagtgaaaatgcggggctgcttcactccaaagtcgatgtgtgtatatgtacatataagtgtatatgcatgtgtacatgtacatataaacaaaagtacacatttaggaagtgtatgggaaatatacatgtacacatgcgtatacagtcataaggacgtttcagttaacagtagactgcatatatcacagtggtcccgtaagattataatcttgtatttttactgtatcttttctattttagataacaaataccattgtgttacctacagtattcaggacagtcacatgctatacaggtttgtagcctagaagcagtaggctgtaccatctagcctaggtgtggagaaggctgtaccatttagttttgtgtaagtacactctgatcacacgagcaagaaatagcataatgatgcatttcttagaccagatctccattgttaagtgatgcatgactggatatacacatacacatatgtgtatgcctgtatagatgcgtgtattctacatactcctaaatgtgtcatatggcaagggtgcctcattgtaattctggctttttccataaatgttaaacaagcatcttctcccaccgccagtccttttcttccttcaaggggacagggcctctggagcttatgcccagctcctgtcggatgcccccgtgttctggtcactcgtgtgcccatctcttcacactcagttttcccacccctgagcacctcaggtgccaaggtgtgtttgttgaactgaaattcttaagcctgctgagtacattctcagtttgtcaagacagataaacaaataccttttttagatgatttaaaagattcttgacacagtcccagtggtgttttaacaacttttcaggtcctgatcagccaaactctgggccaaaagtaaatgtttaataaacaacataagagtgatggaggaaaaatgtatcttaagtggaactgtgtgttctgtaaatctatgacagattactgttcctgcttttgttgtgtataattattcttgttcctcctgagaattgccctctctttcatcatgaaacgtataagatggcctcctcctctggtaatttggagcaattggcctgggagaggattgatgtgtagtaaggacagtccgtaggagagatttagtgggggcagtttccttatcttctattctgtccctttgccagacagaagcacaaaaagtagttggactgaaaatgctgcttcctaaaattagctctcctctttgttttccgaatggttttactggttgatgcgggcacaatttgcccttcttggggagccttctgcattgtgtaaagtgcaaagacacatctatcagagaagctaattttaggtgctagtaagttttaagggcatgcaaagctcaaaactttgcctgttctcttggaagaagatttttccctcctgaaaaacaagcttcctttcaaagtcagaaaaggggagcttagacgaagccccaggagggcaggtatgtcttgttcactgcagtctccagtgccttgcgagggcccggcatgctgagcgctcagtaacccttggcctaatgtacagtttttcattctgtgaatcaggaatagagcaacataaggggagcttctgcttgagacagcaatggcagcatcaaaataaacgtggcaattttggtcttcaagagtgaagttgtgtctctgaaattgtaagcccaaatggatcatttccttttttaggttttagaattccaggtttattttctggaagagcttgcagcagatgggcttctgtaggggaacgtttataccttgggggttccgtttcgagagtccttgatttattattgtttacaaatggtggttggaaattgttcattgatttgacataaagctgcccaggcttattgtaaaaacacctctgcatccaattagaatgacagacacttagtgtgatgactcaggacagttgatggccttaaaaaaaaagcgaacagattaaatcactctctgttttttcatagccattgatggaaacagattctgtggggtaaataacagagtcttgggtggtggaaaggttgaagatgtccagtagttgtggcagggcaaggatggaggactttttctttgcaggggcagtggagaggcggggccatgggtgaagactggagaatactcagaaggtagcatggacgagagtgttgtttgatgactctgcatgtgaccagtagtgacattttactcactgaggctcatattgaggttaagcccgaggtccattggccttgctgagatcgtgtttagaacacagcactgtgcagtaagagactcctataactctatcaaatttgcatttggaggaattgtaaagagcctctgttacctcctaggtgaggcagtccaggaaaacagttgctagaaggagctatctgcagaaatagacagttgtggtcctttcatgttttaataattgttccctggatttcaaggagtcagtccaaaatccccgtaatagattttagtaacgttcatggaatctcagtttgcacatcatgagacctttagtgtggtgtttactgtcttcaccttaatatactttgtatccatgagcaaccttgctacagtcatgcaaagatgattattttttattcagcaataattagccacagtgttgagcacccagatgccttcctgcagcagccccccttttctccccagccaacatctgcaactgtgaacagatttccatcttcagccttggtggttggaaagaaatgtaagtcacctttttttctggttggttctggggcagatgccaccaggctgcagaggcagtctgtgtctgtggggctcaccagggcatgagttctgctcccaggaaagagattcttgcaggattttgtctgtggttctaaggagacaagtaggtggcacacaaaaacagaaaatgaaagaacccatccctccaaaaccacacacacaaagccaaaaggaaaaaaaaaaagcacataattatcatgtaggcactgttgcagctaaccctgattttggcctcaattctgaaacaagttagctggtttagacaaaccccttattaggtaatggattgttattcattcctccccttctcctagtcatttactccgtgagagctgctcctacctgaccttccactgattttggtagcagcatctcccagagcgactgtttccttcttcagcagtgttccttactcagggtgtaagatcttaaccccacagagccccgtatcaggtttaattaactaattgattcagcttgtgcttactgagtgcgaggcagtcatgtgcttctgtttggtaaatggcttcattttccctctaactcctgagcgtcctgaagcttctcttatggttctctccaaaggagtcagcaggctggctctgcaagggtcagtaggttctggggtggtggggggccgagggaggcagggaggttggctctgtctttatttggcatagagctccccgaacagggtctctcctcctttctccaaaggttaatggaaccactatcttaaaaagctgaaatcttatcttctggggtatttgggtagagaaggctagggaatcccttttccatggtggtgcagtaggttctcagaaccagctggtgggcctcaaagagaggcggctgtattttagcctgataatcttgattcctggtttcctggctctgtagcatcagaaatgggaagctttaaaagccgtgccttgttggatgcaccgagtcataaaataaatgtgatgtgctgggtgggggaaatgcgggaggagggaaacaggtggttggagctgcttcgtgatggccgcccaccctggctctcctttcttaataggcttcagaaatcctggaatgcgtaattcaccagctcacagagttccacccatgtccccagtggcttcaaaatgtaaatgacatttgcagtgctgggaggtaggagggcgatcccgttccttccctggatctcagtcgcagaggtgctggctcatgtgcctgagtgcagcggctggcccgtcattactggtctttgcaggaagccactctgaaggcacctgggcccttgccaggctgagtcacagctgacttagggaaatgccacacaggacgcttgcagtccccccgttctaagcgtaggttttgcaactgcatactcggaaaatgaatcagagtgggggaaagtgtcagagaaacagcagaaatggaatgtaggcaggagggccacagtggcgctgtggattcagaccacaccttcggctctgtttggggcccttcctgtaaggagcgtactgatgccagaggctgggggtgtggaagggaagctgctgtgctgttagatccattctgctatttagccagccttccttttcccagctggcacagacaggatgtgttagagaggtgctcagacctcctttcagagcaactgaatcattctccaggagggacagggagtctgaaatgcaaacaggttcccagggttattgaagagcagccaaactgaacacccactgctctgtggactcaagctggttttagacattgtttggtcaggaccagagccgagctctggggcccactgggggctcttgtcgcaccatctcattgattctacaatgcacatttcccccgcctctcatgttttaacatgtctgaaatcaggatgcatcttccatggatggtgtttcagggtttcattgatcgtgtttttcttcctgagtggcacacaaaattaatggtgctccctagagttgatggtccctgcggttcagtgaaccgtgttgctcttgtgtaagctcctgtgggaacatagagtctctgtgtcccaccttcttcctcgcagtggtcagcacggatgaggtgggagttgcataaatgtcagcattcgaaagtgagggcgtctgtcggtgctgtctcactgtggggcttcagagaacgtgagcacctgtgtttgcattctccatcaaggttcatgtcctgttggctcataagcatgattatatccattatacaaactggggcacaggcacccagagagaagtcaaaagacttgttcaagatggacaactaggaagtggtggggacagaccagtcctgtctgatgccagatccagcgctgtatctgccagtcagcatgcacactttcatctctccagcctcttcccactcacctttactcaacatttctgggcctccatagtgattgtagtaattcggtaaagatgattcatttctttagtccggtcttcggacttgacttcttagaagcaggtcttgtgcaatagttgcatattaaccacttggtgacacagtgcatgagggtatgccaactctttttgctcatggccgtgcagtgcagaatttccaggcattgtccgctctgtttcctggacttcggagtgatagcaaagttttgtattccctgatcagctgtgtatctctgagcagcaagttgatctctctgtataagggtgactgtgcccatggaggatggcatgcaattgcctaaagatttcagtctgagaatctgagaaacgatactgaatggagatgacaggcttagtgcctgcttccaggagccatgcctcctcctggcctggaatgaatacctaaacacctgaggctctgagttccggcagtgtgctgaaactgctgttggtctggcccactgacccggaaacccagccacctgaggttgtgactttagggcttctagttttgtatttagctttaattccatctgtgaggcagtggagactgttcattttattttacatcaaaggcttttggaggttgagatgggaacaggatgatagaacagtaatgcataattatggagcatttgctgtatggcaggcattcgtaagagtgcatttgttgatattattgtttggcctctcctgtcattagccctaagcagctacacttgctaagctctgtgctaaggctgcagtaagcaggcaggcagtgcgtgctggtgagcttgggcagtgctggagtgtgtcttgcccagtgtggggatgaacatacaccctttcatgctcacaggtgccttagcctggatgataatgtttaagttcattctgtttatatgcaccgtgtcattaaacaatgctgtgaaaagggcactattatttcccccatattttcagtgataaggcagaggcccatgggctccttgtagcaatggaggcattccttgaggatccaggcaatctgactcccgagtcccggggctggacagaaggaagctggctccgagagctagactgcagtgcagaggaattccacgctccgcaggtgctgtcttcagaagttgcatctcgtcagcaggatgagtgcttttggaatagacaatcttaaatgtcatagtgaggtgacttgcagagataaggaaggacgccagcctcaggcactgactgatgaatccagatggtgacttcctccttgcaggagaatcagccacttacacagactgggagggattctactgagggaaaaaatgaattcgcagccagggacagtggctcatgcctgtaattccagcactttaggaggctgaggaggcaggaggatcacttgagcccaggagttcgagaccagcctgggcaacagagcaagatcctgtctctacaaaaacagaacaaaccaacaattagccaagtgtggtggcacacacctgtagtcccacctactcgggaggctgagacgggagcattgcttaagcctaggagtttgaggctgcagtgagctatgattgtgccactgtactccaacctgggtgacagagcaagaatgttaaaaaaaaaaaattctcatttcttctcatggactttgtgtgtgtgtgtgtgtgtgtgtgtgtgtgtgtggttggttggttggtttaagccatggattaaagaaaggagaactatttcctgtgactaaaagtggtttacatattggtgctttagcaggaattttggagggtggcttaagtgaataattaaaacagaaatcttcctagacgatgtttatcacactcaagacattaaaaattagagtcaagggactgctaagacttggggtgctggtgggtgaggctgcctttcagggaggccatgctgtgagttgagaatcctaggccaccttgcctgcactgccagctttgcagctgtgggcacatctggatccccatttctgtgcgggtgcagacaggtgaatgttacctgcgtgcatcataaaatgctgtgaaaggggtcacaggtattgcccaggcttgggcagactcattcatagggctcactggcttgcatgagaagggatgctgggcacggtaaacacagaaggagaaggcaggctctgctgccaggagcttgcaccctgagccacgtggaactggtttgcctgtgaagcaataggcacagtcctgaaagagcacagtcctgaaagagcacttctaattgggcatacaagcaagctcataataaagttctcctaggaagttttcctcatgttttgaagatgatacacttagtccctgactggggatggtttcgcttacactttttcaactttacgatggtgtgaaagtgatacacgttcagtacgttcctcaattaacaatgaagctatgtcccgataaacccatcataagttgaaaatatcctaagtccataatgcacttctgatataatggtattttcaacttacagtggctttaccaagatgtggcgcattgtaagtcgaggagcatccatccctgatgggatatataaggatgagatttatgcacagatgttcctcagcttatgatgggatcatgtcccagtaaagacactgtaagttggaaacatctgaagtcgaaaatgcatttgatatacctaagctatcaagcatcatagcttagcctcacctgccttcattgtgctcagagcacttaaacgttagcctgcaattgggcaagtcatatccaaacaatgctgacagcaccgcacactgtagggtatcagttgtttaacttcgtgaccgtgtggctgactgagagctgtgaatcactgacattgcccggcattgtcagagactatccgaccgcatatcgctagcccaggataagagcagaattccagatttgaagtacagtttctactgaaggcatattgctttcgcaccatcgtgaagtcagaattgttaagtcgagccatggtaagttggagaccatctgaataacaggatgagatgtagagcaggatatatatgttagaaacaaagtttcgcgaacagtgcaaacgttttctagatggactatcctactcttctctatctcattaaacactttgctggcagcaactcactgagttgaattcccgctccaccagtagcctcccctgggcgttggaaggctctgccctctgatgggggtctccctgggagctgcggctgcggacccccgtagatgggatgcagctgcccagtgtggtccttgcctttgcaggtgagcgggtgcagggaggtgcggggtggggtggcggctgcagcagtggtggttgggggccctgcaggctccctcggggtgtagcagggacatggtgtggtggttaacaggagtaggccactcatgtgggacgtcaggactagtgccacaaaggcagccctgtcacacgaacaggttcttgggggacagaggtctgtctgggactggctaatgacctggaaagactggagaggcaccattgtccaccaccagatgtatggctgcagggtaggagtagacttaagaaggaacactgttggctgggcgcagtggctcacgcatgtaatcccagcacttcgggaggccgaggcaggtggatcacctgaggtcagaagttcaagaacagcctggtcaacatggtgaaaccccatctctactaaatatacaaaaattagctgggcgtggtggcaggtgcctgtaatcccagctactctggaggctgaggcagaagaatcacttgaacctgggaggcggaggtcgcagtgagttgagagatcacgccattgccctccagcctgggcaacaagagcgaaacttcgtctccaaaaaaaaaaaaaagaaggaacactgttagggaggcagtcagtgagcctcaagtcagaaagacaaacaagctcattttatgcatttgctaacatttgacctcttctgggacgcgtaggtctctcaagttctgtttctgtttcctgtcacgcagatcagagatgtgaaacagacctggtgtacacccgtctggggtagcactgggagccacggcgtcctggcagagcaggtgtgcctcccacaggctgatgcagccgttctctgtgcagaggctgagccatcctaggagcagctgtggggtgaaagtgtccttccttaaacttagtgctcctgctcattctctcagtatggctaatagctcatttaaatatactatggtggtttttaatttttgtgactcattccctcccctcctcacctgtgtttttcctgtgtgtcagggacattttagggggaccaaaaggatctctgtctctgctctgtgcttgctctgaggttgaatagagaatgttcagggctgttcttatttgagtcactggagctgttgtgagctctgacggcctgggagccccactactgtcacatgaggacagggcgtggggtggctcaagcatggccgcttggggttgggtcctagtgctgtcatgttggaggtgtctgacctttgcactaagtttccccacttacactaaatggggataatcaaagctttgtgtggggattaagtgagttaatgtaaccagaacacttagaatggtgtgctgcatacagtgataatgcagaactactcactgctgctggagtgcgctgttatattctttattaggtcctcagactttttctatgcctaagccttgagggtctctctcagctgtgcttttctgttttttttttttttgtcttcaatagatttttctagggtcttttctggtaaaaagagactgggaatgcaaatacattgagcatgagttgagaggagtttggacatcagcctgaccgtggaaaactggggaggcgtggagtatatagtttcctctgggtgggttactgacagaccatgggagttctggggaaaatgtatgctcttctctttaagtacaagccaccattgccaggcagaagctgataaagtaattagaattgttgttcatacctgacttgcaggaatgtgtgtgcgtgtgtctgcatgcgtgtgtacgtatatatactgtgcatgcatatttgtgtgtgtgtacatacatatgtacacactgcatgtgtctgcatttatgtacatatgggcatgtggcatgggcatatggcacatgcgtatctgtgcatgcacacatgtacacagcacacatgcacacatgcagtgcatagtatgcctgcatgtacatgtgcgtaccatgcatgcatgtacctacacgtgtgcatactaatttgtgcacacgtgcacactgcaatgtgtacttacatgcaagcctacgatatgtgtttgcaggcacatacatgttcacacactgcccatgcacatttgcatacacatgtgtgcatggaacatatgcagtacaacacaagtgtgtttgcatacatgtacaaacacacatgtgtatttacctacatttcaaggtgaaccctccccagaaggctctgctcaatgagactctgaaagtgttcaaaagcatggtctgagaaagcatccctccttcagggcatgtacccaagtagtctttctcttgctggctgaaatcatcagggattgtttccaagttttaacttctgattttcactcttttaaatcccagagccgatacttgaacagaagtaagtttgctgttacacctctcactttgattagcttgttgcgttaaattaattgtcagattgcctgaaaccaaagcttcttaaaatgaacactggttcactcgggaaatttttgcaagatcaaaaatggaagactgtgtcactgatgaaagggagagatagccagaatacaaaatctagagctttggacctgaaatctggctgcaagatggttttttcctgtcttacctaagaagtggcccccaggattcacataccagtagcctctttttgttattctttttttttttttaaacatatccccttgttaaagatcctcttgattgcaagcaaaagcagcctactgtgcaggctggcttaagcagaaaagggaatttattgtggggacatggtggggaggtgtctcattactgagaggaagaaggctggctggcctcagaaggcatgagaactgggacctgggtccagcccagtccatggtggccacagctggatctcagctctgctcctccaggccaggtggctgctttctcctctctctgcagtgggattttctctgcccaggactcatgtgtctacctgtgggtctaatctcctagcataggctgagcctgcacctccttgagaaaacagattagcttagcttagtctgagtgttcactccaggcgcaccctgagagggagtgcagcctgcacatggggtgggtagttcttaaagggagcctgcctccagaggcgccgggggagggggggggcctgcatttagagtgtgtgcgtggagcatgtagcttgttcctgttttcatggagtcgcagagatcagaaagcatttatgcctgtttctgacagagatgcacacagctggtctgaatgggcaggattggggtgagggcagtggaggagggatctggccacacaggcagtctgctgtgagggccacttcaagccactcttcccttgctgagctgtgattcgttcttttccaagtgacttaaacagaggccttttctcttgtttgtggggatgaggatggcgaagggaggaggagggagagggtggctgagtggaggaagcgcagttgtgctgcggagattcctgctctgcagcttgtctgctgtggattggcccagggggtaggtggcacagtgtgtgtggcaggggggtgggggggaccaggcctggctccgctggtccactcttgggctgtgagccaggacaaaatcttataccaagcaagcatcttttccagtaaaatagagtgtctccatgcccttaggaactgcctgggacagcctcattctgtcctggattttgttctgggctctgctgcctgttgagcgtggaccagtgacctcgtaactgtggcagaggtgaaggtctcagcaccttctgtgtgccctcttgcatgtgtgtttgccagcatgcttggggctttcttcaggtgtttctggcctgaggaagtgtcttacccccatgttatttgtgtggctgcacagcatctggagggagggatagagccccagcgctgggcacatcggatctgtgctctgaacagctctgttgatgccagagctgcctgacttgctctgtgtggtgctgtgaaggtcaggcttggagagtgaggagctgctgaaaaagggtgagttttgttctcttcttccagggctcagtcttccttgtaccagtttctttctctgttcttctctccttgactcaggaatccagtttgcgcagcacttacatggcgggcaaactccagtttatacctggagctgcagggcggagctgctgtcagctgggagctgttattgaggaacagctgtggtagaggtggataagaagaagacctgaccccacctgctggggcaagaagcctgcatagcacagctaaacagccatgtgggacaacggctgagcaatgacagtggaacccagtgtcccatgcaaagtgctcaagaagtggacgggatggatcgctgctgagtggctcttgaggagctcagagtatcttggggctgatgttgcctgttgggactttccccagcacagacagcgtgcgggatttcagatgctcttctccttgccttcagaagcccagggagtgttggcagcttgtttgcacctgatcagataaaagaggtcatgatctctgtgaaggtcttttcggggaaggggtcactggccttgccaaatgtgggaagcgaggcctcttcccagttctgcctgtgactcaatggctgtggctcagggcaagtcattggatttgttttttgttttttttttcagaataacgtcagcatgtgctgagcatctgactcacggggtgaggcagtgaatgaaggacttcatctccgtgaagtgcttgacgtgatagaatgaaaacccttgcgttcccagccttggctgtcagagtctcattttaaggaaagccgtttttgacgtgtgtttcctttcagttcggagctggcttctgttaggacagggggtttctgcccacttagctgtgtctctggtaatctgagattcttggaaacgggccacagtgattcctctggccacattcagggtcaggttttcagttcgtcttcctggtgtttccgcgcctcattctagggggaggtttagtcgttcctttctctgctgtcccccagtagcttccggccattccttgtgaaggaatcttcctaagtcaattttccctggtgaagactgagccctggaagaagagaacaaatctcatcctttgtcacttgggaatttcactggcgaaattcagtgaggcacttgaggtttgtaaatgggcagacgtttcccacacgattacgtctgtatgttggaaagatatttctaagttgtagtgaggtaggagggattctcagcgagaggaggggcttgggctgaacccggcactgctgggacatgaacaggggaaacagcgttggcggtggagcaggtagacattcccttgacctcgtaagtcctggatgccacccggcgaactggcctgcgggctggaaatgatgcagctgacccagtaaacgcactcagctcaccttttagtctggtccagaacgctgaattgagctcttggatcttggtgctaaatacgtggtgtggcattaatggcagtaaagatggatggttatgtaccatgtagaacgtgcaaatctgttttcaataggctttattttttagagcagttttgggttcacagcaaaattgagcagaaggtacagagagtgcctgtatacctgctaccccaacatccagcttcccctattagtttcccttcgcaagagttatagtccacaaacctacactgacacatccttaagtctcccaagtccacagcttacattagggttcactctttttttttttttttttttaagatggagtctcactctgtcacccaggctggagtgcagtggcatgatctcggctcattgcaacctctgccacccgggttcaagcgattctcctgcctcagcctcctaagtaggtgggattacaagctcctgccaccacacccagctaatttttgtatttttagtagagacagggttttactatcttggccatgccggtcttgaactcctgaccttgtgatccacctgcctcggcctcccagagtgctgggattacaggagggttcactcttgcttttgtacattctatgggtttggacaaatgtacagacacacgtctgagaaaattgtgggtttgatttcaggccatcacataaagcaaatacggcagtaaagcaagtcacacacagtttttggtttcctagtgcatacaaagttatgtttacactgtattgccgtctgtgaatagggcagtagccttatgcctaaacaatgtacggatcttaattttaaaatattttattactgaaaaatgctaaggatcatctgagtttttagcaagtcgagtcatagtctttttgcccagatgttgatggctgctgactgatgacggtggtggtggttgaaggttgaggtggtggctgcgacagtttcttaaaagaagacaacaatgaaatttgccacattgatggactcttcctttcacaaaagatttctttgtagcatgcgttgctgtttagcattttgcccacagtaggacttctttcagaataggagtcagttccctcaaaccctgccacgtctttgtcaattaagtttattctgaatcctttgttgtaattttgacatgctcacagcatgttccctaggaatagattccatctcaggaaaccactttctttgctcttccatgtctttttccaggttctatcatgagtttgcagcaattcagtcacatctgtcgtctccacttctagttctcttggtgtttccaccacaactgcagttccttctccactctagtcttgaacccctcaaagtcatccatgaaggttggaatcagcttcttccacgctctggttagtgttgatattttgatcttttctgtgaatcacgaatgttcttaatggcaactgtaagggtgaattctttccagaaggatttcacttgactttgcccagatctataagaggagtcactatctatggcagttatagttttacaaaacatctttctttttttttttgagacagagtctcgctatgtcaccaggctggagtgcagtggcacgatctcggctcactgcaacctctgcatcccaggttcaaggaattctcccgcctcagcctcctgagtagctgggattgcaggcacacaccaccacgcccaactaatttttgtatttttagtagagacggggtttcaccatgttgggcaggatggtctcgatctcctgatctcgtgatctacctgcctcggcctcccaaagtgctgagattacaggcgtgagccactgtgcctggccacaaaatgtatttcttaaacaagacttaaaggttgaaattactgcttgatccatgggctgcagaatggctgttgtgttaccaggcatggaaacagtattcacctccttgtgcatctccatcagagctcttgggtgaccaggtgtgtcatcagtgatcagtagtagtcttttgacaggagtatatattttttttccgagcagtctcaacacggacttaaaatcttcagtaaaccgtgctgtaaacagatgtgctgtcatccatgttctgttgttccatttatagagcacaggcagagtagatttaacatcattcttaagggtgctaggagtttcggaatggtaaatgagcattggcatcaatgtaaagtcaccagctgtattagcctcttacaggagaatcagactgtcctttgaggctttgaagccaagcattggcatctcctccctagcaatgatagtcctagatggcatcttcttccaatagaaggctgctgtagggtagccaccttcatcagggatctcagttagatcttctgggtaacttgctgcagcttctccatcagcacttgctgcttcaccttgcacgtttatggtatggaggtggcttcttcccttaaacctcatgagtcaacctctcctagctttcagctcctcttctgcagcttcctcacacacggttagctttcatagaattgaggagagtaagggccttgctctggattaggctttggcttaagggaatgctgcagctcatttgatcttctatccagactgctcacaccttctccgtatcagcaataaggctgtttggctttcttatcgttcatgtgttcactggagtagcacttttaatttccttcaagaacttttcctttgcattcacactcagctaactggccttcctcactaagcttaatcattatcagcttttgatttaaggtgagagatgtgccgctcctcctttcacttgaacactcagaggccattgtaaggttaccaattggcctaatttcagtatcgtggtatcgcagggaatagggaggcttgaggagagggagggagatggcagaacagccagtgagtgggggagtcagaacacacaccatgtttatccattaagtttgccattttgtatggttcatggtgctccaaaatgattagtatcatcaaagaccactgatcacagatcaccataagatataatagtgacaaagtttgaaatattgtgagaatggccaaaatgtgacatatagacatgaagtgagcacacgctgttagaaaaaatggcagtgatagacttgctcgatgtagggttgccacagaccttcagtttgtaaaaaacacagtatctgaagcatatcagtgtgaagtgcagtgaagcaagatatacgtgtctgatgaaagcatccgcctcactctgttctgggcagtgtcatatggaatagcttcgctgcccttggaattgtctgtgtgctccctgttcatccctcccaaccccgataaccactgatctttttactgtctccatcactttgcctatcccagaatgttggaatcattcagtatgtagccttttcaaattggcttctttcacttagtcctatgtatttaaggttcttccatgtcttttcatgactggagagctcatttctttttagcactgaatactgttccgttgtctggatataccacagttaatccatttgcctagatgtgtccatcatgacaaaggacatcttggttgtttcacattgtagcaattatgaataaaggtgttaggaacatttgtatgcaggtttttgtgtggacataagttttcaactcctttggataaattccaacgagtgcgctcactggactgtatagaaagtgtatgtttagttttgtaagatcctgccaaactgtcttccaaagtgtgcaagcctattttttgaccagggcggttagtcacacatagcagccacatctgttgtggtgccttcctgggaggcccctctcttttatagtcccatcagtgccaccatctgcagggtcaccagagtccctgtagggccagaagcacaagtatggctggttccttatctccctggagccctggcttcttcccacctctctccagcctcaactattttttgcctttgccctacggggactggctggcggttcttccccgcgtggctcctccccgcactgtctcggtgggagcatcgtccggccttcatgccctgtaagatgcggttcagatggcacctcctctgtgacgcccttcctctcatcctactagcccaattaaaaaaagttattatagtaaagttcaaatatatgtaagtagactcaatagtataatgaactctgcctgcccctcaccctgcctttatccgatcagcctatggtcagccctgtcctgtccatgaccaccctggaaatgggccccagaaatcatcttattttacctataaatattttagtgtgtgtctctaaaagatagtttgaactcacagtaccataaatcatacttaaaaacaattaacaagttccttaagggcatccatatttaattatcgctcaaatctccatttggttcctaaatgttatacctgtatttataatttttcttaattcaggatttatataaagttaccgactgtggttgattcatacaacctctggttcttggaaaatcggagttttcttttttccctctgcttttggtcatttcattgacttgtgcgtacaggtttttgtgaagggagctgggaatcgccttactgttttccagcctggattttgtggcttgcgtctccgtggggtagttttccatgttcctccgtgctctgtttcctgcaaatgtgaagtcgggtgtagagccttgatgagattcccatttgatttgtttcttcctctttgagggatgggcgaggctgctcgccacgtggggtctgtgctgcactcttggacctggaggcacagggcactgggtttctgtggtggaggcaaccattgatactcagtgtctgtatctcctagttctttaggctttcaacattgtaacattttaattctatctgcgagtgtaatttctttgctaggctgtttgtataaagagaactccccccacccccactatttgtttacctggtggtactgtccatgggggaaagataacacccatgtcagtttcttccttttatttatcagtttctagtcagtggtaaccagatagggctttttgcttgtttggttttatggcattatgtggacttacacatttgcatttcagcttattccagttattattattagggttcacattttcccagctttggtcagtgaaagctgcttgaggtgggccctacatcccattggcgtgattgtcatggcctttgaggaccgtgttgctgtatactgtggtaagattcccggggtcacattgtctgttcctgccccagacctggagtcagcctttcccagagagccctggttctctgtgctgggaagcgtttgcggttcgctattgggctcagggcggcctgctttcctgttcctcccctgtgccctcggcacctggccggagcatctccaagcgtctgccaccatacactgcagtcctcactagcctcttgcatgcgttgggggtgggggtgggggtgagtgggcggtgttaaaggctacacctgggattctccaggcctcagcagctggtgttgtaaggttacatagtaacagtgttaaccagcttgccctgtcttttctcaaagttccacccattcagttccaggggtccaggacgtgcctatcaggaacagcccttggatgcctgccttgtggatgtcatctgctcccatgtcagccatctccagggctcttcccgagaagagggcagtccccgccaagggtgttgcctctcaaacctgccaaactacaaaccctcttggtacctccacacatccctggagtcggctttggggaacactgtgttccatgtctaagtggagtcccgggcctctcccctccagtgtcgcctgtgccagctggacacgaagcagcagatcagtcatgaaaatggctgctcagctccgatctgcccttccttccgcaggactcagggacgcacagctccccaggttgctggtcacccaaacaacagcattcctttctcctcggcctctccccaggctgcttgggagagaaaacttccctcatcctcctccgcacacactaaatgccctgccggtatcttctttccagtgactgtggccccaggtcgtcacacatggccagacacagctgaatctcaggctagatcatgttggcactgcttccaccccttggataaaataaaattcccagtgacttccttaatattttgataggctgagtggcttatatgcaaactttgatgtaaacactaggccagaaattggttaactgtggtttaggactcctaatctttctccggatttattgaaaacatgtcttagaatggtacgcaccaagtggttctccctggtactgcatcctgctggccacgtaccctttcctgatgctcctctgaagggaggatgtttaacgcaatgatctccagccagtgtccaaatggcatagagccacttccttgttgacattccctgggatctggaggtcacttccagctctttcctcttttctgcaagagccatggtgctgcacctgcctgctgtgtgctggcacatgcctgtggggttgtgaaggctttgtatgggtccctggaccacacctgaggaggcgctgtcttagtcccgtggcgggcggtggggcaggctccctgcactggaggaagcaccagcaggcttttgtgcgtgaacagacaactctgttggctttcctgccctcccctgtttgccttcttgatttttcccttctctttttgtttctgtctccatcctggttgcattccctcactcccctcttctttgtccctgccaggtttctgatgggttacttctttgaggaggagaaccctaccaccattccagaatactcaaggcaaggtttgaggggagaattaggcggatgtccatttcacaaggctttgtttttgccgaggagaacatcagtgtctgcctttagtaggttgccatcatcataagcaataatagctgactgtaactcagggactgtgctgggaactttccatgcccacggagtcagtcccttcagcagccccaggaggatgagtgcttttgcataccccactttgcatagatcccaaaaaggggacattgggacattgggagcatcagtaacttgctcgaggtcacacagctagaagaggggaggagggatttagaatgtatttatttatcttataacgtttattttttgatatataaatttatatttccctttgtagtttatttaaatactgttatgcttttttttttttttttttcaagggacagggtcttactctgttgcccaggctagccttgaactcttgggctcaaccattcaagcctcagcctcccgactagctgggactgtgggtttagaatttgaatccagtgttcacccttcctcctgagcggtgctgtacattatgaacaggttgtttgccaggaactgggataatgccattttcctcataaacctttgccccgcaagcatgggtagacagacagctggtgctttccttggttatatttggcaaactatataaccaaaccaaacttgattatatttggctagtggaccagttcttttgtagttggttagaaaagaaaagatatcgctttcccttgaaagaattcattctccatgagattgaggttcagaaaatctgttaaataaatcccaagccctgaggcctccaaatcagtggctgctccgctgctcctctctctccctcgacctggtctctcagtgaccccctcatcttttcaaatcatagcatgttgggacaagtgttccagggaaggcctctgtcagtgtttagcttacatttcttgggtgtatctttttgacaaaattttccccccagggataaggaaaccagaaaaccacagtggatcagcgtgcaggaatgcataagggtggctctgtgtgtgtgtgtgtgtgcatgtacatacgtgtgtgtgtgtgttcatccgtgtgtgtgtgttttccttcagagcattttaaaggtctcagctattattaacatgaatttattatctatatttaggataagcccactaaggatgatttgggatgagctgtgaatctgtggtgtatatatagatctctgcacacgcgtatagtgcatatttatgtctgcacgtactcctgggcgttgacatctgcctgtggaatgcagacatctctgtgcagggttgtggcctgtcgtctcttgattggcagttgaagtgtcccgcatccccttgttattaataacttgcttggggctacattgagttggggatgtgcagtagtgatttatcaagacattgttataaagacacaaggctggttgtaatagtctaatcagaacaagtgtattcaaagtggcgagtttcaagcatgctgtttaggagacttcacacttattttcagcgttcagaacattgttgaacctctgcttttggcatcgtggtcacagctagtctatgagccttaggagaaattatacttgccatttggtgcccactgtgagtttctgaccaagaacaaaatttccaagcttgatcacctgccttattcgtgacgcttggctccaagtggttgttagctgtttccaaaaaacaaatgtgctttagaggatgaacattatgctgttgtctctgggggccaacccgttaggggagttccagaaatattttgaatgatgacagcatcatgggaataccaagggtctccccaggggactactttgaagaggggcacatgcaggttggtcatgtctttgtgtgagttccagggttcgaaaataactgacgtatactggttgtgtatgtctgtgtgtgtgttgcccgcacagctaagtttagacaccgagctttggagacctctgagagccgactccacctttgattttcagttgtctttcattttgtacccatttggtattgtcttgcttgagcctttgtggaaatagaccttgacttcatttcttaagtcttttttactttctacgattatggaaaggaaaaatatatattttatttagaaggcaacaggtgtacttatgttcttctcctatatgatgggtagtggaaatgttttaattgccttcttttgtctactttaacctcatgatcattgcctttgtttgctagtctctcagcatgcgtggttttgaaaatgacctgcacacttagcagatgtgatacagaaaccaaacccccgaaccacactgtcaggggactctaaaaatgtgaaaacacctggttttggtttcttagtcattctgtttatttgatgaactctgtagcttcaaacgtacagctttgaccacttaatgaaagcatgtggatagtgacgtgaggatgacctgaagatatgactccctgtcctttggactaagtggcctttaaaccagtcacgtgcctggctcaactttaaaaagaagtaaagacattgtcattagatctatacaatgtcaagaatattacccggcctggatttaggtggaaatgaattaagtgcaagtactgataggtactttctgggggttaattttattattttcttctctttaattttgatgtagacatggagacagcagagggagagacaccaattcttaagcatgttgtgtgctggtgtgttgcaaaacattgctgcaagagctgtctatcacccgcaagagcccttctgacctgatctgtggtcgtactggacttgtggcaagctggaatgtccccttgtcaccagtggcgtgttaatgttactaaaaagcaaggaaaatataattgagttctccctaaatctacctgtggcatgaaaaaatctctcaggttgcatcatgtccagaaataactatggtggggcctaatgggagtaattccctggctccaggtatttggaggaggcaggcagcacttctcattggagtgatttggaaccaaggcagtacattttcctgctgttcctgaacaatctgaagttttgcagatccttggagaaataaaagccacagtcttggaacctcccaccttcttttggcctgagtccttctcatgaattcagcaaccaaaatggagtcatggggacgggtgggacctgccgtgatggtcccacctgcattacccccatggcagactagggtggtgtggcctgtctgggaatgtggtctttctctctgagaacccagctatgtggttagtaactcaggattgtggccctgtggttactgtgcactaatcagccctccaaacactggaggagcacaccctggtgtctgcaccgctggctgttttcaagagtgttgttctcttccaccaaacagcctacactcagccctgcactcagattttgctttatttgttgatgaagctggaaagagtccatttgacgtgtaacctggtctccgctaagcggttgttctctattcttgtcaaatgtgaaggcttcccaagcctggttatgcattgttggctgccaaagagggccaagtgtttgaaagtgaataccagattagagaattcataaatgaagatgcaataacccatcacacaattagagtgcaggatccctttcccacaatcagagtaacagagatgggactaaggaagttgtacaggccagagaagggagggggctgtggggagaaagaaggaatagctggttagaatgtccctgtgtttctcaaattctgcagtttcctagcgacccctccctcaggagtgtagcgaggcctggctggtgtttgacagcgtcacatattttaaattaaaggcagagtgaataaggagagatgaaaggtttactgcgtttggatcgtgagtctttcagccaagatcgtgtcttaaattttgtatcttgtaatatcgtatctgtgggatttcgtcaataatgctgacaaaatctgaagttgtacaaagggatagtgggagtttctcatcagaggtcatagattttggtgggtaagagtgctgcttgcttagaggggttttggcagctgccttcaggcagtgagaaactgttaaggtaggaaggagaacagacaacttcggcttagatgagaaattgtgagcactttccaacagtgacatcccagtactctgtttaagtgaaaagctgaactctcttaaaactctcttgccatgcctcatgtcatcatttctccaggattggaatgtgtgccactcctagaaaggattattggcagagtttcaatgtctctctcctgtctttcttttcctctcttcattccatgtgaatatacgaaggaaggtggctccccacccagtgctcagaggttgggtggaggcagcacacagacaggtagtgacccttcaagcatggggaggccagagttcagaggacggtgtgtgggctacagccaaagaggagcgaggagcagggaggccttttggaacagaaaccctgagccacacttgaagaatgatgaggttccctagatgagtgtgtgggggcaggggtgtgggggcaaccccagcagagctgtggagatggtgatgggaacttcccagagcaggagtgtggggttgctgtgctaggagagggctgtaggaacacccagagtggagacacaggcagggccagttcggcgggggcaggcacccctctgcagaatgtggaaagggcctggtgatgagtatagctgagagagggcagccatgcactttttggggcccgctggggtgctctgagagggagggatggaaggttgcaagcctggattcttgagacctggagaccagggaacagagtgacctttgtcttatatcataagggggttgcagttgaggactaacggatgccgatgcctcgagagggtttggggtgtgggaagagaggcccccgcctccatcctgcctcgcgggtagaaacatgagcgggaatgagagtggttcagaaggccatcctcccgcaggcagcctcactcacgtacctcagtctctcctcggaaaagtgtgtgcatgggattgtaatatcgcatctatgggaaatgtcaatgttgacaaaatctaaagttgtacaaagggatggtgggagtttctcattggaggtcatagattttggtgggtaagagtgttccagcccgtataaccccacgtgcacactttgctgaggagagactgaggcacgccaaggagtgactgcacccagcgcaggttcagcagtggccaggacgatagtccccttcaggatttggagtgaggagaaaaggatttatggggctgacatttgttttcagacctaaaccattcctgtaaaattgcaacctaattgctcagtctggcggtttcctcttcctggtagtgggtgaatggaggtggggggagcgtctcccctcttttttggatagatgttaatattttgcactgcttttagcacctggggaaaacccattaaacaaacgtccccccctcccattgctgcctgaggcaggggcatgtgacccacacaccctactttactcggaaacagtgactttgcagcaaccctaaatcctgctgtgagccccgcctgcgctggtgctgtgtgataaactgacacctcccccttcttctctgtggaagactctcttaatgctgtgagccccgcctgagctggtgctgtgtgataaactgacacctcccccttcatccctgtggaagactctcttaatagtgtagtttgatttcaaattcattatgaatagatttttttttttgagttggagtatcgcactctcaccaggcaggagtgcagtggcgcaatcttgcctcactgcaacctccgcctcctgggttcaagtgattctcctgcctcagcctcccaagcagctgggactacaggcatgcggcaccatgcgcagctaatttttgtatttttcgtagaggcagggtttcaccatgttagccaggatggtttcgatctcttgacctcgtgatccacccacctcagcctcccaaaatgttgggattacagatgtgagccactgtgccggccgagggttttttttttaattttaaagagctggatctatgtgagcccctcgcggtggtggttgctgtaatcctcctcagtgatacgctcccgtgctcagttcatcagaacactcctgggtgcgtgaactcttttgaggtgtgaattgttgcactgtaactcattcctcattaccacggtattgctgacgtggcatgtaagatgggatgtcttacaggccaagacggaacctcccctcagtcctccctgtgaagccagccgctgtggcccttggtgccctctgaggagccatctatcccagcggcccccaagggctgtgtgggggatgcaggcacagactgggatgatttgtcccaaatgcagcttttctttccttctctagagtttctcatcaccagctgggtggctgcagggagggtgtccgaatccttaccaatacccatgaggccagggatggtcaggcccccagaaggcctcttagtactcttctggccatctggggccatctgtcctatagcatagcctctctgtcacatcgcactcaccatgtgcaggtacttctaaatgcaagtgcgctggagaatgtgtgtgtgtgtgtgtgtggttatgaaggaaaacaggaccttcgcttgtcgtggtgtgtacaagggcaggcgtgtgttctccgatgttatatggattttgtggccctgaagccgtcagccacttggagttttggggggctctgcctcttccccgaagctctgttctgtggaggccacagagcccagcgtctgcatggctgcttattaaattcagtgggccacttgggtcttgtgcaccagggatggagccactggcttctgggttgcctctggagttgctggcttttggatagggaggtaagggagaaagtaaaacaggaatgatcttagagaagggactttcataagggtgtgtgtgtggcgggggcgggggtggttggggggaggtaggctttccttttttcccccaagctagtctctcctgagtgtcacaagagcctgagtgttggctgggaggcatctgtcttcagggccttccttgctccagtctcctcttctcttggaagttcctctttctgccagagcatcagctcaggacagccttcctaagcccccatcttcctatatgtggggtgccccgagccccatccagggcacctgcactttctggttcagggacatctcatgcctcagcactgttgagagcagctcagcctggcactttgtggatgtttgagtcagtggagaggattttctggattatcagcaatacttccaccagctccttcttcctgaagcccccgcgacacttgtgaagcacacaccctgcttttactcagtggccaaatgccgccgctagcgacgcatcagtcattcggtgtatttcgggctctctcataattttatgatgagtttgctgttcgtttgtagtctgtttctaatctggctcattaggaattagcaaaacttgtctcttgctcaaaatagattgtgttgccaggattcaaagccaaattctgactgcagatatgctgcgaatttttctgtttctttagacttttttctttcctgtcctataacctgtttgttagtggggtagaaaatccacaaatttaactcttactattttattttttagagatgagatcttgctctgtcacccaggctagaatgcagaggcgtgatcgtagcaccctgaggcttcaaactcctgggctcaagtgatcctccctcctcagcctcctaagtagctgtgactataggtgtttgccaccatgtctggctaactttttaattttttttgtaaagatggggtcttgctgtattgcccaggctggtcttgagcttctgacctcaagtgatcttcccctctcggcctaccaaagtcctggtgttacagaagtgaaccactgcacctggctcacaaatttaactctttcaagaggaaacaatacacccaagggtccttactttttttccccccaaaattctgtcacttaaaaataaaagttcagctttcgttttagactcagggtgcatgtgcaggtttgttcatgggtattctgcatgctgctgggggttggccgagtgtccttctgctgtgactggttgacctgacactgaaaaggctgctgagttctgttagtcactcagcatcagtgcattggatctgaaaggaccacaggttgtccccaggccaagctcctggctccgcagagcaggcattgcttctgcagcttcctgtggacaggcatcacccgtctgctgaagtacgctgaacgggcacaattgcaggattactgccttgagatctgcatgacctccatgttcttacttgtagaacgtggagcccaagtctaccatccctgcagtcctctcttgtctctgaagctttgagtgagctgatgcccatcactgtggaactttgtagtcctaatacctcttgcacatgaaaatctctctgctatttgaagacctttctcatcccgccttctactaccatccatatctttcttctgtaagctaaacctctctaattgcctcacatgataagattttgagggatttcttcacctacccacagcgctgccgcagccaggcctcatgataccttagctcataatagccaccgagtggcttgggagaagcacttagcatggggtctggcacttagaaagcactcactagatgctcgtttctggacactgctgggcactggctgatgttaaggactccctgtgctcagccggttgtgaagggtttgggagcctggtgtttacccccactgttggatgaggtgcttcaaggaacaccagtttgatacagaggcagtttggggtttactagggagtcagccagcgtgagtcacgtggtatcaggaacaccgggccctggggaccgacccctgtgtctcccctaagtaggatgctcccatgcaggagcagaaggacaagcagcccggagctgctgcccggctgtgcccaaagtgggatttctgctgatcaagagtctggaatttacactccagcaggtttggaagtctcggcgacagctcctgtatgttcagtcaagcttggctgaccatggctaaaccactttaatgagtttatgggacaccagcgaagctgcaaactgggtcgggatgaaagctgagtgggcgggtgggggcttaaatgggaaagcactgggagggctggcccacacccgtgactgccctgcgtctcatgggagcagaaaggtggaggctgagcctgagacagggtaggaacccctcttaggagcctgtcaggcaccctccaacataaaaattttaaaaatttaagtattaaaaaaactaggcatctcgctagccttgagaaagaaatcaacaacctaataaacaagatagcttaaaacagtatctaaaaagctaggcacaaaacgtttgttttttttttataaaaattaaataccttaacatatgtccctgagtcgttttttagaaacctggacccccaccaaataataaatgctgtctgcagcacatagacctcgggtaacagaaaactgaggacacaactctgaccgccagttttaatttctttctgagaggcctggaggaagacacttccacaggccagatgctaacattcatttctgctgatcccaaattcctagacaaagctttgcttccttaaccaatagcaaatcaaaaaacctttgaatccacctttgacctgtgggccctgctttgagacatcccacctttctaggtcaatcccatgtagagctttcatgtattgatttatgactttgcctgtaacctctgcctccccgcctttaaaaacccttacctgtaagccatctgggagttaggtcttaagcactagccacccaattctccttgcttggcaccctgcaatttaaacctcgcactgtctcgctgctatcctgatgtcagcgtttagctccgctgcaccagccaagtagaccgaagttcggtttggtaacaagccctggagagataaggcaggggcttggctggtccaggtatggggtcctgttggaggccgaagagtgagggtcgtgatcaactcagtataccactggaggctatgtaagtaagcagcgaactgtttctcataaatgcagaatgttggcaaactgacaaactgcgtctgccacccagaagtgatgctgagggcagttatgacccagacgcaagtgtttcttatgattaggcatcattgaagcctgttagtaacaatatgaacctgtgatcaattaagcagctgaccaatcgttacctccttcctgctcttgttacccaataaataggaagggctgtagaagcttaggggggctgcctttgctcactagaagcagggtgcctttttcctcttcttcttctctcttcttccccatgctagccttcccttaaaatagttacttttgttttttgttatttctacattcatcccttcaatcagtctcgtaatgacggtctcaagtagcagtaacagtagtaactgtggcggtcagcaacagggtcctgggagtaactctcttctgatttggttttcactgccccgaaatagataggggtaggggagaccaggacgtccagcctgagaactgttaaatcacccagatttcctaagggaagaacacaccagactccttttctgtccaggggcttggtggccatctctccagctgatactgggagcgtcacagtgggatgaggctgccttccatcacagctccttgaaccctgtgaaagcccgcagaggctgagtcctgcaccccctctagttgggtctgtctcttcctttggttttcctgcagggccaggccttgctgagaatgtgagattgggagccatgaggaagggactgtactagagaggtgacatgcagactgtcttggaacttgcttgggaagaggtggaagatagtggtacataaatggaaaaggtgatctgtgcatttcttgaagcaggtacaaaccagtggttgaaagaattaaaacagccatttaaaaaaatgtgactattttgttgcaaaataaaggactgctatattagttgtttctcttctttctgaattcctgtaagaatatccgagtgtctattgtgctgtgttccttttgccctggaattgtgtttcttgagcgtgggatgagagggtaacattcttcctctgtcatcctccaccctattatagaactgatgcatattaattataaaaatacagcctagcataaggaagcaggaagaaggaacacataattcatgccgcgtaagcatccccaccacggtgccttctaggctttattctgtttggttttttaatatactcgtggtaacaatgtgttgcagtttggtttttttccctgccttgaaagttttaacactatattgtatttttacatgatctaaaaagcttttattaacattgtatggatatgtccaatctacctagctagtttggttttgtaacttatgatgaacctttttatgtaaacctttgcaatacattctttactatgtccttggaatagatttctaaaagtggaattaccgggtcagagagtttgaacatttttaaggcttttgatagatgttctcagctcttttccagaaaggttgtacaagtttacactcagaccagaagactcttttgtacctttgccacatcgttaatatttgcaaataaaatctttgtttattgcctaggtggtagttgacgtttctgtttcgatttcttttttctttttttttttttttgagacagagtctcactctgtcgaccaggctggaggctggagtgcagtggcatgatctcagctcactgcatcctccacctcccgggttcaagcaattctcctgcctcagcctccagattagctgggattataggcgcccgccaccgcgcccagctaattttttgtgtttttggtagagatgaggtttctccatgttggccaggctggtctcgaactcctgacctcaggtgatccgcctgtcttggcctcctaaagtgctgggattacaggcattagcgccacacctggccttaattttgatttctttagttcccttgaactgaaaagtgtctcatgtgttacctgatcccgtagcctgcttttctcatactttgtgttagctgtttaataaatattacaaattgcaaccctttgtctatttttaggtaatattttccccacacttttccttttttttaaatagagaggagacttaactttatgtagttaaattctcatccttttgctttctggtttcctccatttcttttaagcttagaaatgcttgtctcaaccagagatcaggtaagtaatacttaattacatattactctgatacttggttggtttgcttgattttgatatttaactcttcatccacctgaatctgtttttttttttttttttggcagagtctcactctgtcaccaggctggaatgcagtggcgcaatctcagctcactgcaagctctgcctcccgggttcacgccattctcctgcctcagcctcccgaatagctgggactacaggctcatgccaccatgcccagctaatttttgtatttttagtagagacggggtttcaccacgttagccagggtggtctcaatctcctgacctcatgatccgcccgccttggcctcccaaagtgctgggattacaggtgtgagccactgcacctggcctatttggtatttttgagaagtgcagctctaagttggttttatccccttcccccaattcctaaccagttgttcaggtgagacaaccatttgttatttctttggtttcagagaagctgtatctatctatctgtggtgtatccctctcaaacctcccctcattctgggttgggcccaggaggagggtatccaacccagacctggtggagaggagcagctttttttaaggccagtagtgctcaatatttataaactccttctgtatcagctcatgagacatttcacagttgtactcttcgcctgcttggctgtgtgactgagaggagctgggcgtggggtgatacagcagcgagcaggtgaggtatcggggcaagcccaccagcatctctcccgtgtcatctgcacttcagtattggattcctccccgtggacccagtgctcagaaaatccaaggccagtcttggtgctaccacttgcttagacaaatcactgagttgtctgtgtcagccagtttctccgctgtatttaagtatgatcagtgtgaactaaaaacctatttggcctgcctgttgtgaggcttaaatgagaggaagtatctgagagtgtttcaaatcatctaaagcattgccctcacataatttcaaagcaatattaatgtattaatttgagcctttaggtgctaagggttgtaagatgcaccatcattttgtcaattttaagatgcattccccatttcagagatgtcggaacaggaaaagccatgcatcctggaattggtgtttggtcctgactctcatggggggtgagaaatggtagagacagtgtcctagactcgggggtggggatgcgaggggtgtagaggaagacagtcatggatacccatattttattctctaatgatacagaatcttcattttgggccgattcctgtggctctattttctctttgtaattctactttgcgatgcatgtttcagaagagaaaccattttccagctttcttcatctcatttccgttgtgctaacagagaaactctgaattcatctgaggtgctttttacttttctttcggtgaattgtcaggcatgagccacagaagccatccgaatcaggtttctgtgtggaaatcacacggcggggaggtggaggcacaaaatgatcttaatgacatgcacatcttcctgctcccttgtggagctgagtgtggggggccctttgcagtctggcaggctcggctctggatttgaattcagtctctgccatttatcacttgagggatctcagatgaatgctctttccctttccctttccttgagacacagtctccctgtgtcacccaggctggagtgcagtggtgtggcagcctcgacctcctgggttcaagcaatcctcttgcttcaccctcctaagtagctgggactacaggtgtgcaccaccacgcctggctaactttttcattttttttttttttatagatgggggtctcactgtgttgcccaggctggtcctgaactcctggtctcaggcgagctccccatctccgcctcccaaagtgttaggattacaggcgtgagctgctgtacctggccaagtgctctctttctgatccttagttttctcttctgtaaagtgaggataaaaggatatattctggagcgttgtcaggagaattgaatgagctgcatgtgtaagccctagcagagtttcctgggtatagaggaggcacttagtcagcgtcacctccttcccatcttctcaggagttggagggtgacagagcagaggaaatttaggttttcactcttctgggggtgggtcaggtaactacgatcgaacctgcacgcattgttttagtgccacgttgattgggtcgcgcctgatcatttgcttctggtctgactgtcccagatccctgtcagcacatgtctggcaccagccatcctctgataaccctgccatagagctccaggagagagtggggcctgttcctggtggcctgagttgttgaattgtactctttagacatcgaacctaatgtttcaaaacacacattcattcgtgaggcctgtctgccgcgctttctctcccggatgtgagttccagcacatgcatgcaccccctcactgccccccatccagagccacagcctgccctgtcggaatatgtccagccctaatgagggaggcgttgtcttcagatcacacactccgcagcggctctgctctgccgcgccccttcaggagcgctgggtctgagagaggacttcagaaataacgggggcaacgttccgctttgatgctattattagaattttccaaacaccgcttgtttgtagcttcacagggacttggagagaggcgagtgggaagaggttgctgctagtgccattgtacgggaagctcaatggcatttatctggtccaaggtcattcaacaagaacaggttgaaatcaccctcagaccgaagagccggccgtctgtgcattttgcttttcccgcagttcagccgggactctgcttcacggatgctttcacctcaaggacagcgaagccagacacacaggccctgcgtggttgggggcgagagcatttttccatagtcagtgggctattccgaagctaagagaccgtttccttgaaccaaaaggctgattctttcctgctggagctcctgttttcatactcatttccctggggagtggagctgaggcgtgtggactgttcccacccccgcctgcacccaataagctttgggggagccaaatagtgcttttcactggagcctgagtggatgcagggaggcacacatgcttcatagaagggaatcagtgatctgtcccgctgctctggggctccagcatggagcttcacgtaggctggggtggggttggttctgtgtgacagcctgcacagaggtggtggatatggccgaagccacttctgcttcatgctgtgtttgggccagatgtccttggtggctgggagggtctgctgtggaggtgcccatggtcagagagcctgcaggctgcagtggctgacctctcccctccccacctggctttgctgagagggtgcttgctgggtgttctcagctgggcagccagccgaggctgtcacagtgacaagggaggaattattttctcttcaaggggtggatgtgaattacttaattatttgcagaagtttcattgctttttacttacattctcctgattcctccccagtggaagcatcaagaccccactgcaacaggctcgtcagcatcttgtcacagctgtggatgtttgccaggctttctggacgagtccagctctagattgcaacctggtttagctacacacgttgaaaaggagaagaaaaaagtagagataagataggatttggctcaggattgatgttgtatagggtttgacttttattatctttcactcttgaaaagtgaaatatattctcctttgatttctgttgacgttgttggaaatagagatttccttcaagtctttaaacagcattattatcgtttcctaggttcttagttttgatttgttttacaagcagtagtgcttcattctaatcctcctgcatccattttacctttttctccttggaatttgttcagtgatgacttaatagaaaaaacaccttgcatgtcgttgcgtgcgtcttttccagacctctgtctgtggcctcttctcctttcatctgccattgcccaagcgttactggaaaggggtcctcatccagaccccaaaggacggttcttggatcttgcacaagaaagaattcagggtgagtccatggagtaaagtgaaagcgagtttattaagaaaataaacagggccaggcatggtggctcagagcgcctgtattcccagcaccttgggaggccaagatgggcggatcacctgaggtcaggagtaagagaccagcctggtcaacatggtgaaaccccatctctactaaaaacacaaaaattagccaggcatggtggtgcgtgcctgtaatcccagctacttgggaggctgaggcaggagaatcgcttgaacccaggaggtggaggttgcagtgagctgagatcacgcctctgcaccccagcctgggcgatgcagcgagactctgtctcaaaaaaaaaaaaaaaaaaaatgaaacagaagaaagaatggccactccataggcagagcagtggcatgggcagcttgactgagtatacttatggttatttcttgatcatatgctaaataagaggtaggctttttatgagtttcgtgggaaaggggcagggattttcctggaactgaaggttcctccctcttttagaccatctacggtaacttcctgacgttgccatggcatttgtaaactgtcatggcactgatgggagcgtcttttagctattgtgttataattagcatataatgagcagtgaggatgaccaggtgtggcttttgtagccatcttggttttggtgggttttggcagcttcttcactgcatcctgttttgtttatcagtgggttctttatgacctgtatctcatgctgacctcttgtcttatcctgtgactgagaacgcctaacctcctgggaatgcagccagtaggtctcagcctcattttaccctattcaagatggagtcactctggttcaaacacatctgacatgagcactcagtgtctaccctcacgggggttatggtgtgaggagaccaacaagagcttctggctttttctagctgctacttcctgttgaccattgacagccactttacccggctttggtcccctcaccttactgtttgaaaggtatctaataatccccatttcagagatttatatttaaatgaagacatttagatgagaacaatcagggtcctcttgctaaatctgaagaatcccgatgttatcgttgaagccaagtgctccttcctggccacatgtgtcccttctgatgagaagtttatccctctcggttccctgccacaacttccaagctgcatgggacacaccaagacccctcttctaggctaagacagcacagtgcagcctggagttcagggtctcagcctctgccttcagcaacgcctcactcctcctgccccatgaagggaggacggttattctgcagcagggctgctggcactgggcctggaggggagccactgtaagcctatcaggcagtccagaaccagcacctgttccactgacaacagctagaattgtaagaaaatggccaccaatggaaagagcagtagaatagtaagggattttttgttttttggtaaaattccaaggaaaatacaagcaaagcactgcgagcgtaataatttgccgttgcatggactaaggggtaaggaaggatgaactggtgtattaaaggaaatccagtttcgttcccacctatgaagattactcaggtttatggagagttgttttgctttgggctgttgcggaaataatctacttggaatgaagttctttcagctcctgggaacctttaattgtcctgtgggctggtcattcaggttgtacatccacagactcacagaattgcgtagccctgggaggaagggaccataaagatgaatcagcccagccttcctcagacatcctgcgaccaccccaggcccagagaggctgtgcctggtccaggctgccgggtccctgcgtcagctgtactggaactgtctgctgagtgcgccctcccccacggggcttctgtctgcttcttggacacccctttcttccccttgggggtcggctttttaatggccagctcacctctgcctgagaggaggaatgaatcccaaggcttgggtttaggggatggctcacctctgccagcctgtgcttcatgtttggagacaggtgatggttaaccaggcaacagtccctgccagtagtgtgtacacagacagtagtgtggctggtaggtttggccaaggcctggagttggattcctacccctgccactgcctggctccactgccctgggccaagtccctgcccttcccagtgccccagcccctggacagcagtgcctaggtgacagagagtggtccctgtcctactgaggggatgggagcacagtggagcgtgacttcccgtgaagctgctgtccgttgctatagaaatccagcctcggaaccgggagtactgtcagtggtgctcgggaaacttcccccttcctccagcctgtgcttcctggagtgacgcgctgccacagctggaggcttctctgcaaacgtgtattatggttttatcttctcccctcccacaatgagttctgtctgtgtcaagtgtttagagatcattcgaacctttctcctcacccctcccttccccttttcctcagggaaaagcttgtgcataactcagtagtaaatgaattgtctaaatcatgtagcaaaacacaaaataatgtgactcccagtagtatatgccattatacaacccagctgtacagtatttcagtgtattcagaggacctcttttccattaccaagtgatagtgtggaagggaagatacgtatcctttctagttctgaaatagctatattcttattttctctgcttttgtgtcatcattgaaaaattccagcattcgttgcaaatgtgtgtctattttgaaacaaatgacaaacgaaacaagaatgcatagatctgtaggtaaccatgcttaaagacattctgtttcttcaaggggaatgtgagtgaatgtgaattggatcaccccacaggagattagtaggaactgatttattttgttggcaacatttgttgacagtgtgtcctggagtcttaatattacagctgaaaggagagatcctgcccatcttaacactgcgcagaagggactcgtacaggctctggctccagacccgggctgggttccttactttgtttttaatccttaaaagttggtaaaatacatacatcataaaatttgctgtcttaaccatccttaaatttacagctcagtatcctcacgcatccacagaactctttcatcttgcaaaactgaaactctgtctcattaaacactgactcccttctcccctcccctccccctggcaaccaccattctactttctgtcttcatgaatttgactcctctaggtccctcatgttagtggaatcatccagtatttatccttttgtgactggcttatttcacttagcataatgtcctcagggttcatccatgttgtagcgcgcgtcagagttttctccctatttagggctgaatattccattttatggttaggccacattttgttgatctagtcacccattgatggacacgtgggtccttatggctattgtgaatagtgctgctgtgaaatatgggtatacagatatctcttcaagaccccgctttcttttgttttccttttttttttttttttttttttgagacagggtctcgctctattgtccaggctgaagtgcgtgccacaatcatatctcactgcagcatcaaacgcctgggcttattttcccgcctctgcctcccaagtagctaggatgacaagtgcttaccaccatgccaggcaaattttttgtttgtttttttgttagagacgagagcctcactgtgttgcccaggctggtcttgaactcctggcctcaagtgatcttcctgccttggcctcccaaagtgctgggattacaggtttgagctaccacccctggccgagaccttgccaccacactgcttaataaaaggctgggctgcattttgggattaggacctcctgtggaggtggggggagggtggggaaggagaacggtggcatcccagccaggaagcatgagggatggcatccgtccaccaggccacaggaagcataagggatggcctccatccacccggccacttctttccacatcagcattcttccgcacttgggccacacagggtctgcgagaactccaggtggctcttagagtggcactgaccaagtagtctgtgtagggggactcactgtgccccccatgctcagaggctgtatggtgaagtcgttaagggcccgggcttatatccagccccgccagctgatcactcttgatctggggcaagtaacttaacctctgtgtgcctctgtttcctcctttgtaaaatggggaaaaaagtagtacctacctgctagggctcttctgagggtgacctgggttaatataattaaatatacctagtacgtgcatagtaagcaccatttaagtgtctagaacattatgggtaaaaatacgcctgtgctttggtgagtctggaagtctaaagtgtaactttcctaagctggtcgttgcctgctctgttcacctccgtaagttcgcatgctcatttgctgaatgctgtctgcatacttgctggtcagctacttcttgtcctctgtcttactgtggggcctgcgtgggaaggctgggtttttctgaacacttgcttataaattatcctccttctgttcatttaaagccagatgctctctatgtgagaattggcccgtaccctgggagaaggtttgagctctcctgggtcctgggggccagcaattccaggagagccatttccttcctgtggctgctcttcagagcagcagcctgcaggctgggcccatccctggttcaaactgtttttaggggagtgggctggagagctgcccaagtccatgtctgagcagctggtggagagaatggtgctggctcctctaggcttctggtactcctggagcctgagtccagagactgaaccttctagtccttcccttgcagtggattctgggaattggggtactgggcactgtcagccccattccctgtgagcatctgggctttgggcaaggtcctcactctctctggctttcagtttctgtgtgtgaaaaatcaggggaatccgcagcctgagagcttctctggaagatgtagttattttttggtaagagatgtccagtcgtttgcagcagctgctaggaatgaaatgcagaactggagacattcgagagcagaagagcagaagcagcaacaaggtgtagtgtgtgcaggttccacagtcacacagcaccgctgcccatccttcatggggtcctgaagtcccatgcagaactgcggggtggtcctgctgaagttcttgtggatgctgctgctgacctgtaaagaggcatggcaggtgcagtaggggccgaggagaaagaggtcgtctgtcggcctgaacacttccttggttttttcttggctttacgcagcatgttgcttttcacatgggaaagtgtcaaccccacgctcttattaaagcattgagttcttccaggcctctgttgctgctctgataactgaaagggtattgtgcttgtctttatctgccacacgcacgtgggtgacattgatgcgccaaccagatgcccccagctgtgacaggcagaatttaactgtcgccctgctcagcggtcaccagctcatcttgtttgtcctgatgatggtccctcctgttatttggctgtttgtcagatatcaagaattttctttgtaattaggctttaattgctaacttttaaattctaatcactttcaaaatagcactcttttaaatggaggtgacacatcttaggacattcagaacgatacctcctatatttgccagaacatattccacttacaaaagcagcacctgcgagtgcttgacagctgtgtcgtgggaggtggcttgatgcagatcctcctggccacacctggatcgggaggcagagcaggttggggtaggagacgtctccgtgctgccttctgggccacatgtcaaagagttgacactgttatttcacaaccctctccctgtatctagagtgaccatgctatttagtgtccagacctgagtgcttttgagaatgaaaggggaaatgttaataattacatggagacagtagttagtatccagaacatttgtcctgttttgtgcctgaaaccaagaaagactactacactcggcttctctataaccagaggatcacagagccagcgtcacccgcagcaccaaatgataaaagctcagagtagccggtgcctgcacgtgaagggcggtttgtgttcctcgctactggaagtaggattatggttgtaataattatgtggacttcagtattttttccttaagaaagttttattgtgccaacatctgcaacaatagacgctgtatactcttaggtaccaagcacccaccaggatttcgccatgcttgttttgtcttttcctgtttatgcctgtgtgtgtgtggtggggagttaggggtggtagtggtgtgttttaaagcaaatctcggatgttatttttcttcttgtgatgcttacttcaaagtaagtaccactaaccttgtgccagtgttctcatgtggggcgaggattaattaaagactaagggatttgaagagcaactataaagtattaaaaagcctgggagtaggtggttgatttggggcagaggttatggtgttgctgatacagtggcttctaagcttcttgtgggaaggatgagtttatctttggcagccttcagtgatctccccgcaggccttgaggtgagatgtgtagtgatgtcaggctcctctcttgcttggtaacctacaaaccaagcaaggtgagaggcccggcggagcatcccaagggtctcccgatggccactccagagctgcgtcatctgttttctgctgcagcatctgcaggctctcactcatcccgttacacttagagcgacccatgtgcctgtgggcccctcctgcctcagtaccaagactgtccttggcaccccctccccaaccccattctcagatcgccccctgtgttgcttgttagcaggcaggttccagtgcagactggccgaatctgaatttctcagtgagcgtctcagaaatctgcactgtcagctcccctgacccctaagtttgtggggtttcctggccaggcctcagactctggcagtcgggcctgggccttctgagggggtttgtcctggaaatcctgtcttcccccaagggaagctcccccaaaggaacccttttaggtgtctggtgtttgaagccagtcccccatttccctctgtttttgttgttatcacatactgtagggatggttgtaataaatacagacttttagagaatgcagccaacttggtggttctctggggattcctccactgaggtcggggcttagacatttacacggttttcttttgccttttgagattcttatccacagctagttggttgaaagccacccaccttggcatagtgccaatgggggccttgccccgtgtggtgcctgatgcagcacagcaggacgtcaggcaagcccagacgtcaggcaggcccagaacgtcacctgtcttcttggtggcagtggttccatctggacttggaaataccatgtttgaaacaaggtccctgtaattacttaattgtaaagaaatgagaggtagcatttcggcttgcttgcctacctgcccagcccctctgggaagtgtgcctttcaaagatgctcgccgcttgcatttttattatcctgtgattaagagagaggacgttggtccactccttgtccaggctgctttgggctgtagtggacctgcttctggtgttccttgaggttctgctttcttgtgagggttcttttttctctctgcttcttattaatctgtagctgcttatgttttttggcttggctaaaaataagcacttttccttcttcctcctgggttaggagtgaaaaagacagtctttgtatttctgctgtttggagttggatgtgagaaattgataagctaaaagactgtggttatttttcccctcccttttcatgtatctcgttagggagccctggaggaggaagctttgggaggagtcccgcgccttctctcccgcaccaggtctgagaacttgttcgcagctattcatgtcttatgtgtgcctggtcacccctcttcctctttcagttttgtttttttgttaatagctaaatcacatttctggttatttccttaatatggacagtattttcatttcctctggaggtgttgatcggaggccactgcctgcctcccttcctgacccggttggagtgaagcaggtgtgggctcagaaaagcctgcttgggaagcactcctgtgttcatttacaactcagccaccttataccaaccatacactgcacactcagtattagatgagaaaggagcaaactcggctctcagggagctggggcatttaggaaaaggaaacaaattagtatagtaagatgcattaatgaaacggcattgggactaacctggagggatggcccaggttgcagggggaggggtgggaaggagagagggcatagggtgggtgtcgtgcatgtaagtgaaatggcatgccaggggctgcacgcacctcagagcggccccacgtgttggcggggaggcgttatgctggaaacgtgacctgtgaggaggttaggtaagaaccacgcagggtcctgtatgctgcagtccagagctggctaccgcctgcactgtcagatctcggtgtctgtcccgctggccgcactgtgtgggagtcgtggcaggggacagacaggaggcaggtgggccactagagcccaggtgagaagggaagcaggccttcagctgtggcagggtgaattgggaaggaggggccagagttagagaaacaggaggcagtgtctgcatatctggctagctggtgagatgttggggatgaggggtgggcagtgccaagctgggggagatttcagaccatgattctcaaaagaatgctctctgatttgacagcatcctcaatttggaggaattacctttgtgttccttccaagatgttgtcactggactgatgaactgaaaccctttcctctggcattttctagtttccaagatcgaccgtgaattataaagacttcattttattcaacattcattgtgttcaaaccttctagctgaaagccgcctactttggggttaaggtgtgggtttgcctatattcactttgctgtccttgactcttggccaacattcctagagcccctgccacgggactgctgtgggctgagactggtgtcgcctctcccttgaaagcatggcctgctctgccgtgtgcctggcttggccactggttctcctttcctggtcccgcgggggcttttcttttcttctctgttgtaaaataatctcaggccagggccactcctggcctactcttcgattctgcgaacagtggctggctagtggtgtggccacattcccctgcagtggttgaggctaaacagtcactgttgagagaagctgccttcctcctccaagagtccctccttcctgccctgttgccctcttcccattgaaggagagcttctgtctcctgagtgagggcctcagctctgcctgtgggtcacctctggctcccagcctggaaggcattgcaggcttcatgaagagagctcgtctttagctgctatttctaagcatgattgcttgttggaggttggcagtggtagatgctcctagcacacgtccacaccttcagggcaaacgctctgtccccagacactgtccctgtttagttagtttcctaaactatgatcactcagcaacctcaaggatagtcactgtattattacatacaggtgcagccctcttacatacctgtgtgtgtgtccagccccactggacacatgcctcccacttgcccacactcttccccatcccgctttaaagcttcaaatctgaaaagacagtggcgctgcgtggctgagagccacgaggtggactttaggtgaagggctgcccaccggcacaaccagatcagtggccagctcggggcgtgcacagtgcactcagagggagagccctgtggcactgcgttattttcctcctagagctgaagccagaaacctgatagggaaagggggcgttttcagggctggagtagttcagcacagtcccttcctcactgtggactccttttctaaatctgcaagtcacaggtaacctgggtgcatccaacaggtcccacagccctggaaagccctcgtttaacacaagtgctctctgtccttgctgcagaggcggctccacgccttgcttctagaggtccctcactcgccttccggagttaactccagggtgtgggtcagccttttcaaggggttttgttttctttttttttctttctttctatttttgtttttgagacaaggtttgttgcctaggctggagtgcagtggtgtgatcacagctcactgcagccttgatgtccctgggctcaggtgatcctcccacctcagccttccgagtagctgggactacaggtgtgcaccactatgcccagctaatttttgtatttttagtagagacagggtttcgctctattgcccaggctggtctcaaactcctgggcccaagagatccacccacctcaccctcccaaagtgttgggattacaggcataagccaccatacccagccccactcctccccaccttttttttaaacagggcctcgccctgtcacccaggctggagtgatcacagctcattgcagccttgacctcctgggctcaaatgattctcctgcctcagccatctgactagctgggaccacaggcacgtaccaccacgcccagctaatttttgcattttttgtagagacggcgtttctccatattgcccaggctggtctcgaactcctgggctcaggcagtccacctgcctcagcctcccaaagtgctgagattacaggcgtgagccactgagcctggcctacttgtttaattcttgattgcttgatttcagaaggtgctgcttctgcttttatggctcctgaagtcattttatggtcttgaccttgtctctcctggagcgggtgggaggacattgcgaggccacctagattggacttgtgtggttgagcactgggttcaggaacatccctggagggtgggtgatggttgctgcctgcttgctgttttatagggtgtttctcttacaggctgccaatagcttggtggtttgagcatcctattattgcagtgattcttaggtctggcgttgagggcagcaagatttctgcctaaacatagtccttctctgtagtagtgattctaggatgagccactgtagacaggggcatgtattgagtgcaacaagcggttgagggaccttagattttgagggtttttaaaaaccgcctgattggtttgtgtgcatcctgccacagtgttacctaggtgggcttaatgaggtgggagtgggctttttgttttgttgttttatgcctcagccatgtaaatataaacagatacattgaatcattcaatgtccagagtgggaaattacagccaagccctcctcacttttagaatagcatggcgtgaataactgcaaaacctccctctggtctttcctgcctctttaagagttctgtctccagagactggcagagccgtctctgggcagatttgccgaattgtttcagcagggcttctccggtggccatcagatcaattgatcttgacacatggggtgcctctgagggcttctcactcttgatttaattctcagaaacgcttctcaacaccgttggtgtctttcttaattataccataatagaggttgacagccacacagtatgatggaccccagggtgaggatggctgggtgggcttgtggggctgctgaggcagagacctaggagggtgctctccattcctggatgcggagcccatgagtggcttaaaagacatgcactggctccgccctggggccaggagagccatcgcctgcttggtgactgcaaagctgcctacctccgtgtgctgccgtttttctgtaccgaagcttccctctttacctcaccataggaagcctgagatgtaacactcagaagaggcttgacaggcttggaatcaaaggcatgacttcatacatcacccaaggtgtcatatttcttctcagaaacttatatttggataaaacaaaaatcctttttcaacctttgaaacggtttccaacagctgctttaaaaagacatagtacaacaactccttccacttcctctttctgcccgctttgtttttgtccgcaacctttgcagagaagtgaatgtctctgttagagttggagttggaaattggggagggatgtgtgacttgattctgaaaggaaagtctcatctctttggtagagcatttttgttttgtttgtttgtttttagaccttaagctctacttataattctgtctaagacacctttgtggagcagttggagtgcctggctcctcattagagaatgcgctgcgacattcagcctctccttggccttctaggatggcgggaggcacagacacacactccttttcccacccagggatttggcgttcagaatgggggctttgactgcttggccctgactgtgcagttttctggatggaagcctgctgtcttctgagcacaaaggaatccatcgttttctttgcttcccgaaggaatctattttcccagtggcagagcaacttagagaattcccagccagggccaccattctcaactcctcaggacgaggctggtgcacccggcatgcaggtgtctgtaactttgtgtgacttgttgaactctttcctatttaaggtgcactacctgggttgcctggagcacaatattcttcctcttgtggaaatatgttcaggatcttgtgtggtgtcctgggtttgattttatagctttgccaacataatgattacagttgacgatcaccgtggccaccgttgtcttttccctccattcccctgcagctttctggacctccgggatgtcctcctggagggaaggcccctggagaagtgtcccagtagaacgcactgttgtgtcacttgctctgaccaccgttgacatcgcagcacagcgctgcacacccgtgacagggtgatggtagaagatgagggtcggattgtccacgtagtgcctccaggaagctcaggatgatggccaagccagatatgtaaggtggctttggggcacaggatgatgccctcgaagtaatgcatggtctagttgttttgtaaacagtgctgtttcctgaagaagcaatgattttctgactacccggcctccccaagatagccctgggaggagaatttctgattctctctacagcagtgccttcttctgtaggatctccccacatgtccctgtgcccaccacgtaagctaaggaaggaaagcagagctcctcagttcattgatggcttcaactacagatgaaccagtgttacaggaaaggggtcccgatccagaccccaagagagggttcttggatctcgctcaagaaagaattcagagcaagtccgtagtgccaagtgaaaagaagtttattacaaaagtaaaggaataaaagaatggctgttccatagacagagcagcctcgagagctgctggtcgcccatttctatggctatttcttgatgatatgctaaacaaggggtggattattcatgcctctcctttttagaccatatagggtaacttcctgacattgccatggcatttgtgaattatcatggtgctggtggaagtgtagcagtgaggacgaccagaggtcattcctgtggccatcttggttttggtgggttttggccggctcctttactgtagcctgtcttatcagcaaggtctttatgaccttattttgtgccgatctcctatctcatcctgtgacttagaatgccttaactgtctgggaatgcagcccagtaggttttagcctcattttacccaactcctattcaagatggagttgctttggctcacatgcctctgacaaaagtaaagctctcagggggctcaggctgatgggttcccttttacttctttgaatccccagtcgggcttggaaccatggcctgtaagcgcatccgacacttggctagaatctcgaacctgactctttcaaagatgagggcaaggtttttcaaattgtaagttgtgactcagtagatcatgaaactaatagaggagaataacatcagtattcatgatgaataattaaatagaaaatactggagcacatcatacatgtaagagtaggtacccttttatgacaccgtatgtggatggatgggcgtgcatgtatttatataacgtatatatttaaatacatggtttgggggatggatgtctacatcaaatttatttgttactatgggttttggcaaaaaagtttgaaagctgctaggatagtgcatagccaggagggaaataagaagaagctatgagagaactagataatccttctcctacacagactcgtgttttgtgtgagtgggacactcctcagcctgcgtccactctcaggtagcttcctctttgaaccgcttgtcattgtgaggcagtgaccatctgcgccagccctgtccttggctctaacgtgatgttcatttgctcacctttcttggacttcctttgcttcctcaggctttagcttcttgccctgctgcctgtatctatggccttctctctggctgtggtttagggaaaatcactccatctttctgtgccttcagtgtgtttgtccactgtgagtgaagcataatcaatacttggtgacttggctaaactgcgttcagtccttctgaatacttatttacattttatttattatttttatttttagagatgaggtcttaccgtgttgtccaggctggagtgcagtggcgtgatcatggctcactgtaatctcaaactcttgtgctcaagcgatcttcttatctcagtctgtggagtagctgagactataggcctgagccactgcccctggcctgaatacatttaaatgagataaaattaaatgagagaatgaaaatgaataggcccattgccatgcctgagacaaactcagatgtctgctaatgatcggttcttttctccttacatgcgggagtgtttctgtagtcagactggacacctacacacttaaacagtcattgatggggggtcagccttcaacattttaagggtctctttgcgtttttagttttatttttaatcacagtaagcacattttcatgtattagagaaaaagaaaaaacacccataatgctttctgtgtagaagcaagcattacagtggccttggtggtgttttttgaaagggctggggaattaattcatcgagaacatctgaggacgccttccagattcaccaatcatcaggcccctaagtacccttccagccccacgcccctgagttcttttcatgattccaacccagaggtctcagttgtgaaaagtttcttttgtcagacacagtgagctcagtctgtctggccgaggccactccgctcttggagatggattacagcctttgttcccactcctgggcctcctggcgtggcctcgggggcccctggttggtggcactcaccattcactctgtggaggggtctggtggaactgatatgttcataaaagctactggtaaaaacaaaacaacaacaaaaaagctactggtgcccagtgcctcttacaaactctcatgcagatttatcgtgtgggtctgtctgcgtgggtgtctaccttataaagactcagaaatggtttctcttttcacccattgtttggagaataataagtctctgtcagattagcttcttggggcctcagtgctttttgaaaagagcttgcataatcagtgtctggtgagctgtgaggccaagagcatattgccattgtgcaacggggatgtggattttgtacattttcaatatttcaccattcagtcttgtcagaagtcaagctgccgtccaccctgcacttgcagtggagacataggcccttcgtccacagtggataagtttttctccacgtgggccacattcttactagaaaagaaaccccggccctttagctcatcaccctctgctctggctttccccgagttggtacagagctgatgccgttggtgtttttaagaaataatcttgagtcagaaggaatgtgccaaaccggcacaggtgagagatctctggacccccttatatttgcctattctgccccttctgagaaatttctgggagagaaggtagtattatgggacaatgaagccctaacccccaggacctcagaatgtcactttatttggagataagatctttatagatataatcaaattaaaatgtggtcgtcagcatgggctctagtatgactggtgtccttatgaaatgggggattcagacagagccagacacacgtggagggaagacagtgacaagagaatagacaacaggcaccacctctaagccaaggagagaggcctggaacagcatcttcccccatggccctcggaaggaacaaaccctgtcgccccttgagcgcagacttccagaactgtgagaaagtgtgtttctgttcctgaagcctcccagtttgtagtactttattatggcagccctggcatacttactcaggtagtctctgtcaggttatttataactcaccttatcacattggtaacttgtggttttatcatttggcatgacatccaaggccccttgcagttctaatatttacgtactagcacttaaaaagactttctctgaccacagggtctttgctggatggggtcttggtctggggctggggctttggtttccaaacatcagggtcctcccagatgaggctgccccgcgccgcatgcaccccccaccccgtttccgcgtgcagttttctgcggaagtatttcccaggtcctcggtttcccttctgtgtgagagcgtcactttctctcacatctgtggagcggaagtcctgaggcagtcaccgtttggggcctgcatggggttgtgagagcccttgtgctggctcctgcccgccctgttcttcgttggctgcctagggctccctgcaggttttcgctcggaggtgggccctgcctgcagccgctgacctccgggagagaccggcctctccctaattatagctcatctcttaatcccggtcatcatttcagctggctgtccttgaactgaaaattggaatacaattcaacctgtagctgttttaaaaactgccttattcagagagggtcaagataaagaaattttagcttctttcaggatcttccaaaacagatcaggaatgactgaatcaggacagggtctcctcctttggggctgggagggacagggcaggactctcccaggacagtcccatgggcagagctaggttttgtgaggactggagcttttgtcatttgaagaccatttctaagagaaagagtgattataaacccaaaactgggctcccaagtgcatagcacaaaggaccccacagaagatcacaaatggcccatcctgactggaagagagagattagattgagggccaggtcgtgagggcactctgagggtcgctaagacattcggcgtcaacctccagttcactcaggagttctgagtggaggacaaaagccttgctttaaaaggactaattctgtagtgattttgccacatggagaggggagggaactattgtgtcagatcaggaaaaccatgggatcagtgctaagggcctgtgtggtgggctctgtctgggtgggagagactgtgtcctggtcatggggctcagtctgtgggtgggtgatagaagagtaaagcttttgtgtttttagggtggggaagagaagagagagtcattgattttagatacaagtggaacaccacgtagacctggcctctgggtggtgatgaccttctggggttgatgtctggagacggtgcggttttgggatgggggagcagaggagggagagagagagagagagaaagagagagagagagtgtgtgtgtgtgtgtgtgtgttttacagcaaagacctggatcctgaatcttggggagaaaactccttgcattgtacatattgggctggttacatggctgaagttcaccgtgtcattttaggcctgtttctggcttccacactggtttgcaatgtcatcctagggaagtcagcttgtccttggtaggatatattcattggtgagttcactcaagagactcctttttgcgtttctttaccttcaacgttcgtttcctaaaattgattattccttcataaagttgccagcattttcaacatgcttcctagatgctggatattttattatcgtttgtcacggatcaatttatttttttggcccttaaactatcacattttctgcagttaaatttgcttaactttctaatgcaggggcagaatgtaacctgcaggttgtggctttagaaagcaatgtggaactcggggccatggtaagcaagttggtggtggttttttttaatagcacatctcatcctttgatgtcagaacactgtctacacactctgattcatttcagtcagtccctaaaatgtgaagatgaaatgttggggagacagatcctctggcctgaggaagctagccgtcttgtttgggagataagaaacatcaactgttttgaaaatactttggttctatcattagagagctgatcaagtgcagtaagaggcaaggtcagactgggctgtattatgttttgatttggagaaactatcacgaaagaggtaacattgagtcagagcctgagagaattgtggagaatccctgcaggagtaaataagaccatcccaggagggctctcatttaaggcctcgtgtactgtggtcatttgaccttggttcagatgccacttcagtttagatgcatttaaaagcagagaaaacattggaacttactgtgtagtattgagtgagcattaattgagatgtgtgtgaaccattgagcatgatacctggcgtgtcgtaagcaccattatagcaaacttatagaaagctgcattatgtcactgtacacctaggggagtggctttggggggaaaaaaagcaaaaatgccaccaagtactggcaaggacatagagcagctggaactcttatcccttgccagtgggaatgcaaaatggtacaaccactttggaaaatagttgagcagtttcttataaagctaaacacatgttctcatacaacgcagtaatcccacccttagatattatccaagggaaatggaaatttatgtgctcttgggattcataatggcattattcatatttgccaaaactggaaactacgtaactgtcccacgactggggaatggatgaacaagctgtggtttgcgtacatggtggaatgcagcatgtggcgggatacctcctgcagtggaaaggagacaagcacggttcacacaatgtggatggatctctgtacattatgtgcattaagaagccaggtccaaaggctacatactgtatacttctattcatatgacattctggaaaaggcaaaattacagagaaagcagatcaaggattgccaggggctggagaagagagttaactacaaatgtactcaggggagttttggaggatggtggcactgttctatatcttgattgtggtggtggttgcatgactatatgcagatgtcaaagctcccagatctggatactaagaagagtgaattttactgtatgtaaattatacttttaatttaaaagcagagaaaaaaaatcataagccaagtcagggaagtgagaaggatcttgttgtatgtggagaaccgtcatggaacaggccagaactgagcacagatcaggttgaatgggtaggatgaactgtgactccagaggcattgaaagggaaatgtttgcatggggcgtggtggaacacagagagccctcgggaggcccgggtagcaggggggcaggatgaagggggcatttcgtgttgtgtgagggatgagtagcgtggggagatgaggccagaggttccagccaggaactagtgcagttctctagtctgtagataaggcctgaacacagcagttggttgtaggattctggagagactggagcttagacctgattacattatatatgcactgtcttttctcagagatggggaaactaaggcatgaaaacattaacttttattttggaaaaatgctaaacatagaagtaagagggaggcctcctgaggcactttgccaaactttatgcacagcaactatgacctgcaaaatctttttagcctgggctccctctcttgacctgagactcttccagggagcctggtatccacaagagtggaagcagctggtcagggccacggaactggagatgccccatgggacagaaggcctggggctctggcaaagtgtcttgtaagtgttcctgtcatttccctccacgtaaaccaagtcaggcttgcaaatcagcagcctttcaggtcctttctctccttctggaagctcttgcatgttgcaaccccctacccaccccgccacctcccatcacagataaagattttgtaccatcagcctgcaagtgagttggatgaatgccatctgaaaggctttgttcgtttgcacacgaggtcgtgaatagctggcaacaaagaggattgaaccttggacctagtgtgtctgagcagtgccccagcccccatgccgctttggatttcagtggcctctgcagcaatttattattcttacatcagatgtttgaagtaggtgaaggggcaggtggcatgtgtctggtgaggttgctgacactgcttttggatgagagagagagtagtggttgaaacagagcattcaaaaaagcgtacactttaacctgtaatccgcaaacattcctttgagtttacccagccgtgggaaaggacgctgtacccctgccctattggctgcaccctttgctgttgatgtgaggctttatttacctgggaattgacagggttttggtccatgattgctcctttctccgcaatcacatttaatgcccatgatatctcatctttgcacacgaaggcaaagccttctactgctttttctcttaaagtgttcagcactcccctgagtttattagaaggatcagaagaaagagaccctgagtgtgaggctaggtcaaccggagaaattcacccaattatttcgtttctttgtttggatccctgcttttcatttctacctattctgaaagagaggcttaaaactaaagtccggttagttgaggatcagatgtgtcatacttttctcagaggggaggggacggtcactttgctctaagtttgggccatgaggtccacactgagcctacatggggtagggggaaaccgtgaagtgtgcagtgacctgagggtgccagatcaccccgagccgttgtggttcccactgggcaggctgtacgtggtgaaggtgatagactgcatgtctcatgcaggccaagtgcctgtcggtcagcttgagggagaagataccttgtctacctccccccacctgcaggctggctggctttgggtgcaatgaccctcctcttccttgaatcgctgtttcattgtggacctgttggaagtgccagcttggctggcctttggctggatccctgtttgctagagctttgttcctactctggaggagtcagctgctgtgccttctgggactgccaagagttgccaaggggagtggggagtcctctctgtggggtgtcgtctgaatccagcagccgcaccacccaggtgcttccctcctccccactcctaggccaatgtccttagtttctgctcactgatcagacgattatccttctccaggatgaccaccatcatctcatagtccttcctcactcccttccatgaagtgcttctccaacccattgtctctgtcatagtgaaatgattctactgttagtatcaagattttccactagtgctaataacaatccctgatgttatcaaacatgtaggatgggccaggcattgtaccaggtgtctacagaaatcctttgtgctgactgttgaccactatccccattctgtaggcgagagtgagccttaggaagggcgttggacgtggccaggatcacacaccatgccttgcactcacctctgatctctgagggccagggcctctctgtatacaatgatctctgcatctcttcttcctagcagaagactcaaaagaactttcagatgtgggaggccaaggcaggtggatcacctgaggtcaggagtttgagaccaccctggccaacatggtgaaaccccgtctctactaaaaatataaaaaaattagccggtcgtggtagtgggcgcctgtaatcccagctactcaggaagctgaggcaggagaattgcttaaacccaggagatggaggttgcggtgagccaacatggtcccactgcactccagcctgggtgactgagtgagactccatctaaaaaaaaaaaaacgaaactttcagatgaataaattggttctatcagagatggctcttaaagctcaaaagctgttttaaaaagccctgtggatgcgcaggctctcttagaccctttttctgtgttacagaaggggatataataccccaaatagggttttttttggtacaaactgtggatagtactagattttgctccatacagagtcctgttgactgaactgccctttcatgttgtgtctccagtgtttttatgggcaacagccatatacagtctacttcctatctattgtgaagttgttgttgaggatttcctgtattatttcactctgcattcatgtctcagttacctttgatccctagcaaactgtcccaagtggaatggcctaacccaggaatgatgtattatttcttacagtcctgtgactgtctgggcggtccttttgctaacttccccagggctcacgtgtgccttgtggtcaagtgatagcagcgttggctggctggtccaaggtggcctcacgtgtcctatagtatttgctagctattgtctggggctcctcaactctccacatgccccagtagcatagaccagcttccttacaccatggtggtctcagggcagcattctaagagggcatgtccaatgtgcaggtgtgtattaagcccctccttgccttgtggttgctggcatccaattggccaaagcaaatcacatggcctagtccagaggccgactccagctgtctgtgcagacgtggcaaagaaatatggccacttccaatccactgcagtccagtccccaaaatccattcttttcatggcacattttggaatctagcagctgaatttcagtctctcttaagatactcatgactttatttggatggtgagcatatggttggttggagcacaggcttcaaagtccagcctgaattgagattctgacttgctctctgaccattgtgcctttggcgggtgactcacatccatttcttcatctgtgaaatggatatgatgatacttgccttcctgagattgttgtgaagttaattgagactatacatgaagtctctgggccataactgatctcattacaccttaattcttgtttctattacttattttacttctgtctctgggaagttcagagtttaaaaattcaacttgaccacagcatctttacttggtcatttctgcaatcaccatgttccatttcttttgtgtttctatttagatcttttgttttaagctacccaatcctttttggaataatatggggtattattaaagtaagactaaccagcaaaattctgtaaaatttaaaaaaaaaatcttggcgcttccagttcattggttttgctggtaagattcaggattatagtactgttgaacaagcttgtatagacgtgaatgagtttccacattcttatagatttgactcaagtgatctttgcagattttcacaagcactgaagactagccagccttcctttaagtctcccagcacttaattcatctggtccaacacatgccgggttcttcagggtgttaggatgaagctcctgtatctgatcacctaccatattccacacattttccatacactctttctcatcctctgagaatttagcattccgggtgatgctactaagatggatgaataatttataaagttttagaattctaaatatagttctttctagtttcccttagggttcagaaaacaatatcccaaaatgaaggcctcagaagcaaaagtttttcactttctcctgccctccagctgccagtctccttctccccaaggctgcccttagaagctagattccctccatagaagctagaatccctcttccctaaaacaggtcctaggaaccagaacttgctttccccaaagccagccatcaaccctgaaaatgcagctctaactttccctctgccttgctatgtaaatactgtttataaaaacagtatgtgacttaactgtttgactgtaggtcataagacccacccctccactccattccagagagggtcttgccccaacccagaatgaaggaatgctgctcagagaggctgagaagaatctagatggacaggccttgctgggcttccccactcggtctgttggcattggaacctaccatttttgtccagtcacatttccacatgactgtccatactgtgttgaacttaagcatgagaatggacaatttcccctgtaactttgggtcttcattctgatggctcctgtgtgtacacattaaatcaatgtgtatgccttttctctaattaatctgactttttcgagttgagttttcagtgaaccttcagagggtgatggggaaagttctccttgacccctgcatttctaagtcagtggacacgtgaatctttggcttacagaaagataagaatcagctaaacatgttctttgaaactccgcattaaaacaacaacaacaacaacaacaacaaacttttgtcaaaggaattgttaaatcccccaaccttcatgtgcagtgaggtgagatccaggccccacttggaacaagttccatggagtgcgcacatcttgtgggccactggccactcctgaattccatggactccgtggggctgaggtgcagtggaaagatgagcagtgactgttcccagtgctgttgctcatcagagagcatgggatgaggtcactccggcgatctctcatgctttagcgtttccagctgtatgagggaggtgtggtgtaacttctcaggcggtcgtgtggctctgggctcagtttttgttgagagccttctgtgtgtcagacactgctagcatcatcatgtatgtccttttatttaattcctccacatcacagtggatagaaaacatggttcctattgctacgagctccagagcaggaatttgaatttgccttcgaagcccgagctgctcacagcagctcactgtcttttcagctttcccatcaggatcaaatgagacgaagtgtgtggaaaggagaagcaacctttaaaagtagatcttggtaaaattactgttttctgaagttggaccagggaagctaagaggaaagagggacagtccccactgactgtcttggctgctgtgggccaggcctgtgccagtcacttggtgtcagtgagcttattggatttagctttcccaaccacatggacacggggtcagtctgtctgtcccagaactggccgggggtggtggatggagcctggactctgggccagtcacagcctgatgtgacactggatacactgcctgttagctgtgtgctcttgactttgttttttttgggagggtctcagttttgtcatcttttttttaataaaaggggtattaaataccatacctcaaagatactgtgaagaacacatacgtaactgcaatcgcacacgtgtagctcctctacaatgcctggcacttggaaaatccctggtaaatgccagttctgtgagggtggcatcactgtcgctgttatttccatgttctgggttgggggcagaagggccgtcgggcccatggggaagtacccagtagaggccggtgctttgctttctctccttgtgtgtgtgattgcccgtacatgcactgtcagcacccgagttccctgtacacatttactgctaacagcggtgataagcgcacaagatcactttggtgtttgacccgtttcttggagaaagcaaagattcagtagggaaagtgatgtacatagaggagatgagcctctcagcaggcttggcggactgcatccgatcatgtgatctctttcttgcccaggacagcacggtgctctctgggccctttttcttttttttttttttagacggagtcactctgtcgcccaggctggagtccagtggtgcgatctcggctcactgtaacctctgcctcccaggttcaagcgattcttctccctcagcctcctgagtagctgggactacaggcgcccgccaccacgcctggctaattttttgtagttttagtagagaggtttcaccatgctagccaggatggtctcgatctcctgaccttgtgatccacctgcctaggcctaccaaagtgctgggattacaggtgtgagccagcacgcctggcctctcagccctttttctaattccaagggagaagggaggctacctgagattctacagtagtgcctggaccccaaaccttaaaagcagaggtcagctcacacctgtttctagaaacagcttttgtgtcccctgccccataggttcctgtagtggctttgggcagcatttggaaccactggccagataagatcccttaatgatgtgaaatactgcataaggtcgaagttccaactttaacatatctgggctaaatttttaaaactattcaacaattcatgaagataattaaagaacatgtgaaagtctgagaaggagagccaacactcatcattctccactcttaacacaatcatttttattccagtgcctttcattccaggctaatccatatggatacagatttttatatagttgtttcattgtgtacataaaactttgtctcctgctttttcatttaacgtaagcattttgcatgtggctctgtgatctttataattttaatgggcgcatagtattctttgaaggggctgttaacagaaattaacgttgtattggtgaatgttctaagtttcttctgttttttctcttataaataatgctgcagtatttgtgcataagatttattccttattttaggttagttcactgggataaatttacagaagtgagatttcttggcttaaagattttcagtcgctttctagttcttgatgttggatgccaagccaagttgctttccgataaggtttaatttacactgtgtccttttgcttttaaaataaggtagtgagacatctgcagcctggttgtgatgccaagtattgagatagtatggagaatgtcccagctgttgaaggcagagaatggacttacaaataagtggcgccagaggtaggggatctcacagcttgtccctgggtggcactggtcaacctgtcccagggcagcactcgagagggagggaggccctcggagtagccagagcccctggagagggctgatagatgccccacagggctggaggtttctgtatggagtcctgctgtaggtcactcatattaggcatgatgtgaatgtgctccactcagctactgtgatctgattgaaataaccttttaagaaaagagcttgcaactgtggaaagaccactgttttggatcaggttgacatggagtctgggctttgatgggactgtatgaaccgccttaacccctgtgtttacctgtctttaaagtggtctaataagccatgacagtgtcctctgcacaaatcctttgtgaaagaacaatttgtaattaataaaaaaaaaaagaccttttgaaaaaaatagattaagacaatccttatagggttttggggtaatagtcacacagctaatagctgctgaaccttgagcaaagaaaatgttaatgagaaaatgtacattttaaatgaataaaaagaaacatacagtccctatgtatttcttgtttgttaggaactttttcaggcactcctccccgcagcgtcactcatgagtttctttttcttgggtgcagatagcacacattttgcatggtgtgcctcacacggtgtttctcatctctagctactttcaccatctttctaaatatcccacgtgggtcatatcattttaccaactttgaaaggatttgtcaggcctttttcaaatgcctgctttatcagtcctgaggctgcacagccttggccttgccatggagagatggcagcaggacagtggactccggggattcagtgagcacgcggacatgtcttgtctctgccttcttgctgtgaccagtgggtgtgatgtgctggtctctgccatctgctgtctcccagggcagcttgggaaagcctctcctttcccccaacttccttgctttcttcccttttcccaaaatccagatctaattctaatggtacccaaagagaagtcaactgaagtttgaggtttctccctttgaagataaggggtaattgctgtacagagaacctcagaatgggggagaattgctgtagtgggggagtcatgaggagtaaaagagagaacatgctagtgctaggcctggggtggatgttgaataaacattagtccctctcactcacacttgggttggctgtacctgggctgtactgccaagaatttccaactctgtaatgatttgtgatgagataagtcaggggagaagcttaattacaaattttccatttcgtttgtaaccctcagccctcttggggctctttgcatatcattctgagactcttttttttttttcttggagatgctcttcaaaacagagtcaagtgttttatttttttggtggtggggggtgacagagggtctcttactctgttgcccaggctggagtgcgatgatgcgatcctggctcactgcagcctcaaactcctgggctcaggtgattctcctgcctcagcctcccaagtagctgggactacagctgtgcatccccacacctggctaatttttaaaattttttgtagaagcagggtctcaccacgttgcccaggctggtcttgagctcctgggctcaagttgtcctcccaccttggcctcccaaagtgctaggattacagtcgtgagccaccactcccagcatggagccagttctgactcagtggttacagagcaggcctaggaaggaaccagttgtatggaagttaggccctcatgggaaggatttaaccaggtggtcatgggagatggtggcacctactggtgacaaggagcattgcactttagttctgtgagacctgcttgtgggctgaggtgaagtggggaggaaagcagccttgcggggatattgacatggaggtcagggaactgccgagcgtggaggagcgccgtggtgatgggaggaaggggcggtggagcagcacgggtgtgaaatgtgcagggctgcagcctggccggctgacgaggctgcctcctgctggcctccctgcggctgctccactgtggcccttgggccccgctcatcaccaagtgctgcctgagggcttcacctctctcctcccacctttttttcttacctattggcaatgattatttttaaatttttaaaatgcaattgatttttacataaatcacatgggaaataattttctaaaataccccccccttttttttgtaaagagacattttctagtccagtgtgcagaaattcttcatttttctaaagtaaaagaacctgcttcagctgtggttgggaaacccagaacaagaagtgagctgcagttgagagagggctttgtgtgccaccccctgactggggaggcggtggactcggagcaagtgttagaaaatggagccataaaagactccttaaagtgtcgggcgctcagctaacttagggctagaattatatatcatctcttaaaggacctgctgttcttgccttcaggaatgggaagttatcaccaggagctaagagctgacctgcttcataaactcttacttagacctaggaatgaggaaaagctgcatgcgagtggcatcccttgtgctcgctttctctgggctaaaacgtttaggatggtctggcagctcttgaagagaggatggtggcgtggaatagattcctctgaggccttgcccctcctgtccccggagctgagctgattattctcattggaagattggctttcgagcatttatcaagagatttgtacctgagttttcttgaacgaagagggaggcaagagggcttaaaatttccattaaaaatgaacaggcacccaggaaatacatgattgacggatgttggcccaggagttttcagtgtagttgctttccctttaggtaaataggattatgcgcacatttttgtaattttttacaattttatttttttctagaacagttttagacttacagaaacatggggaacattgtgcagaaagttcctatatatatcataccaagtttccctgttattaaaatcttacatcagtatgattcatttattgtaaagaaccagtattgatatgttattaactaaagttctctctttattcagattttttacaacatccccttgtgttctttttctgttttaatatgttatccagaataccacattccagttagtgattatgtcttcttactgtgacatttttttagactttccttttttgttatgaccttgacggttttgaggaggcttggtcagggattttttagaatattcctcgtctggggtttgtttgatgttttttctcatgattagatgagagttatgggtttgggagaggaagaccacagaagtaaaatatgcataaatttgtaaacaagttgttgaatgagttaattatggagaggaagggaagtttagtacccctgaatagtaactggaagaggagtaaaggctggacccccagattggaagaaggcaagtttaatgttcttaatgatgggacttaatgtctaacttgtgtcatgccttatagttcaaaggggatgggatagagtggttcttacattttcatgttatatcttgggaaactgaggctcagagaagcagcctgagttgcctaaggtcatagagatagaccaggatttactggatatgccagtgcatttgcaaactattcctagttgcattttctatgcccagaggttctagactcaactggctgggtcaccgatggccatttcatctgtgcgtagctatagggatttaaataggaggatttttgttaaatgaagacaattgaccaactgtgcgtggaatcaatgtgcaggatgattcaccaggctttctgcctgttagagaagttaaatggttgagaattaataattatgcgattgtagttcacgacttcagcacaagtcattgttacagttctcaaatgttgagcagccccacgttattccccaccagcgtgtttttctctgaggttacacagtaaaataagtgaagtgctgacctttatcataacatattttttatttgtgagcaagtggagtatgtataaagcagtttgtgactttgaatccaaaatagaaatttgccctcctctcattttcgcagcattgagtttcataaactaagttggagcagtgaaagtgaaactggaaatgcatggatgaagccagtggttctgaacactgagaactgcctgggagcttctagaaaaacccccaaggctgggtcccattccctaaagttgtaattatattggccagggcaggaacaggccttgggaaatccaaaacttggcctttctgtcttgttcctcactctgtactctacccaggtcttcattcttaaacctttcatatcttttgattcttgcctaagtagaggttttgggagctgttgggctggagctttcaaagcttgcagtaggctgatcttacttctctacctatattttacctgttctccctaggtgatgaaactaggagggcccatggctacttctgctacatggggcacaaaacatgcttcagaaatatttgagagactgaatgaagcctgtctctggtctctagggtatattacgttccctttctattctaatgatgagtaggaggaaagataccactctttcttgtaaaccaaactgttcttgctttcaatggggatttttattaagaagcaaaaactgatctcttttataaatgcatagataccagtgttttacacagtacaggcttctggttttaagagaacttttgccatggttcagagtgatcttactagcctagtatattggtttgttttacattgctataaaggaatacctgagactgggtaatttagaaagaaaaaaggtttatttggctcacggttctgtaggctgtacaagaaacatggcaacagaatctgcttctggtgaggacttcaggaaacttttcatcatggtagaaggtgaaggggagcaggtgtgtcacatggcaagagagtgagcaagagagagaggggaggaggtgccaggttcttttaaacaatcaaatctgtgtgaactctttcctttaccatggggagagcacaaagccatgcatgagggatccacccccatgacgcaaacacccccaccaggcctcacctccaacattggggatcacatttcaacatcagatttggaggagacagctatccagatgaaatcacctagttaactctggtgttcttttttcaggaccctttcccagtgagttaaaattaaatttgtgagtttattaataggtcacacagcctatttggaaagtaagtttttttgccttcttgtgagaagacctgaagattattcctctacactaccctggtggaacgccaaccttgaagaattagaaataagtccttctgcttctcccatgggtcactttatagggaaaatgcttgatcaggggaggtcttggtctttagcgggaaactaagtctactctgtaaaaatttgctttcgagtgaacagtattttagttagtttgtaatgtcttagctttgcagcttagcttagtcttaccttttgagaaatgggctgtgaaatataaattattacatcatttaaaaatttctggcaacctgtttttttccccaaaacttgagggttgctgtgtggattggctgtagtggtaattactgaaaagtcatcaaataacagtgaaaactagacaactgatgagaagggaatcaagtagtcattcagatggtattttcggtaatttaatctgcctctgaccatatgttctagtcagctgaaataatttaacagtgacaacatatatttcagcaagcagagattaaaaacagcccatttattttctgttttctcccgcagtaatatttttatgtctccgttaacaaatatgatgttcgccatttaaattatatggaagcagctttggatgatttagcaatatacataacatttattctttgttattatctagttttatgtatgtaagcatgtttattttagtggtgtttcataattcaaaaatgttaccagaggtggtaattgtatttatattggacatgggtaagacatcagcgtgagatgaagccacatttttgctgcttttgtgactcaattcttgggcttccaacacctcacagcccctgccccccacccctgtcccacacaaatgactggctgggtgcagcagtctctgccactagcaagccttatggcattgataaatgtagtggttttagaatattctaaatattaaccaattttttttattatcctcctctcaaaactggaggctagtctcagctccaccaaacccgatttcacgtgagctggacatggtgacatggttcattatttcttatgaacagactgtgacagggcaacagtgagtgatttccaagactaggccataaaaggcatcaccgtgtttcccttgctcttgtatgtgccctcttcctcatattcactggggaagccagccgcctcttgggaggacacttaagcagccctactggatgggccccagtgaggaactggggcctcctggccacgtgagttacccatcttggaagcagaccccagccctaggcaaaccttcagagaacagcagccctggccgaaatctttgcagccccattagaaatcgtgggccagaaccattcagattcctgaccctcagacactgtgtgaggtaataaacatttattgttttaagctactgagttttgcagcagttgataagtcaggtagcccttctggatcctttttgccaatcctctgggaaacgaatggttggactgcacagtgccctgcacgcatagattcgatcaatagtgcctaaggggcttgctcatcttccagccactgtacctcctcatccccacggcgcctttcctcctccactcccctgaccacttgcctttggcaactgagccaagaacacttcttatttttttcttatttggatcagagacagattatactgggaatattctattaacaacgaaacctatatttacacttaattagtttccataactatttaataaactcacctattgggtttactgcttctgaaaatagtgtcatagtatttagatgtcattgctattttatgtacttagagataggatgaatttgagctgctgtgctctctgattatggcaggtaagtagacgtcgctcagccatggattcccgtctgattacactcatggccctggtttaattccatttgtgcctctgttgtgtgcatttgtaagaacaatttgggagatacatattttgaggttttaggatacataattttgaaccagattaaaatgtctaataacaataatcactaccatctggggtaagttagtaagtaggagaagacttagagttctctttctctggcccagatgccatttacaaagggagcgaagaccacagcgctgtactttagggcatctaggtctttccagaggctgcgtgtggatgcatccaatactctagaccaaggggtgatgccaggcagggcagcagcgttctcctgtcccatgtttctcatttggttggcagggcatcctagacctctggttaaacttccctgatggaatgcagtatttggtcagagctgctgagccctcccttgtctacactttcctgaagcaccatctgtctgtggggtaatcattctgcattcactgtcaacatccctcctttgagggtggtggaaacaaagcagagatgggtctgcatcctgggaaatcaaagcgggcttacaagatcacaggctttgaattctctgcaacttttgacccagcataaaccacatcatgacttgtctaatctcagtagtttatacttgtcactaaaaagaggacctgtctgtcactgcatcagtttccccttaaaagggagaaaacacacagatctgttggtagcacagccaggataccagtggctactgggcgcaagagccttcttcatacatttgcattcagtacatttccatttttgagcggcactgatgctagtgtaaataagtcttataatgtatgtaaatgtatgggagggggattgtaacgaaaaacttccactgcagagtaggcgaagccagtacaatcaatctgagtaagtagggcgaggatttttttttttcagctgcatttattattgagcaactattgtaaggccaccagcgcacttggtaccataaggatacagaaggaatatgacagctttccttaccctcaaagaacctgaaatctttttggatatcaaacatgggcgaagcaggtagcaaatgtaaaagacccccaagtgctaactgaatgtatcacctacacaagaacactgggcaggcagggacccgctgtgcaagaggcattgagcccagcctcctaatcttagagaagttagactccaacacccactgccattggcagaggcgtggctggaacccaaggctctggctccgaggccagtgctgctccccacgtgtcatgcggggtctcctcctttcctacttgtccctgcagcattggcctctcctctcccctgcactgacacctcaccttccctgagtggtctccctcctgctcaccagtagctttaattacccggggccttttcacaaccccagatttgtgcctccatctgtttgcagatgcctcctcttggtatctcacagtagcttcatcatttccaaaccaaactcctctatatttcctagcactgcttcttaccctccccagcaactgtcttgcatttcttctcggtggacatcacacctgtgtaggaagtgctgcagtcagaaacctggggccgtctttgattcttcttccccttcgcactcctcctgctgcattgccagcccctcctagctgcacctgtctccgctctgtccctccgggacctggactgggtccagcatgccatcttcccattgctgcattactgaaatggcctcctgggctctcttgtgccctctagtctgcccccaccttatagccatagtgatatttctagaatacaggtctcagactatcctgccgcttccgtgccctcctgtttttgatctttcccttgttccatctgtctggtacacccaccaccgctagtccccattgttccttcttgcctcccttaggtctccaccgaggtaccacttccgtgtacagccttcctgggggccctgttctacgcggggcctgtgcctctgggccgttgttccccacgcttgtctgtgggtgtctttgcacagcacaggccaagatgcctggcccctgctgtgtctctaggagctgactttcttaataccaggccaaggccttcggtaggggtggagagaagagagtgggacaagacaagcatctacagaccagtggtgggttgagtgtgggtgctccatcagccagtgaacctagtcagccatctttgtaggaatttatttctagtgaccagacatattctgagatgaatggttagtacaatgtcttaattgaactttggctatttagttgagggagggaggaagctatcttatctagaggcagtacagctaaatgactgagaccataaactccagccctgagctccccagggtgtggatccagcctcatacgaacactaaatgttcagtgccttggcttcctcacctgtaaaattggaatagtaatagcattgcaggaagatgagcatatgtgcagtgtccagagtggggcttggcacctcgtaaatactgtgttaggcagcagtcaccatggtggttcctccttttcattgtcctcccctccttcccctcctctctgcctcctcccctcctcgtcccctcctcgtcctcctcctcgtcccctcctcgtcctcctcctccccctccctctcccctcctcctcctttccctctccccctcctcctcctcactgtcctccccctccttctccttgggggctcctcttccccttccccatttttactgtaggagcaggtatttaagatgataatctgcaggttttggcctgggagtccagaacaaaacagtcctatgtgagtgacctcctagaaatgtattcttgggtttttatgacattttgagaatcaggctcttataatttagtttaaatcgagccctagcctgtcattcccactctgacttacataaagggccagatttagctttttaccagctgcgtaacctggacaaattgcttagcctatcttatgtgtcctcattgtaagacaggaattataaaatgcaggaatgagagagggtcaatgcacaatgcttggcgcatagtaggtattcgtaaatggcagggcttgttccatctgcttggtaccttgtcatgccctaattatatgggcatgaactcaccctgcactagttttatagtaggcatcgttgattggaaggaagaagggaggttgaggagtgctcaccctgcactagttttatagtaggcatcattgattggaaggaagaagggagggtgaggagtgttacctgtgggcaaatcaatcttatttgtgggcacaaaaaaaaagtttattttctgggaaaacactgatggttgacctgcaaatgtcagataatgactacagatgatgactttatttttacatgtagaaaatatgctagagtcaccagccccactggcagtgttcacttttgattttattcagctacaagtttaaatgatttgatccattagctggtgtacatagaaggccagatgctggggtgggggttgagaggtgggaattatcagccacaatgctacaatcaagcctcaaaataaaaattaatgcgtaattaaaagtctgcagagtgtgactgtggtaatttcattacttgctgatttcgtattcacatgtatctccttactttgtaaagccagttggtgggttaaattctctcaccgttgcctatctgccagggttcccgcaaaatcagtgccagtagtaaattgaaagtttctttatagccaagtaatctcaaaagccaagttataaatatatcttttcaaaacttttttgcagtaaaaattatttaaattgggatacagctgcattctaatacatttgttgcagcgtggggtaagacttgcaaaagtacatggggcacttaaaggccaggaaggtgttctgctgggtgggtggggcttggacccccggctgcagaatggtttctctcaccagcccgccaaggctacagttcctcccttcctgccattttcacggcagccctgatgtgataaacccagctgtatcgcctcattagagaagcaacggaagcaaaagctagccaagagatgggggagtcttaggcacagtttctgtctaattaccgcacctcttgagtaaaaatgcagattattggcaaagcaagttgcatttggaaaaaatgtgtcatttggcccaggccctgaggtttacccttctgcagatctcactttacgttttaagtaaagaaccaaaacgtctccagtggtgaacgtgcgtgcagcacacagtccgcactggtccagaggagtgctggtggaataaacccggggagagctgggttccccgccccgcagggagggattactgttgcgtatccgcctaatcgcatctgctcaggaaaatggccagctgacaatgcttggctcacaggagtctggtgggaaaattactagccatggcttatttctgatttgggttatatacagaaacctttcttattttagtcacagaaatcagattcccagtggtggaaaatatatatttagctctgtggtcgtgcagttgttatttagtctgatttaatgttgataaattagagtaaattgtttgcccagatgagttgaataaattctgccagagcttatatcttattctgttttcacattgagtccttaatatgtatctctgtttcattggcagtcctattagagtaagtcctagaaaaagcttggtggccctaccccctgctcctgtgttagtcagtggaattaaatcatttaacactctctgaggggagctcaaaggagcccttagggagaatctggtcctaagatgtccataaaccacctaagatgtctggagagctaccttcattttaatggctttaatttaaccactctagaattatttcatttaatccactttccctatctcgcttccccaccctcacaaatccccaaagccctgggagtttttggagtatttccttcccacagataagcaatacaaatataaaatgaagagagaaatgcaaacccttgggaaaggtcatgcccatacttttctccccttgcatcttgactccctaacaatttctggtgtgtggggtctttaagatgtgccctccctcctgctcatcagtgcatccccagggccaagtgttaactctcctaagactcggtatgtattgaactgatgaatgaaggtgtgcttgaagaacaagtcaactcattcagtgtctttgttcccctaggaggactggaatgaaattgaccccattaaaaagaaagaccttcatcacagcaatggagaagagaaagcacaaagcatggagaccctccctccaggtactgccaggggccaggaagccatcttgctttgagcacgtgattgggagtggactgagcatggctcttggagcaggtggtctgtggggagaggctggattccataggtcagcaggagacaccgccctaaagcactgctttgccaacttccatcggacccattagtgggtggtcaagttaaaacttttataggaggtgaccaaaatgtgttgaaaagaaaataaaaatagactaaagtagaaagtatatattagtatatattagttcatgaaatatttttaatagactttattttttagggcagttttagcttcagaacaaaactgaggggaaggtacagagaattcctgtatacctcctgcacccccacccccaacacacatacaacctcctccattgtcagtatcccccaacagagtggtacatttgttacaatccatgaacctgcattgacacgtcatcatcacccgaagtctgtagttgacattagggttcactctcgatgttacacattctgtgggtttggacaaatgcataatggcgtttagccgccattgtagtatcatacagagtcgtttcactgccttaagagtcctccgtgctctgcccattcatcctttgctccccccagcccctggcaaccagcgatccttttgttgcctctgaagttttgcttttctagaatgtcaggcagttggaatcatagggtatgtcagcttttcagattagcttctttcactgagtaatatatatttaatatatatttattttaatatattaatatttaatatatatttaaggttcctccatgtcttttcatggctggatagctcatttcttaatgaattaacattccattgtctgggtgtattagtttgtttattcacctagtgaaggacatcttggttgcttccaagttttggcaattatgattaaagctactataaatatctatgtaccagttttcgtgtagacataagttttcagctcatttgggtaaataccaaagggtatgattgctggatcatatggtaagagtatgctgagttttgtaagaaactgctaagttgttttccaaagtggctgttccattttccattcccaccacagtgagtgagggttcctgtttctctacatcctcaccagcatttggtgttgccagtgttctggatttaggccactctaataggtgtggagtagtatttcacttttgtttttatttccaattctctaatgacatatgatgttgagcatcttttcataggcttatttgccatctgtatattttcttttctgaggtgttcactccttttgcgcatttttaatccagtggttcattttcttattgttgagttttaagagtctgtatacatttaggataatcgtcctttatcagatatgggttttgtaaatgtttctcctagtctgtggcctgtcttctcattgtcttgatagtgtcctagaagattttaattgattaaaatctggcttatcaattatttccttcattgtcacgcctttggtgttttctctaaaaagtcttcaccatgacaaaaaggtcacctagattttcttctatgttatcttctatgagttttatactttggtgtatttacttatttatttgagacagagtctcactctgttgcccaagctggagtgcagtggtgaaatctcagctcattgcaacctccacctcccaggttcaagcgattctcctgtttaagcctcccagtagctgggattacaggcatctgccaccaagcccagctaatttttgtatttttagtagagacagcgttttgccatgttggccaggctggtctcaaactcctgacctcaggtgatccgcccgcctcggcctcccaaagtgctggaattacagcgggagccaccacgcctggcctactttggtgttttacatttaggtctgtgattcatttggagttaattttgtgaaaagtgtaagagctgtgtctaggttcttttttttttttttttttttttttttggcatgtgagtgtccaggtcttccagaaacatttgctgaagagactctcttctctccgctttattgcctttgctcctttgtcagagatcagttggcaatattcgtatggttctatattggagctctttatttgcttccattggtctatttttctgttattttgccactaccacactgccttgattaccatgacttcatgtaaagtcttgaagccgagtagtgttagtcacctttgttttctttcaaggtagttttagctattccagatcttttgctgttccatataaatttgtaaattttagaatcagtttgttaatatccacaaaacaacttgctgggattttggctctaattgcattgaatctatagatcaagttgagattaactgacattttgaccatattgtcttactccccatgaatgtcaaatattttttcatttaattcttttgataccttttatcagaattttgtagttttcctcatacagaatttatacatattttgtcagatttgtacctaagtttttcattttgggagtttctaatgtaaatggtcttgtgattttcacttcacattccactcctttgttactggtatataggaaagcagttgacttttgtatattgacctcacatcttgtaaccttgctgtaattgtttattagtcctaggaaatttttgttcattgtttcaggttttctgcacagacaatcatgtgatctatgaacaaataggattttatttattttcttccaatctttatacttttttttttgtcttatttcattagctaggacttccagcacagtgttgaagaagagtggtgaggggtcatctttgccttgttcctgatcttagtgggaaagtttccagtttttcaccattaagtatgatgttagctgcaggatttttgtaggtattctatatcaagttgaggaagttctcatacattcctagtttgagaatttgtaacatgaatgggtgttggattttgtcaagtggtttttttgcatctattgatatgatcatgtgatttttcttgcttagctagtggacatgatggattacgttaatgggttttcatttgttgagccactgttgcataactggcataaatcctacttgatcatggtgtataattctctttatacattgttgaatttgatttgctttattttgttgagaattcctgcatatggtcatatgagagctattaatcagtacctttcgtttcctttttttttttttagagacagggtttcaccatgttggccaggctgatcttgaactcctgaccccaggtgatctgcctgcctcagccctcccaaagcgctgggattacaggcgtgagccagcacacccagccatacctttcttttcttaaatgtctttgtctggtttttggtattagggtaatgctggcctcatagaatgagttaggaagtatttcttctgcttctgtcttctggaagagattgtagagaattggtataatttctttctttaaatgtgggtcagaattcatcagtgaacacacctaggccaggtgctttctgtttgggaagattattaattattgattcaatttctttaatagatatgaccagttcaaattgtctatttcttcttatgtgaattttggcagagtatgtctttggaggaattggtccatttaatccagcttattgaatttatgggaatagagttgttcatactattccgtattgtccttttcatatccatgggatctgtagttatatccccactttcatttctgatattggtaaaatgtgccttttttccttttcacttagtctggttagagattcattgattttattgatattttgagagaaccagtttttgtttttgtttttttctgtattgattttctgttttcaattttattgatttctgtaataatttttagtatgtcttctacttactttggatttaactttctcctttttctagttttttcaagtagaatcttagatgattgcttttagatctttcttattttctaatgtatgcactcagtactataaatttctttggaagcactgcttttgctgcatctcacaaattttcataagttttgttttcatttttatttactttggaaatttaaaatcattttttcttgagatttcttctttgacccctgtgtcatttagaagtgcgttgtttagtctccatgtactttgggatttcccagctagctatctttctgttattgaatctagtttaattgtattgtgttctgagagcacacagtctgatttctgttcttttcaatttgttaaggtatgctttgtggcccagaatgtggcctcttttggtgaatgttccatgtgagtttgagaagaatgtgtactctgctgtttttgactgaattagtctatagatatcaattatatctagttgattgatggtgttgttgagttcaactctgtccttattgagcttcctcttgcaggatctgcccatttttgacagaggactattgaggtctcaaactataacagtgagttcatttatttctccttgcagttctatctatcatgaactgcatggacatttttatgcctcatgcatttttatgctccttttaggcacatacacattaaggattgttgtatctttttggaaaacagacttttaaaaaatcattgtgtagttctgtcttgatcccttaaaaattcctatgatctaaagtctacattgtcagaaattaatatagctattcttactttcttttgattagtgttagcatgatagatctaacttttcttggtaaaggccattctttatcattttacttttaatctatgtgtgttgttttatttatagtggatttgttgtagacaacatataattgggacttatttttcgattctcacaatcttggtattttctttggtgtatttagaccatcgatgtacacagtgattgttgatatatttaaattcatatttactatatttgttattgttttttatttattgcccttattctgtgtttgtacttttacctttcacactttttctgccttttgtcgttttaattgagctttctgtatgatcccattttctctctcttctcagcatatctattatgtgtcttaaaaaaaaattagttggtcttctttcagataacactatactttttcacaggtagtgcacgtatcttataacaacaaagtattcttgattcctccctcccatcacttatatcattgctgtcattcattttacatccacataagcatatgtatataatatataaaagaatacatgatggaatatattgttgctattattatttcaaacaacccattatatgatagttcaattaagaataagaaaaataggcgaggagcagtggctcatgcctgtaatcccagcactttgggaggccgaggcaggcagatcacctgaagtcaggagttcaagaccagcctggccaacatggtgaaaccctgtctctacaaaaaatacaaaaattagccaggtgtggtggtgcgtgcctgtaattccagccacctgggaggctgaggcaggagaatcgctggaacctgggaggcggaggctgcagtgagccgagatcgtaccactattctgagcctgggtgacagagcaagactacaactcaaaaaaaaaaaaggaaaagtttttattttaccttcacttattccttctttgatgcatcctttcttcatgtagatccaggtttctgatcgatgttattttcttatgttaaaagagctgcttttaacattttttgcaaggcaggtctactggcaacaaattccctcaacttgtgtttgaggaagtctctatcccttcttcatctttgaagatcaatctttttttttttttttgcgacagagtctcgctctattacccaggctagagtgcagtggtgctatctcagctcactgcaagctctgccttctaggttcatgccattctcctgcctcagcctcccgagtagctgggactacaggcgcccaaccacacccagctaatttttttgtatttttttagtagagatggggtttcaccacattaggcaggatggtctcgatctcctgacctcgtgatccacccaccttggcctctcagagtgctgggattacaggcgtgagccaccgcgcctggcctgaagatcaatcttaaatggtacagaattctaggtggtcattttttttttctctgagccctttaaatatttccctctcctctcttctttcctgcatggtttctgagaagacattagttataatccttctctttgctcctctattgataggtaaggtgtttctttcaattttttttctttatctttgattttctgcaatttgaatatgatatgcctcagtgtagtttttggagcctttatactattctgtgtgttctctaagtttccttaatttgcgttttggtgttcaacattaatttggggaaattcttagtcattattgcttccagtatttctcctgttcctttctctctttcttctccttccgatattcccatcatgcatatttacaccactgtaattgttccacagttcttggatattatttcaatttttttcatcttttttgtctttgcatttgagttttagaagtttctaatgtcatgtcctaaagtttagagatttttttcctcagcatgtcatgtctgctaatgagcccattaaagacattcctcattctctacagtgtttttgatctctagcatttccttttgattctttctcataatttccatttcgctgcttacattatctgtctgttcttgtgtgttacctactttttccattagagtccctagcatattaattatagttgttttaaattcctgatctgatcattccaacattgttctatatctgagtctggttctgatacttgctgtgtctctttaaactgtgcgtgcgtgcgtgtgtgtgtgtgtgtgtgtgtgtgtgtgcgcgcgtgtgtgtgtgtgtttaacctcttagtgtgccttgtaattttatgttgaaagctggatgtgatggacttggtgcacggaaccctggtaaacaggcctttagttgtgtggtgttaaggtgtagtgggaggggaagcttgctatagtcctatgatttggtctcattcttttagggaacctttgtgtctgggctgtgagcctcacatttgcttctcagcttccccctctccacatccttaggtgatactaaagtctagcagaggctggttatttcctgttcctcagattggacaggctctgataaatgctagcagtttagtccctgtttaaatagtttctcccgatggcaggccttattaataagaacacagtgccctggcttctttcaaaatggttattttcccctctcactgttgtaagcatgaggggatatttcttcaatattcactgtgaggatctggtagagctccaggaggtaaaactcacacaaatatagctgccacacccccatgactgggtccccctggagtttttaatctcttaggcttgtccacagtgagcctccaggaattttccactacagtttaggttttcctacccccgtagtggatcttcaggggtttctacttacaggcttctgctccagtgaattgtgattccttgtattcacctgtccaatttggggggctgtggcttgtgacatttctccaacagatccaaggcagatctctaagaagtgctgatttttcattttattcagctttttactgttaggacggaataacgactttcaagctccttacatgcctattgggaactggacgtccgtttatgaagtgtttgctttgctggcaagagtgtttgctggtgagagtgtttgctggtgagagtgtttgcacgttgtgttcttgactgtggttggacaagcgtcaccccagggagtccaagcccctcctttgtgccctccccatgcgttgtcccacctacaccagatgcaggtatgtcactgtctcctccaggaactctgactggacgcatgcatgcagtcaatttgtgtgttaagtcggcctccctgtcatctttccagctcctggatgagtcatgaagccctgagccacagttctttcatatgtaaagtaaacattacccacacaatggggagcatctgaatagaatagttaatattcctttattataataataggaagctaggatacacacttctgttgtgtggattaatgagagacttcctatggattatcttctattaaaaacatacaagtgttctgatggttttcaggcaaatagagagagggagggaaaagccatcttcaggtcataggctggatttgaccattgagagtcataccttacttaaaatcatttgagtgctcacattgactctgcctttcatatccttaactattgcatacagttggttttcttatcttcaaagagatcagaatgtactgatttgcctctcttttgagttattagtagtaatttttgataaatgcacaatgtctttttattttgccaaagggctttctttcctttttatgttgaaaccatttttcttactaaaccaacatacacataatttttttgttgttagaaattattttcttgtgattgaaaaatacattttccctaagcatgaggaacacagctaaagttttatggtttgcaagaaaccgctggccatggcacttcccagtgtgtcagtggtgtgttcaggaagctcagtggcttcctgtgttctgtgtgttgggcatgtagcagttgtagacagatgggcgggaagacatgacaccaagctggatgcttttatggccacagaacccactgacagatgaaggagccagatctaacagggcagagcagtgatgttccaggccaacagtctccaattttctgatcgcacactctatgaacagacgtatatttagaccacctcccacacacatatgtattaaaatgcttacttaggaattacatgcatattgccgtacagatttattgatacattctaaatgaaatgggatagttcccttgaccccttcacaggactcagcccacagctctcagcccctcatgggaggagcagcatgcaggtgagtgggtgcaggggctggggtgagtgcttttgggcatcggcaggagtagaactctgtgcagccccccggcagcatctgggtggggctacctgtgacccctggagccctagagggcatatgttacagtgtgctcttagatttgctgtccacagatgacttaagtgttagctcagtgcaaggtcagtgtgacagccttttgcatccaccctcttggtacctgaattctcgtccggtgtccaggaagaatcaagttgtgcaaacaaattgaaggatggtgaatgtggaggactttattgagcactggaagtggctctcagtgggatgggaagctagaaagggggttaagtgggaagatggtcttcccctggagtcctgctgtccccagccaaactcttctccaaagtcctgctgtcaagctgtccctctgaaatcaagctgattctctccaacatccggctgtttcttctctccttctctattgctttgctggtagggcctggggtttttatgggtacaagatggagggtggggcgggccggggtggttttggaaaaggcaacattcgggcaggaaaacagaaatgcatgttctcactttgggccctacggttccaggcttgagggtgtggcgtttgctagggaccactctctcctacccagtatttccctgcctcctgtttgtatcataaagtgtatttaaaataagctattataaaggatgaggaaaatacttgacaatgtctgtcattttctttctttgccccagaagattgtcttatgtggccccactttggagactaccactcttggggctgccgtggtcacaaaaacccagattattgttttaactctatttcttgccttggttcatcgtactttggggaagaatctggaatttgtataaagtataccacccaagtggcagtcccagctggaagtcatggaatgggggcaagaacaataacctgggagcacgggatctgggttcggaacaaggatgatggccgggagctctaggctcagctgtgccaccagtcctgtggccttagacaagttaaggagtatttgggttttgttttccttgtctgtaaaatttagatacattcttgctctaaaactctttgattctgttaactgtgtcttaccatttccctttaatctctattctcagattggaatcaccaattttattttcttttacatgctgtaaaaatatatctctgtagttccccccaccctcataccacatttcaggtctactgtggatgagtttttgcccataaactctgtgacccttgcttctatttcagcatcatgctttctacttggaaccactgaattttttttttcagtgttggtttttaaaatattgtcttcaaatagagtatgtatattagtcaatattttgtattttggaaatctatctgatagagaagaatgtcattttttccccttggtgtggaaaaacttctggattgaaaaataagtttctccctgtaattgtctctgaatctgaccagccagccagctggcagaaggactggcaaaggagcgggggccggaagaggagcaggggccagtagaggagtggggccggaagaggagcaggggcagctgtaggggctagaaggccgaggtctgcctctgaggacagctgttgatgaggttcttgttggagatctctcaccctttggtcaacgtggccttttggagcagattttctctttgcctttatgagaccttagtgtcattcttgtattccttagtaaccttgtgtaaagggctgaggcttaggagagacgagggtagggagagagttcagaaaggagagtcctaaggccgtctggattctccttgagccccctccccatcctggtcctgggctgtgtcttcatcacagccacccctccccgatgtgctgttggttcagttaccccagacagtggatttctcagaacagaaattgctaatgttcacgtaaagatgaatgaaatgggaatgatgaaatgtgttaagagaacttaaatccagggtgtgaattgccactgatcctaacagagacgttttagcttttctacttcccacctgccggaagaaagatgagataaaccacttgtgttatttgttcagcattgctgcagcatcagagaggagtgttccccgaccctttgtttttctaggtgacttaatgggttctggcattgtgcatttatctttttaattgtggtaaaagatgcgtaacactaaagttgccattttaagcgttgttaagcatacaggtccgtggcattaagcgcattcacagtgttgtgcagtcatcaccaccatcaattagagctgttttcatcttgcaaaatggaaactgtacccatgtagtaccaatgtcccattcctccctctcccaggccctggtattcctgtttctatgaatttggttcctctgggtccctcatatgagtgcagccttacagtacttgtcctttatttctggcttgttcacttagcataactcctccaggttcacccatgttgtgggtcagaattcccttcctgtgtctctgtgaaccatgtgccctgtgatacatgtcgtgtgaggtggaaccgtgtgacacttgtggggagcgaagtctacgtagttcttcatgagccaggcctgaggccagtgatctgcacagtgttgtcataaggaaaataagtggctgtcagtgtctttagggaagcatcttttaaaaagcaagcaatgtgtgtattgtacgttttagaaattcagataagcaaaaataagaaaattatattcatacataattctaccatccagaaacaaccaccattcctctcccactgcgtgttcctccatacttgccctgggcgtatacccaggtgggtgtgctgcccccatagctgagacgaaggggtctcctctgcatgggatgcgccaagacccacgcacttgaagcctcaggccttgcacagtttcttagagttggctcctgggaccaaatgctcctgaagcatctggcctctctgacaacaggtcctgagttttatcccacattcaaagttcaatcttttcgtgaatttctatgaaaattcaggtcatccacaaggtgactagcatttcagtagatttgggggatttgctgagacgtctctccacacacgcccatctctctttcagagccccctctgggctctgactccctgatcgggggccaccctcctctctcttctctcctgaaacggggcctttttctatgggcagttccctaccatctgcttacagctagatttttacaaatacagcactgtggtgtaccatctctgcttgggcgatatatcgggaactccttttcacatccataaacatctcctatagcattttaatggcagcaacatctcgaccgccatcggctcattgaacttattttttgttgtgggacataaagaggggttccagccagtatcctgagaggtaaatctttgtttaagtccatgattattttcttgaaatgaattcctaaaagtgaaattgcagggtcaatggcaatgcatgcattttttaatattagttgccattttatcttccacagggggcctattttcttactctagccaacattaaaaaatcttcattgtccttctcctgttccaacaagcaagaaagtggagaccaagggctgagatcagtagccagaaatgtaatggagctgtttaaaaatagttatcttaagctttattagtcgaaatacagtgtctagaagcagtcacgtgacatccagtgttctctgggctcccaccccatagctgaagtgtttagttctcttcagagcacagagtgttcagggatgctgataaactagagttagtccggctgacagtgactcagattttgaggaagcggaagcagtgtccgatgaggaacatgtgcagtaactgtggatgtttttacagaagggcttccaaggggaagtgggatcatgatgtctgaatatttgaaaggctaccatataaaagaggctgaagactttttttctctttttatttgagacttctgtttcttttatttgagcagaaattagagggaagcatttttttgtttctgttgttgttttgagacagggtctcaccaacccaggttggagtgcagtagtgcaatcatagctcactgcagcctcaaagtcctgggcttaagcagtcctcctgcttcagcctcccacacagctaggactacgggtatgtgccactgtgccagacacatttttaaaattttttgcagagacagcatctcgctatgttccccaggctgatctcaaactcctgagcccaagtgatccctattccttggcctcccaaagtgctgggatcataggcgtgagccaccgtgcccattcaggaagcagcgtttgtttttatctgaggaagcccccaccaacagttctcgctgtccagtgaaacagctgccttttgaaacggggggctccccatgctcagcacctcttcagctgtggctggacattagggactgtaatggaaagattttcacacctggagagatgatgtccacagttccttctgagtccaacaacaggtgatgccagtgtttcagagacaggaacacctgctctcaaagtcagagactcagtcactccagggtggagacaggactggcactgccacctgaaagggggctgggcagctgagaactgcacaggcatgcagggttgctttttggtgtttcgcttcaattttccccacttaaaagtgagttgtcgggtgcagtggagggaacacagactgggcataattaggacctgggtttgagttgtggttccatcgtcttacagctgtgatatgttggataagtttaacttctgtgccttagtttcctaacttgtaaagcagaaaccctcatatttgacatggttatggtatggtgtggacaaggtcttgtatgaagtagcagaccaagtagtcactggttaacagatgctgtctttctctccttctgtctttttcatctgttggctgggattctgggcagtagattcactttgatattattactgatatttaggatgaaaaagaagattggtcaagaccatgtacaataggctaaatttattatggttaggtagtacaacatataacgaaaaatgaagaattttcatttcaaatttgaagaagagatataggatgattcatacatgaagatttattgcactttatcaatttgatactgttttgtggtatatttttagttgttttgatagcacagataattttaaacaaatgaaaactatttcctctataacatctgatattttcttaggttttcttttaaatagctttttatcacttctttggatttcctggtttttttgtccttaatcatggatgtgtgggattccctatttcaagagacggtttctcacaggtgaagaaaatttcctgtgataccacatatccagtgacaaataataaaacataatttatgggcctttgtaattgaaatggatctatttgtttgtaatcctggccttgtcctcgtcttttctttcatggtgtagcattatgaccttctagaggaagaatattaggattttttttcttttaagcacagtaaaattacattcaatttgagatcaaccaaataaatctgagagccttgtcctttgatattaaatacattctgtttcccttccttggctgctttcccagcggttgctctgttttacgtggggtagctttagatttgtttaagctgtctttcctggggaggatttgaatgaagagttgcagtacagcagtgaatacctgtatagaatcctgaagcctcctgcagcctgaatccactgagactctcagtttcctgcacaacgggacctgcatccaggaagatacctcccctccccttgtacacctgcgggtggtagatgacagctctttgcccaagagcatatgtcctgatctgctgctgaaggacagtcgcaactgagagtcctctaaagaccgcatttgtgcatgtgcctgtgcgtgagcctctgtgtgctggggtttgcatgcgcctctctgtgctggggtgtgcgtgcgcctctgtgtgctggggtcttcatgtgctttgtgatgttaattctttgaagggtcagttttataggtttctgtcatcttttttttttcaaatataaggtttagtaaaaacaaaaattttaagaaagaagtggcattgtttggaaaggtagcattattttaaaccaacatttatttgaacaagtcatccaaatgcaagtagtcccctgatgacaaaagcgtctttttcaaaaagttcacttgaagattggttattaggatcccagaatgaactgtcccatggaaatggtgtcctgagtggcacttaggagcgctgtctggctgtgtctctggctgcagccaggtcctagagtgtcagccacagagctgatgctggcggggccccgagcagccttcccggggcctcagtgcctatgctcagcctccactcccaggcaccatggaccgttacagtcgccagccactctctgctcaagggacactgtcctgctctccagcctcgataagatggggagaaaagttcccaaaactaaaccaggaaaaaacagattctgaaaaggtagctataactcagagcctggtggatgggttacgggagggagaagaaattctgtacccaaggaagtagcaaagcacaaaaccttgtgccctgaatgatagcgggtgtgatgaagagtatcagtggggaggcatgccgactaagtcaaagatggggaagagaaaaaagaaaaagttgctgggcctgaagtctgtgtaacccagggagcagtggccgggtagtggctagtcaggacagtgggcagggatgcgtcctgcagaatggaccggcagacagaagtggtgggaagttcacctcccacaccagccttagggcccccttctcctgcaggggtccagagccaggacttgtcaggccaccgtaggtctgctctgtctctccaggtcctggcccttctctcccagaggcagaagaattaacctgggcccatcccctctctgactgtacacattgtttttcatggctacagggataagaagggaaggccttagggccatcagtccaaaggtaatggacaaggaatctcccttcctcttgcggttagcccagcccttcaaatggactggcctccatttgccatcagacatcagatgcagctgcgaggtggccaggaggggagggacactctccccacagtgccacaggcctctgggaacagtgtcagaacaagttgcaggaacgcctgtagggcttagcaggatgttcattttcattactgaagtgcactgcttagcagcttccgggctgggcccccatccaccatagaggggagcagagagagctgtggcagcctattccagtgcgtgcggaggggtcagtgctgaagatgacaagcataggtctgtggacacgaggggaggagagagagcaagaagagcatcccagctctgcggggagaagaagtggagcctgcccgttcccattgggcctccatcttctctgtccagacttgatctccaaactgaaaagggtacagcaaacaaggttagaagggtattgaagtctgagtcaggtggagagagacaggactcattttaaacggctttcagtgaatgtgtctccaagtccggaccaaggtcaagacagggagggcacagccagaacccgagaggtggctataatttctggggagtgacttgggagtcactgaggtgccggcagagcaggaacaaacaccattgtctctgtgtttgttgctgtgttcagtggcagttagatgtggttaaacttgagctctagccttggtggaatttcaagttattagacagaagagtggaagcacttataaggccccctggcaagagggttttagaaaagctgtggttgggatagagctctgcgtgagggggcaggaagaggcttgcagagagaggagaaagaaaagagagagggtgcagagaggcagcagctagggaccccagggagggctcctggaggaggtagccacattgagaggcagctcagctggcaggaggggtagacacatacatcgcagtggccctgccttatctgtaagtatgcacagcatcagcggtgcgggcatggctaggaagaccagctttagtaagagttcccaggtacaccttctggggttgccgatgggactgacaaaacagtaatgaagtattagccaggttagtggaagcatggcagccttcctgagaggtgctgtgcccgcaccgccacagattccaccgtggctcctcctggaggaggagggagcgctggggaggcaccactggccacacaagccggaggtgagcagagacctggacgtgagtttggggcttgcaggggctgggctggcttggaggtgacatggcatttggctggggacaatcctcagataggggcagggccttcctgagcagggggcagatgtgcactaggctgtacacacttgcaccagggtcgtcagcctcctcactttcgtctcctgtctgagcatccttcgttccacagccagaggcacattcctggagtgcaaagtggatcagcactcatttactccaaatatcctgtgcactctagaatgtggggagtaaggttcaagtacttcagcccaggctagaggatttgcagccactgggcacagggccccctcacctcctgcctgccgtccctccctactgggtctcttctgtctctgggtgtcttctgttacatgcctcctgcatctggcaggctcctgctcacgcttcaagacccagcccaagtgccctttctccggggctttcttggaaccttggcttggttatggagctatcccatctcctcctcacttttggatggcgggtctttccagtgaggtgtttgttaatttccgtacatttgcttgggcttggcattttcactgtactgggctgttctgatcaacttggggaaaatagagggtggtggactgtttttctccaaaattaagacccaaaataaaatgtctgtcttatgaggtcacccatacattcctcaggacggcaagtgcgagacgtccctttagtattcttccaaccctaggattgagagagggtgggtgtgggtcttgacaggagatgggaaggtacagctccacctggggacacaggcttctgcattcttgccccgtccagcacacaagctgctgtcagcaggcaggccccgcttctcctcatcccatccccactgagcaggagaagttccgcatctgagtgggagcccccagaggctttgtggccctcaatagccctctgggtgatgcagagagcaggagaaaatggtaaaggaaggtgcccatggcatgcacaggtgaggggcagagggctggtgcttcccgtctctgcacagtcctgagaactgggtttctcagacccagtaccgccaaggaatgtgaaaaacagcttaagtggaaaacctagggacctaactgatcatgatatggctgatagtaaaactaattttctcttagagtaggcccctggcacttccattttgtagtgggctgtgtctggactattcctctttcaagcactaacacccctggcttcagagcaagcctctcttcctccacactccacctgacatgggacctgtctcgcatctccccctgcctgaaacaagcagagaatgacattgagttgttatttccaggtgtttcttgggagcagcagatggaaatgaaaggatacaagtgtagacgtaggtgaaatcatccactggccccgccttctcacttctcacagcgctatggggagggcgggaggtactcgtgggtaacagcagggcatgaattcagtgcatccgcaggtctgtacccctgctcgcctgggcagtgcccacaggacccccataaagaaagcagggattccctctatgcttcctgctcgcccccccggggtcagttgcagagtgggacacccctcatgggtgtcacagagggcctggtggctgggtggttcccagcagccctttctgggtgagggcatagggggttacatcagagaggcagggacattctgtttgtgttcggtcatttctgcctgtaaatatcagttaattttatagttagtagtgtaggacttttgctgtgatcatctcatttagttgttataacaaccccagaagtggaatattatttccattttatacaaaccagagtgtcagagggagtcagtgagccaggctcaccctcatgcttggattttgtgctctgtgtgtgtgtgtgcatgcgtgcgtacatgcgtgcgtgtgtgtgttctgctgctcctctgctcaagtccttgaatccttatcagtgacacagcattggcctggacccctgttggccagctctgcaccctctgttcccccgtgctccagccagcgatctgactgatggggcaggcaggctcgggagggctgacaggctttgcggtggaacacatttaaaaaatgcctgcaaacgagcgaaagaggcgtaggagtaagcgtccggcgcaagaccacagcacgtctcatatgcggctgtatcggcacgcagcgatgagatgtgtaagaactaacacgaagctgcgttcctcccagtcacgcgcaggattggattccttttcacggtcagcctccggtaccttcgacccaggacgagaccctcagtagtaaagcccttaacaggtgcttgtggactgcgcatgtgggatgctgaggtgctgcgggcgaggctgagtctgtgaggtgaggagctccatcttcacctgggtaggaaagggagcctggagcaatacgaggagtggcgcgggcaggacagcagcccaggagagtacgaggagtggcaggggcaggaccagcagcccaggagcgtacgaggagtggcaggggcaggacagcagcccaggagagtacgaggagtggcaggggcaggacagcagcccaggagcgtacgaggagtggcaggggcaggacagcagcccaggagcgtacgaggagtggcaggggcaggacagcagcccaggagagtgagacccttgtgggcccagtgcttctcagaggacatggccatgcatgtgtggagcagggcagtctgtgggaccacctgagggtttgactgggactagcgcagacctcattccagcccaggtaggtcggcatggggtcgcagacaggtgacttgttctgtctgcggaataatcagctgtaagcttctcatttttactgaatcaggggtttcaaggctggtaaggtcaaacaattccttctttggtttcaaagaccacatctaagagaagtctatcttctggaaagaaatttcctcaaaaatattttcataaccttatttaataagcaaacttttcgcagccctttttaggataatgctctctttcttttctcatgttatttaaatacctttctcatgttatttaaatgtatgttttattttcctgtcatctttggtgatgaagctagtttctgcctcctcatgtaaaatgttatatctttgaagtattttccgtcagctgcttctgcttagccaagtccactttcccgagattctcatatatttttattttctaaagctgtttaatttccagaactatttttaaagatttttaaaaagatgataaaagcacaagatgatgtatggatgacatgtcatatttttaggaaggcaatatattcagacgttttgttggttgttttgtggctgtttctctctaacctctgactcataccctactctgtgtacctctcgccatgtccctgtttgcgtggggttgggctgggacgcgtgtgccctctgcaaaccttgttctccatggattttcctgcctttgcctctgggggtagcttcaaacctagcaattctatatagtacagaaataaccaattttagtaatggttctttagcttagcgttttccaaattatgggttgtgacccatcattaggtggtgaagccagtttcgagagatacctaaaacaaaaatagaatagatctgttcctcgcatatagtgagggtaagtttggtattgtgagacttttgtatcagttgggtgtgtatgtttgcattgtgacacctgggtcacagtgttaaaagtgtgtcattgtcaagcaaacttgaaagcccctgtagtattccagtactgctaagcttttatgaaagaaatactgttgatagtctgtctctagtaaaacagctgtgtgtctcagggagattgccacaagacaaggcagggcccacaccagggtcctgttgaagacgctcctgtgtcaaaggaggcggcagggcagggtaccgctcagtaggctcatgtagtctttgggtgctgaagaaagatgatatttttgtgaagtttcaagggcttctccaagttcatttttactcatgattcaaatctcagttcagatattctttctgcagggaagccgcccctggtttcccagtctagataagattgctccattagatgcttcatttttcaccctcagagcacttagctcagtttttattgatacatttattagtatggtcatttaattcttttttttcttttttttttttttttttgagatggagtcttgcactgttgcccaggctggagtgcagtggtgcaatctcggctcactgcaacctccgcctcccaggttcaaacgattctcctgcctcagcctcctgagtagctgggattacaggcgcctgccaccacgtctggctaattttttgtatttttagtagagatggggtttcaccatgttggccaggctggtctcgaacgcctggcctcgtgatccacctgcctcggcctccccaaagtgctgggattacaggcgtgagccagtgcgcccggcctagtacagtcatttgattcttgtctgtctccctctacctcctagaacatgaagtccacagcatgggtcacgggcctgtgtgtgcttattctccctgcaggatctagcatgacacctcatgtggagtcacctagtatgcaccgcaggccagggtctgagctgccctgtgaatgactggcattagacatcttgcaaaccctgtgctgtgatggtcttattccagaagggctgtgggggtgtgagagcacaaagagatgtatgggtggaaatgggattgaagcttctagagctgtgcagaggccttatcccatggccactgctctccttgcacacaggcccacaccaaccagagtcctcagactttgctgtccccagcacgccggtgagaagcaagtaggctgtaagcagagttacatggtaggatgaaacctctctcgggtggtggtctcttctctggctgcgcatgggactccgtcatggttctttattccatagttcaaagttccgtggtgcagggtattcaggacattaaatacgtttgttagaaccagctcattggaattctgccgtaggtgctgctggtttagattttaacaaaagcttcaaagcctcttttgtattagtccgtgaaaggataaactcactggtgaggagtagaagctgctcgctcttgagcgcaggtaggtgttatttttcttctcatccttgaaaatatatgagggtgaaggcaggaagatgaggagagagtggaggatcagtaagtatttttaggatggtctttgcacggaaaacatgtttccagtaacatgttttggaaacattttatttgcggcataagaagatgctgacaccttggccggctcccacaggcagctgtttattggggccgtggtatcatcgctgtagccaggctcgtgggttttggaactgattttcgatttgagaggccagacttctgtgacaccccccaagcatcatttccacggcaaccagctgtgatgagatgggggttctgacctcgcaggaccattgcaacaagaagcagatgagcttttagatagaaaatttactcttctgtcttgaacaaattacatgtaactgattctcagtttcctcatctctgaaatagagaaaggaacacaatggcccttcaattgtgtaatgagggatttctgttgggaaagtagatatggaggtacacatgctattatcataccgtgttttcaaggtcaactgcacgacccaagggttgacacgctgcaaaagagctgtctcccccttgctgccctgtttcgtgtagctgccggcagccctgccttcccctctccaaccttggctctgacggccaggctcttgcttgctccttagtcacactggcctcctggctggttcctgaatgggcatgctcatgtcgacactaggacctttgcactgcggtgccctattctcccggagagttgcatgcccacaccctgcctttgttcagttatctgctcaaaatcatcttgctaggccttaccagaccaccccataaagaacaggaaccctgtactccctgcccccataacagccttatgtttcttcatggcagttccaaccactggaaattgtatgagtttcatgtgagcagggttgttggtggtgtttattattattttttagtttgtcatatctatgaagtggaacattgtaggccattaagtcctcgtgaagaaccttttgttattctatttacttattttgtaggaaacttaatttcaaacaatgaatagcgtatccgagatcatataggtggcaaatggcgaatggtgcttgattgaaacccaggttgacacagaatcataaatgttctccttgcttcaagtctgcctctccttccacctgtcttctgctgtttgagcatcctgcctttgtgcatttctctggctctgcctttattacacctgggctcatcctgacttcactcgcctagcagtgctctcctctcaatgctccttggtcgccaacactgcctctgccctagggtagagctcctcagtgcagtggtgtgttcttggagaaccttgtgcctggcattctagggttcaggccaatgccaggggacaggcaggctgccttggcttcctttcttccaggaagagaacaggtatgatgtgtgtgttaggaatggccaggcccctgctgtgcatatgaggacacctctgagagccacatccttcactttctccccgtggggtcaggcatactaacagctgcaaaaaggaccccttgacaaggtctcaccaaagggtattttgatatcctgttctttaggggttattttttgtataaacatttatttttgtgttacctgatgttacatgatggaataccttatgtgcagtttatacatgatcttcttcaccctacctgagataatgtcaacattataatccctggaaaggtgggacaagctgagaacatctccttttatagaaaacatgaatgatgccacagttacaggtactttgatcttactttgttcactggacagatgcctgtacaccaggcctttaactttcatgctgtaaatggcaaacctgcagtttcctattctctgggttgtagacaggatgatgcttgcttgtgctgttttcagctagtttgttgtttaaaatggccactatataaagaagccatggatgtgatttctggagttaacacttactgcagtctctgtgatgagcacttggtcacattttccctcatccctaccctctgctctgctctttttagggaaagtacggtggccagactttaaccaggaagcttatgttggagggacgatggtccgctccgggcaggacccttacgcccgcaacaagttcaaccaggtggagagtgataagcttcgaatggacagagccatccctgacacccggcatgaccagtaagtaccccactaagcacctgctgcagcttcatttgctttcacacaaaccagtacgtcgctttcacctgtgacactagaacttctccattactctgggaaattgaatgtgtgttgtaaaactaggaaaaatcctgaggtatatggcaatggaacttcatccataggcagtggaaggatggttctagattcagctctagtctttaggtgccctgtggcagtgtgcagaggctgtgggtttctggccagagcgtggaagtcagaaagagagttgtgtgactggctttatatttagtgatcacttgttatttttatgatccattcacaaaaatgcaaaatttgtcattgttcccaaccttggaggaagaaaatctaaattcctgcttattgtgacagcttatattggaaatgttctaaagattagaaaggagaaatgaactacccagcacaatagatgttaaattgagcagaaacacaggagggacaggtgccacatctccacaccctgtactaaaggaagggctcttgtccacatctttctttctatttttagagatagggtctccctctatcacccaggttggaatgcagtggtgcgatcatagctcactgtaacctcaaactcttgggctcaagcaatcctcccatctcagcctcctgagtagctaggactacaggcattcaccactacatccagataatatttatttaaaattttttatttttattttttggtagaggtgaagtctctccatttgctcaggctggttttgaactcctggccttaagtgatcctcccgccttagcctcccaaagtgctggaatcacaaacatgaaccactgctctcctgacctccttctttttctttttctttttctttttttttttggagactgagtcttgctctgttgcctaggctggaatatagtgatgtgatcttggctcactgcaacctctactcctctacttcccaggttcaagcaatttgtggctcagcctcccgagtatctggaattacagctgcctgccaccacacctgactaatttttgtatttttagtagagatgggatttcaccatgttggccaggctggtctcaaactccagacctcaagtgatccgcccgcctcggcctcccaaagtgctgggattacaggcatgctccaccttgcccacccctttttattcttcaaagatcttgagagtggagggtactttggggtctatgaagctcagctcaggaggttggtaggcattttaaaaagagtatttgtcaccacttatcaggaaagtgatatgcataaccctcattgttatcccatacctgtaagtttgctgataagaaccttgattgggaggtctttcacattggaattctcagtgaattagtcttgtttcagattattaaaaaataaggagctgcattttgaaggcagctgttttcctgggtgcttggtatatcttcctgctaagttagagtcattcattcatcagtgaatggaatatagattacacatctaccatatgtcagactctgtgctcggatcctagcatttcacccagaaaaatctggtcccattccagctgctaggggtggcaggtgcaccaggaagtgaggtcgtgtagctccatgggttgggcagtctactttgcatgaatacttttgaggcactcaggagggtgggagggtcaggacaggtcccaagagcggtgaattgggtggggacacccaggaagaaggaagtgcagaagccctgccaggaaagcatggggctcccagagagccagcaagtgtctaatttcacgggctggagtttcagggattgatgggggagggagagctggagagagacaaatggccagtgaaactacattcacacacactgcatacagtgaaagaagatttttctctcttactctcaaggactttatggacagtgtaggtgccagttaactgccaggagcttcctttcttaacagctttctttgggttctagtcagctctgttcacctattccagctcatatttaagaaatatgtagctttacagtttttttagggccatggaaaagtgtgtgtgtgtgtttgtgtgttaatatctgatacatatgagtatatgtaaacatacatatcttatataatagtaagaatctcatcattttcctaactccactccaaaagattgtctttgattaatgtttcctgtcatccattaatttcttttctaaagccagctctactcagtccttatgctgtcctggttaaagtcagcttgactaactgtttagtactgtatctaaaataaggggtgacaacctggggtccaaggacctccagggagccatgcatgggctttgggatgttgtgaaagtgttgaggccgaagctgtgtgcaagatcgcaagtgtatatgtaggtgcgtttctggggacagggtccttcactttttccagagggtcccaggtgtgtacttccccaccaccagcccatccccaggctaaccaggccaagcagcccatgccaggtgcttctccggcccccacccacgtaatccacacaaccctttaagataggcttgaagcttatcttcatacacagagaggaaacggaggtgcccggaatgttgataacttgcccagtgattaagagctactgactgaagaccagaaagcgtccgtgtagcttttaagaagggcttggcctaaactcaggggaataaagtctagcagaatctagtgcagaaatcttccctgatgacttcagtcgactgcttggcatgacatctccatgagatggtctgaatttcttttcaccatgtgggttaagagctagttttcccacaagattttatctttacatacttaacttaccctgtgagctgagagaagaatggtgttctttctcatggctcatcagcatgtgggctggctttctcatctgcctcccttgcaagtccctacaaagtccccaaaactatatgtacgtatattttttttcaaagtttttgaaatatgagtttgtccaaacagatgtttgaatattcatcccacagtgtgggatgcattttaggtgggtttaattttagttccagccagtgtgtcatgttcatttgcatgtgttaaaggggcagctgggatgccttccacatttgttggatttgggctaaattaaagtctatccatagtcaattggatgcctagagctgagccgatttaatgtctcaaagtgtaagctctagaattaccattcttgttgaatgtcaggttaagaagattgggttacctctttgaatttctctcccaatatatctaatggggagctatttcagaatttgacctttctgtataaaatgttttttgtctctgcagtatctaccttcgtgttgatcaatagaaattcttgcacagtagaattcagtctttagttttgataaatctgaaagcagtacaggtggagggtaattaagaatgaggtgtttggagtcctacagacctgggttgaaaatctcagaccctccagttcttaattctgtgacctttatcatctataagatgatagaacattactccatctgtaacctatgaagattaagcaacatgtttacatgggctggttgcccctcccctgagccacctcagtgaggtatcccttgaccatcttccctaggagttcaaccccctgacccccactccaaaacttcccgtccccctttcctgcttgatttttctccacagttcctctcaccacccacacactgtgtattttacttatttttttcttccgaatagtgagttattgtatccagggttgttattcagacacctccgggcactcagtaaattcaataagtatttgctgagtgagtgaattgtttagcagagtgcctggcatatattgagtgcccaataaatcatgcaagatatgaagaatcataaaagaatacaggagaaggaaagggggatatttaagtataaaggtcctgtgaactcaagatgggccacacacaaataacctcattgtgtttgtgttctcccaggactggaaaactgcgattataatccaccccttattaccctgaaggatagatacaaggaataaggcttcagagcctcccaaacaaacagacaaacaaaaaactctgggctatgctttatttacctttctagatgtatatattgtaccaagaagaaatatttacatggaatcaggaagcacacaaaagccagctgtgagtgaaatactaaatactatgtataagatatattaggtcctcttagatattagaaagatgatagcccatcttattttttttttcttttctttctgcaaggtctcactctgtcacccaggctgcagtggtacaatttcggctcactgtagcctttccctcttgggctcaagtgattctcctgccccagcctcctgagtagctgggaccgtgggtgcgcatcatgacgctaggctaagtttttgtagagatggggtcttactgtgttgcccaggctggtctcaaactcctggcctcaagcaattctcccgccttggcctcccaaaatgctgagatagtaagtgtgagccacggcattcagccccatcctagttttgaaagcaccatttcttttctttttatttttaaattgatatatcatagttgttatctatcttggcggtacatgtgagattttgatacctgtctacaatgtgtaatgatcaagtcagggtaattgggatatccctcacctctaacagtgatctctgcatggtttctcaatttaaaaaaataatcttcttgcttggaaatttcaaataaattatcaagacttaaaagcaaattaaaccaatgggaattctgaagtttcttttttgtagtaagtgtttgttttttctctctctctctgcgttgggaagctgttcttactgtccaggcagaaggtaatggaaagtagcattggtggtggtgagaagtggtctggtgggctatattctgaaggtggggccaacaggatgtgctaatggactggaggggggtatggcttggaagagggtgccaaggattgtggctggcacaagggaagacctgcagtctcctcagctgagatatagggaggctgtgagtggagcaggtgtagggaaatgtggacatgttaatgctgctcagtgtaggtggacctgttttgtaggtggtgggatatgtgtctggtgttcaggaggaaggtcttagcgggaatgtaaatttggaaatgttcagcgtatggatggtatttaaaaccgtgaggctgggtgttaagcccaagggaatggatgcagacagaagaggcccaaggcctgagccctggacgattccaacattgagatctttagctgtgaatctggagccaacggctgacacttgaggacagtctaacactgtagattgcgtactattttaggctgtgttcccgtgatcaggagatataattttatgaagctatgcgactgtgaagctaaaaggagcctcaggggagtgtctaattcagtggttctcagccttgagctgtgccacccacccagagcgaagatggaaatgtgggggtggaggatcgggggttgttagaatacccgtggggtgctcctggcatttaccaccagggcccaatgaagccacatatttcgtatagcccaggttggtctggcacattgaagagactgtcctacccaaatggccacagggcttcctgtcaagccctcatttacttatttccccccattagttaaaaaaaaaaaagcatgttgaagttgtttttttgttttttctgttattgctctgagtcatacctgccttctccatcagccagccctcaaaagcaggttgaaagccatcacctcctgagccttgtagcccatacaggccccacaggaagtctctgtccctctgactagcagccgcatggaagtatgagtgtgttgtggactgaattgtgccccctcaagtttcttacgttgaagtcccaaaccccagagtgactgtatttggagacaggtcctttgtggaggtgattaaggttagaggaggtcctaaagggtggcgccctgatccacctgtcctacaggacaggtgtccttataggaggaggaagatggaaagagagatttttttccctaccatgtgagcacacagcagaacagggccacctgcaagccaggaagaggcctcaccaggaaccagatctgctggtaccttgagctgagcttccagcctccagagctgtgagaaatacaaatctattgttgggccaggtgcagtggctcatgcctgtaatcccagcactttgggaggccaaggcgggtgaatcgcttgagtccaggagtttgagaccagcctgggcaacatagcgaaaccccatctctacaagaaaatacaaaaattagctgggcatagtggctcacacttgtggtcccagctacaagggaggctgaagtgggaggatggcttgagcctaggaggctgagcctgcactgcacttcagcctgggtggcagagcaagaccttgtctcaaaaaaaaaaaaaaagtctattgtttaaggtcccgtctgtggtattgtcagcccaggctgactaatacagagtggaaacgatacagcatgaccggcaggccagtgggaggaccggccagccagatcctgaaatgacttgggtaacacttgccttcattttctcttaagctcttctgaagcctctccccagtgttgtctggttcagaggttcctggggtaacatccccttgatgccttctttagagtgtgctgcgcttaggaagtgagtgtcgtcaggctggagcgtttccgggatccaaactcctttccaggagggttttgattgtttttgcctggaaatgcatctgataagaaaataaagtagaggaacccaggaagtttatgaaatctctttctctctactagggaaaacttgggacagtttacattgaaattatttacagatgtaaaatgaaatcaacctttaggggggaaaccattttctttgttttcttctttcccctgtcaactagacaccgttccttttgacttgtttcattaaatcctttaaaaacaagaactgcttgttaaagaaacaggtttcctttgggtttcaaacgtttagttattagaaagcttttctctgccttgccaccactacatttaaaatgtggggttttgaaacatttttgtgtctcacgctgaaataccactgcctgaaccatttccctacaaaggaaccttctttgagaggagtgtgtccaagttgtacatctaatcggtttatctttaagtcaagaatatgttgtttttactctagttacagattatagtggctcaccctttgtttagaagaattactaaagaactctattttgaccacttttgaaatgtctgcctttaacacagccaaaacataggtcaaagctcttaagggtgtattcttttatttattttttaggggcatttaaagagggcagacattgaaggcctgggttgtgctgtttactctcactggaatgtcagtattgatatcagttgttttaagagtggctaatcaggattaaggattgtggggaaagataaaatccaaacttcccattcttattctggaagaacaaacattgctgaagccaagtgaaggttttcagcattaagtcagccagcttggagggaggctttggctaaggcaactattaggggactcagagttttctttttaggggggcagaagatctagggaaatccacacagctccccagtgggagtgtgattggagacccaggcagggctggagctttgtccttatgttgtacttctcggcagctcgcggcgtctcataaacatgcgccgctggcctcctgagattcttgtgacggaaccgctgctccatggtagagctggcccgagcacccactcctcccgcatcaatttgctgcccaactccaactctgtatgccgcaccacagggtcctggtggaggagatgggaggccacacggggtgtcacaggtggggacaggcgcttctctaggcttagctgttctggctttgttggcatttgtggccgtggggcaggtggagtttgggtgtggtgtaacagtgaatgtttaaaagcttgttcaataatcacagtaacaaagcagttcattgaacattttttggtatcaaggcccatgctcagccttttgtgtgcattaattttatttaaggctgggcacagtggctcacacctgtaatttcagctctttgagaggctgaagcaggaggatagcttgagaccaacctgggcaatatagtgagaccccatcttaaaaaaaaattactctagtgtggtggtgtgcacctgtactcccagccgcttgggaggctgaaaggggagggtcactcgagcccagaagtttgtggttgcagtgagctatgatcatgctattgcactctagcctgggcaacagagtgagactctatctctaaaaataaaaaattttatttactctgcatcacactcctgtaaagtgggtagggatgctatacttctgatgatgtcgtataccagttcccagaaggctcggaactcagaccccacttccagaaagtagaagagttgcacacaggagtcaggttcggcaggatgtgagctcagtttgcagagcagaggttgtttttctcatttttcacattgtcggttggaacatgtttggggagaggcaggcagctaggatatcccggggcctcataaggcaccaccttgtatctagagagccttagtccccagggattttacagttactaagccatgaagttttatcacttgtctatgaggcagacgagaaaggtgagccacttgcctgagttctaacagggctcactggtggaggaattggagcactctgtatcctgggctcagggttctgtctaacagttgtggctcccttactgtccgctcttcagagggtctttcatactcccggcttttaggcatgagtcttggcatgaggcctgaatgcacctaaaaaatggaagagatgggtgttggtaacttgcagccaaacaacctcctaagggaagctggccacacgttgatgggatgctgagaaatggagaagaaatggggttgtttttctttttccagcttcagattctcgaagaaaatgtattggaagagtgcactctatttctgttcccttggaacattgctgatgccgttcaggaagtgagactgcttgtgtgttcagtcagtgtgacatctctgcctgtcagtgtgacatctctgcctgctgttggaagggtgctggcaggctcagcgagatatacgagatgtggggagtgggaagtggccagcaataatggctccttgcttaacgggtcccccaccaactcatcccaggttgtaacttgcatctgatatgcacagttcacaccaaagccatgtcattattcatcagcgtgcttgtttatgttttgtttttattttttgtgtctttataaaaccaacttctggtttcaaccacagaccgttctttttcttcccttgatatgtttcctctttttttttggtctatttcaggccttctctctgtctgaattaaagaatgcattgagactggtataagtagactgtattgatttgactgtagagatttcgtttgtgtcgatgttggcatctctgaagggcccgtttcaagtctccttttcaaagatcattagcaaacgtattctcaaagcttaacccctgagtggctgcccacatgtgtggctcagtttccccatctgtaactctgggttatggtttgggcaaaagcacaatgatgctaaatgagttgtgtgatttgctttctttactctttagtcttttctttctgccatcatcctgggaatgcagtgatgaccatgaggatcgtctttgttgtcaagaaactgtagtcttcccggagaggcagacaaggaaacaggcaattacgtagcctagtaaggataacctaaccacctctagaccatttacaacagagctctgttctttctattttagacctgtttgtgagtttctgttattttcttagtagactggcccttttatcattatgaaatgcacttcttgtcagtggtaatgcttcttgttttacaatatcagtagagctgcaccatctttctttggtttcatgtttttgcatggtatacattttcccatgctttcactttcaaactttttatgtccttatatttaaagtgtatcttctgtaagtagcctatagttggattttggactttcatctgctgtgacaatctttatcttttatatggtgtatttagttcttttacatttaatgtaagtactagtttattggggtttaacaccaacatctcactggttgtgttctcttagttccacctgctttgtgtttctttttcccttgcatcctcctacgttttttcttctctgttggtttgctaaattcttgactagtaagtccacatgtagagcctaatgtaaatgaataattttattacttcttagacaatgcacagaccttctaataatttaccttccacttaccttcagccctttgtgctcttgttgtcatttagcttaattctttctttataaactctataggatatcttttattgttttatgcagtaaatatccttttgatttattcacatatttatattcccattgctcctcatttcttatatttctatttttctacctaagaccatattccttctgtatttcattagtatttctattagtcccagtatgttggcaatgaattgtatccttttgtttgtctgaaaacatcttaactttacttttttttttttttgagacggagtctcgctcatgttgcccaggctggagtgcagtggtgtgatctaagctcactgcaacctccgcctccccagttcaagtgattctcctgcctcagcttcccaagtaactgggattacaggcacccaccaccatacctggccaattttgtatttttagtagagactaggcttcaccatgttggccaggccggtcttgaactcctgacctcaagccatctgcccaccccagcctcccaaagtgctgggattacaggtgtgagccaccacgcccggcttacttttgtttttgaagagtcttttcactgactgtgaaattctgggttgacagtgactgtcagcacctttacgttgtctttcagttgtcttctgttttttgttgtttctggcgaaatgtctaccgttagtcttgttctttttgaagacatttgacttttccttccagctgccttttcagatatttctttttttcagcaattttgccataatatgcctagcagttgttttccttgtgctgaacctgtttgggatttgtggaatttcctgactcttgagcttcatgccttgtcagttttgccatgctgcagttctgtctcctcttcctctgagaccctaatttcatctttgttagataattctgcgtttcctctgtccctcataagctcttttctgtactttttattctttttgattccctgtgtctcagtctggatatatttctgttggcctgcttcctgttcattgatcctttcctctgctctgtctagtctgcttttaaatccactgctgaattcttcatttcagtgattgtgttttgttgtgtatgaataaataccgagatatttcagggctctcactgactttttcctccaaagaggatttagttttgttctctggcaggcagttaaaatagggcaggtcaccttaatcaagtctggaattgagctggtataaagctgggtttcggtcttttgtgagagagctggtgagtttccagttctcttttgccactaggaagtagccctgtgggattcgacctgggaagtctgggatatgtatcagagcccagtttcctcagcaagccctgaagtccatttctggcctccacagctccacagcacctccagaagctttcacttggctctgcacctacaagaccatcgcttctgctcggctcagtcggccgtttggctctatgccgtttgaggggaagaggatcagagaatgttggccttcctctctaggtgcttctcctttctggaaacctgacctcacacctggctgctttgctagctctctagtgccttcaaatagattcttcagtgtatttcatcccgaatttctggttgcttttagtgagtaggttggtctacagcaaggaactttactgtcactggaagcaggaaaaacacctgagtgttttatttggaattcaaatccactctgaatttggcagtttataaattttgccctgagcaataatgtctatctcgaaggagagtaaatggaaatacaggcttgaagttgggatgtgttgcttttattaatagctcaaccagctgttagctcccagactgaggttaaaataatctctgtaaaccctgggtttcttatctgtaaaacaataatcatgcttgcctggcctgtcttacagcatttttattaggctcagatgtacacataaactacatacattaattacacaaattcaggacattaatatagtgactagtggcttgtatatatatcagctttaagtaaagaatgaactgttattttgttacactttgctctcaaaatgtgtgtgacatggctggcagactttcagcttccagtatgtgaatgcctctgtcacactgagatggtattggattgttttatcatagaaccaaaaacagttgtggaaatagctgtgaagcagtgatcctacctatttcagaaagaaattagaccaggaaaaatggagtcaacagagttttgcttgataaatgagatcaatcttcgagtcctaacaaactgtcctacttcaactatccatttaaaacccatcactttgccccccgtcgtggaaccatgaaactgaaagaacaactttctttttcagtggaagggttttgtatattttaggaaacagtcaaaatactgtaaaatttattttaactttttttgtcatttaggctacgtatttcacttgaatatggtttcggagattacttgtgatgtttctaatgaacttaaaagaagcagcattgtcagtttatggtacattcattattaagtcaaaacaccgatctgttcactggtgtaactgacaattcacatatactttggagttgtctcaccccgttgcccaagctggagtacagagatgtgatcatagctcaccgtaacaaactcctgggctcaagccatccccctgagtagctaagactacaggtgtgcgccactgtactcagctgatttaaaaaattgtttagtagagatggggtgttgctatgttgcccacactggcctcaaacccctgacctcaagtgatcctcttgcctttacctcccaaagtgctgggtttacaggcatgagccaccatgcctggcctgtactctggagttgttaaatgttaatggtagaacctatgagggcccataatctccactgccatctgtaaaatttaaagttcagacttttatagtaacgactatcttaactatattgaataagccatgattttcttcatctgacaataatgtgagaaaatccacacctctttggaaattcaagttatttaaaaaaggaaatatcccaataggaatattgtacttggatttaaagttttatattcactgaagatttatttttattcttggatttatgcatttatttagcaaagatttgagtgctaactacatgacaggtgtttttctggtcactggggaaacagctgtgaacaaaacattaaaaaaaaactctgccgtcatagagctcacattaagaggatgggggagaaaacaataaaataaatcattaattatgtggtttttaaaaagcatgttaaatacagaagagaaaaaaaaagcggtggaggttaggagtgtgaaagagtcaagggttttagtactaaacaggtgatcagggaagatctcactgacaggaaggtgtttaggcaaagacctgagggaagggacgagggagtgtgcgtttgaataactgggaagagagttctcatcaggggaggtggcaagggcaaaggccccaaagaggtagtgtgccaggcctatctaaaggacagcaggaagccagagtcgctaggcaggtggccatgaggaagagtagaaagaggtgaggtctgagaggagtcaaggcaccaagccctaggagcctggaggcgcatggtaagggcattggctttgtctctgtcatagtccgttttgtgctgctataacaaaatacctgagactgggtaacttacaaagaacagaagtttacttcttatagtatggaggttgggaagtccaagatctttaagctggcagggctcacattgtctggtgagaatctggtttctgctttcaagatggcgccaagaacagtggatcttccagaggggacaaatgctgtatcctcacatggcagaaggcagaaaggcaaaaaagggacaaactcccttcattaagcccttttaaagggtcttcattcctttcacaaaggaaaagccctcattatctaatcacctcttaaaggttctgtcaccactacattggctgttaagttgcaacacctgaattttggaagagactcattcaaactgtagcagccattgagtgagatggaagccattgtaggtttgggagcagaggaacagcatgacctgaattaggcctctaaagggtcagttttttaaaaggttgctgtgataagaccaggtttactgggggtggggtgggaaatacaaggccagaagcagagaaacctgttgccgtgatccagccaagatgacagtggctaagaacaggggactaacaatggaggtggtgagaggtggttggattctggatgcctttggaaggtagagatgacaagatatgctgaatcggatgtggaatgtgaagaagagagggctgaaggatgccactgagtttcttaaccaagcaacttgaagaatggacttgtcctttgctgagcagggagcagtacaacctcctggttaaggtgtggatgctggcaccaggtctcccatgttggaatcccagttatccctttagcagctgcacgatcttggcgtgtcagttagctccttcgtgatataagttaagggtgatgataatactcatcttatgggctgccgtgtgaggactaaatgggttaacacctgtaagtgacttagcacagtggctggcacatagtcagtactaaacgaatactagctgctattcaggaagcattgctggaaagattaggagggaagttttcatccaagtggaactgtccagtaggtggatgaagatatacaaaaatctggaattcaggaggcaagcctggggagaagttacacagttgagattgtcaatgtttatggatggttttaaaatcactttgttatctatccctgaatgtgtatttttaaatgtggaggtatttctggttaccaaaataggcttaaagcaggagtccccaacccctaagccgtggaccagtggtgacacatggcctgttaggaaccaggccacgcagcaggacgtgagcagtggatgagcaaacattaccgcctgagctccgcctcctgtcagatcagcatgggcattagattctcataggagcacgaaccctattgtgaactgcacatgcaagggatctgggttgtgtgctccttattagaatctaatgcctgatgatctgaggtggaacagtttcatcccaaaccatctcccctctccaccatctgtagaaaaattgtcttccatgaaactgttccttggtgccaaaaaggttggggaccgctggcttaagggacactgggtttgttatctgttgcctcttctttatgatgatgattgaatttcctctggcatctttgccatggccctttaaaccaaatcttttttattcttggtaattctttaagtgcaaaggccaaggtacttgttcttgatattcacatataagtgtcacctgttgaagttggaaaattccccgtatgttgctctgggctagaataaagcaatgccctggttgcctaattctgcttggccaacgtgtactggcgcgtgggaccatgagctgcccaagtggccttggtggctttctgttctggcatccctctcaaattaaccccttcctctcattgccactcttggtccagtcccttgtcctccgttctgagtcactggacctgcctactcagatctctcagtacctctcccaggcttgtattctgcatgcccctcccacacaagaactaacctatggtgaggacacctggatccccctcctgggccctgcatagatggcctgcagtagccggtcctgcctccgccacccacttacctttcttgagacttctgacgtggatgcattccagatgtgggggcattctttgcaaagtgcttgtggctgtcttcattcatggtattctccactgcccttctaaacctttctaaatgggtgtgtcccttaaaacacaatttgcctagattcttccaaagaactgcttctgactggccccctgccatgggattgctgcccttgcttgagaccttgccacccccaaccagagcctctgtgcctgggctttcttgttttgtagctgtgcatgatttctccaggtatttcgtaagttgctttgggacagagactatctgtaattagacagttctctaattcctcacttaaattcttagggaattcagattgttaaaaaaatatctagagagctattaatgacatatacacaatttgtgaaataatgtttttaatcttgagacagtaccttgtactcaaacacactaatgtttttgcagcagaacatgaatatgcataccaagtgggataaatcaggagaacagtcatcaggtcaggttttactgccacataattcagatcatggcaggctttgccaccaaatatgatacagatttttttccaaggtgtttttgtttttttttttaatgttggaatcaaagattaggaattatggaccctcgctaggtaaataaagaagaataccattgattctgctgccacatgataaacagcccactccggaggcaccagagcctacttttgggttgctatgctgtagatgaggggagcagggcataaagggagttgaaactcccgggatggtcttcagcttgatatcctgcagggcctctggtgcacaggttgcccttgagattggttagcacccagcgtagctcctggtaggctttgccactccctcactgtcaccacgtgctgggtgggctgaactagatctctctcggtagctgcttttatggaatcactcagttaacccagttgactgtagaatcctgtctgcaaagaggcatcccctggaggccagcgcatggtggtgccatcaaacgaaggtacttttgttagggttggtccattcttgggcttaatcagacccgccctaaggaaatcatggtatgatgtgacggtgatgctaatgatctgccttctattgttggcaaaccttatcttggccaaatattagctaaaatctctgaattggtctgtgtttcacctagatactaatggtctacgcagtgggctgttagcaagcttgtatcatgaactccccaagttctcctttctttaaatacaccgaattactcaaaactggttttttctttaaagaaaaagctttttaaaagtagatacgtgtttgttgcacacaggaagaaaagtctgaaagcttcacattgtctctggtgaacatccttcctaatttgtctcataccctctgatgttcgatgtatgtcattttctataaatacaatgacagtaaaatgacactgtatttgctgtttgcctgcctacttttttttcattcagtaatacataggaaatattttctaggactgttaaatatataactttcccttataaaagctgtatatatcccattttatgtttatttagctagctctctggtaatggactgctagattcttttcctttttaatgctaacgttgggatgaatattttcgaataacctccttgcttactcatttaaaaggagatgctatttgagatgacagtgtgttatttggttctgaaaatgtaccagaatttactcaatatattgctgagtttggctactgctttattttaggttttgaatgaagattcatagctgaaagtgtctgtggccagccagcctgcctgccttcttttcctcctctctcccgtcttccttccttcatctagctttggcttcaagattatgttaactttgtaaaatgaatttagaacaaattcctaaatttctttagatgcttcagaaaaactgatttgtaaaggagttatttgtttcttggagctcacctttcaaagtcatctaaacttagagctatttttattttcattacagtaatcctttgataaccttttaaaattcttccatgaatattgacatgtgttcagtttttctatgctttacttgaattaatttgatttatatcttcccagaagaataaatttcccttggattttcaaatttattggcatagtgttatatgtatatgcacttaaatctttattaattataaacttttcatttttttcttctttaaaaatgccagtgatgtgtctctggtttctcctccttacttctgtcttcttttcatccttgacatcaagtgctgggattttatatacatttcactgcttttctctttttttttttttgagacagagtcttgctctgtcacccaggctggagtgcagtggtgcgatctcagctcactgcaagctctgcctgccgggttcacgccattctcctgtctcagcctcctgagtagctgggactacaggcgtccaccaccacgcccggctaattttttgtatttttagtagagacggggtttcaccatgttagccagaatggtctcgatctcctgacctcgtgatccgcccgcctcggcctccctgcttttctctttaatgcattcatgtctgcctgttgcctctgctttcctctgcactccccctgccccatgagagttgaatgttgaatgtttactttatgtctacttaattggtttctgagtgcagctttggctgagtctcataatacgaaatatagtgtgataattttggttatttttaaacctacttgtaaatgaccgctattattatttctcaccactctggaattctgtttttggtttcttttttggtacgttgcttatttaggaaagagtttcaaaatcgtaagaaactgatttttttttctttttatctttttaaacttaggtcattggagatttttttctcctgactttattgctgtggagtcagacattacaactttataattttactattttgcatatatggagggttttactttgggcatgagatgtagctacctttaattgagattttcgttccaggtgctatgctaagcaatttacacacattactcatttaattctcacagcaaccctatgaggcataggtactgttgttattgttactaagatttgatagttagagaaacagaacttgccccattaaccaggctgtggtgaggtctaaacaacagcctgcccccagaggctgcaatctttacttctcatttctatgaatatttgatgggtattttttaaaagctagtaacatctatactcatttccaaattcaaatatacatgttcaaccaacctgatcgattacattcaaaacctttgttattgataaaagcatttgaaactcaacattacagtgctaggagtttctgcttatttctaagcatgaggggcttagaagatatatattcatggattatacccttattgacataaaattaccccactttatttgtttttcttttctttttttttttttttaatagagatgggctctcactgtgttgcccaggctgtccttgaacaagttttccttttttgccatacattttgctttgcataaatgttaatctcctactttatttcacttactcttgatacatttttgtatcttactgattttttttcttttttggatgccattttgtcttaggtttatcttttgtaacacatatattttgatttttaagccaacctgatggtctaaagtttaatagactcttagccattttttttttaattttattcatttactttttttgagatggagtcttactctgtcacccaggctggagtacagtggtgtgatctcggcttactgcagcctccgcctcccaggttcaagcgattctctcctgcctcagcctcccgagtagctgggactacaggcacccgccatcacaccgggtaaatttttgtatttttagtagagacagggtttcgccatattggccaggctggtcttgaactcctgacctcaggtgatcctcctgcctcggcctcccaaagtgctgggattgtaggcgtgagccactgtgcctagccgaaaagttcgtctttttaaccacaggccaaaacagagcaattcagtgtatctgaaaagagtggtgtcctaaaatgtcaccctccacagaacttaagcttttctcctgtccacttgggacaatcagaactgctcaggggtcccacagactccattatctggcccagcttttgtggggagaactgcaagagtagggtaggaaagaaaaccaactgcctgaataacctctaagaagggtgctctaaaggattcaccactttgagacaggcagagcagataaaaatgaaagcacatctcttcatggaacaatggaagtaaaaactaaaccctcagcttggaaaccagaactcacgtatccaagaggacgatggtgggcaccaggaggcagagggagttactggagttactctagcaggaccaagggtgccacttgtcccaggggagtagcaagagggaagaaatggaatgtgcagtgttcacattgtctgatgagcagtgtgagcttccatccagaaaaggcagcttgtcccctggcatcgggaggaatgaaagtttaaaggacaataataatttagtctctctgaaatgactctagccttaaatggtgagtgggacctggcagctgaagtgcagccctcggagggcatgacgagagagttcagacggcttcatccagggctgttattttctcaactttcaatagctcttgactcttgaaaagttttcagctaaaatgtagtgtctgtaaaactggaggcactaaagggcaaatggtgctctttgaatgaaaaaacatttttattccatcaaacagtggcttgctgaaagcttcaaggggaaacctaatgtttttccccttctgttggagaatactcacgtattctgggcagcattttctgtggccggtgccgaagcgtggagtgtttggtgagcgaagagtgtgtttttggattctccgcttggcctgagtgtgtgtgcatgttttttgcctctggaacccttggcttttcaatgagattagaggacttcaaagggagtacagtaaatacgataggcttgagtttcctgtgtcacagggaggataaacattttgttttagaacatgcttccgactcctatgcgttgcagaatgcagaagcctgcggtattcaagaaagctattttagacgaataatttcgaagtgagacaaacctaaagttattaattgagctaattcaaatctcctgttgaccagatttttaagaagcttgatttcacagaggtcctgcagaggttttttaatgtcttaggatttggttctgtttagttttgaaagacctctatagaaataaactctgtagctattaggactaatcagaaattagtggatttggtggaatattatgccattatgactgtttggaggattattaagggtatgttttaattaaatgaacattatacaacagctaatgaacttttttccattttcctttttttggcttccatttccagtttacattctatccagtagcctgcctagactttctgtagacaccatagcaacacatcttgaaaatgtgaagctgaacatcttgtttgggatgggccctagtggaagtgccctgaggttgagagatgcatccgcagcccagtttggggttggactgaggagggcctgtttcccgtggccccttctgccttgtggtggatccagtctccagcttgggctagatcttttcagcctggtcatgttgggccttattcccagtggcttaggcttgactctctctgtgttaggcttcatagtcatggtagactttgaggaacacagcgtgggctgggccacttcatgtatggtgaccacagggggtcagattgtggtagagaggaggaatgggaaatcaaaatctggaggaggcagagtttttttgtttttttttttttaacctctgtgctatatggtccataccagagttccaggtctaaattcaagttatccagatgagtctaattatggctccacattagagaactgtttcactaataacacctctcacttttctgtgtgtttcttaaaatgaagtctaagagcaacctgtataagccttgccttcaggggccttttcgaattcagattcccaggtatcacccagacctacttattcagaatgggatgggagaagcagtcagggcctaggcatgttcattttcataagctccatgaatgagtcttatgctcactaaactgtcagagctttgtgataatcagaagtctgtggccttaaagcaactgcccttaccgcagaagcaaatcagagtcctgaatgaggagcatgcgcccagcctgcggttggctctagcctggctggagccccaccttcacagcagaggcatatatggacattctgtgtccattctgtgtccatgggcagctgcatcaggctgccaggatggtcagtgaaacaacagaccttcctgcccttttctttcccttgaaatgggaatggcgtaagcattttctgtggatgagggcaaggaaacagaaggcattcaccgcctctattgcatcaccagctgtgtccagagccttgattccagcatcctgaggtgctaacaccctccccctgccaccgaatatctgtatatgaatggagaaatgggctagcaagcaacagactgtattttaatatgttcctttgatttttcaaacttctggccctgctggctaatttaacgcccccacaggctctctcggctcatctcacctggctgatgggtgcacatggagactcgcagactttcaggtgctgtgttggctggagaaggaaaggtccacgtggctgcagggctccctgggctgctccatctttccgaacacatgcggaggcaggtgccttgacctggctcagaggcaggggcctcgccactctctcccaaagttaggggagccagtcatcgcacccgcggacatttctccccctccccatttcactcacccatctcatggttgagaaaactgcctgtgtttctccagctgtagaatttgcttggatttttaaccatttttccttatgtagggtagctgaaatcaatcactctgtgactgaagaaggtggaaaaaactgcagggtgtaaacctaaagaaagcagaaggaaggaaataaggaaggtaaaagaagaaattaatgaactaaaaatccagtggagagtatatataaagcttcatctttaaaaaatataaatctctaaaaatgctgattaacaaaaatagagaagaaacattaatattaggtgtaaaaaagcagatataactaagatcataagaaaattaaaagtatacttttatgtaaataaatttgaaacttacatgaaattgataattttctagggatatttaagttaccaaagtctcttaagaaataaaaaaatgaataagtgcaaaccatcaaaagaaattttcagcaataaaaaatttgccttcccaaaatttcacaaagctcaaatgggtttgcgtaaaacccagactgtttcagagaatagaaaaggaggaaagctaccctatttccttcagtagtatctagctatgaaaccagaaaaagaaagtataagaacagcaaattgttcaatttatggttatagactcagaaaatcctaaaccaaatactagcaaatctaatacagctatatatatatatgctatataatacagctatatatatatatgctatataatatagctatatatgctatataatacagctatatatgctatataatacagctatatatatatatgctatataatacagccatatatatatatatacaagaagagtttgttttaggaatgtaaaaatgattgaatatcagaaaataatgtaatatatcttctcagtgaattaaaggagaatagctgtaggtcatattaatggatgcaggagggaaagcagtgaaattcagcacttgtgagggagtttccttcacctgatgaaaggcatctgtaaaacatctatggcaaacacaaagcttaatgataaaaatctgcttgtgttcaatttaaagataggatcaaggcaaggttgttttttaccacttttaaaaattgtatattgtgttgcaggccataatcactgccatcttaagaattgcaagatgtgtaacgaatggaaagacagggacagaatgtagatgtattgatttgtggaaaatctaagagaacctgcaaactgactatcagaacaaataagagagcacagtgaggtgttgaatacagagtccacatacaaaaaccggtatcagtaatggccaattcaaaaatgtaataggaaaagagactcctttcactgtagcaagcagaactgtcagatatggaggaataaatgcaaccaaagatgtgcaagactttcatggagaaaattgtaaaacataactgaaggatattttaaaatatccagtattgtagaaatattaatttccttcaaattaactcataaattcagtgcagtgtcatgcagggttttttcatggaacttgaagagctgattcttaaattcatcaggaaaagcaaatggtcacaaatatccactggcatcttgaagatcttcgcctagtaggggccatgaagagttactgctgagccacattcattaaggcagcatggtacaggtgcggggttacacacatagatgaccagaacagaaacggatgtagacataaataagtgtttggcgtgacagcagtggcgttactcatcagtgatgaaataatgaactattaaatcatgctggggacaatggattatctacacagaaaaaaaaagagattatggatctccttcatctatatatgaaggatagcatggaacttgtctacatccatttctgttctggtcatctgtgtgtgtaaccctgcacccataccacgctgctttaatcactgtgactctgcagtaacgcttcatggctcctcgggcatgttgccctactatgtgttgttcttcaagactccagtggatatttgtgaccatttgattttcctgatgaatttaagaataagctcttcaagttccatgaaaaaaccctgcgtgacacttcactgaatttatggattagtttgaagaaaactaatatttctataatactgggcactttttaatgtccttcacttatgttttgtaattttctccatgatatacatggatatacataatccttcaatatttatgaaggatatataacctgttataacctgttaaaagcatttgtaaaagtttaaacatttgaaataaaattcacaatatattaatgaccttcggttaagaaagcttttcctgaacattgttaccccagggtcacagtttgaaaactcaaaattaaaacgtaggtttgacaaaaagcatcataaacaaaattaaagcatctgccacagagatttttgcaatgcttctggctgacaaaggataatgtccagagcatataaattcctacagccaaatagtaggtaaaacctaatcaaaaaatggacaaagaacatgaataaacagttaacagcagaaaccatccagtcagctcctaagcatataagatgatatgtggcctctctagtaatcaggtacatgaaagttaaaatgatgactacttcataccaatctggttggcaaaattttaaaacatggtgatacctagggatggtgagaatacagagcaggatgatctcatgcaggtccgggcaggagtgacactaggtccagccacttgagattaagttggctatgtcaggtcaagttgaagaggttcataatgtatgaccagtagtcctacttgtgggtaaataatgcagagaaactttctctgctgtgtaaaaagacagtgtccactgcagcgttgtttctaatggagagaattgataatcagcagaaaagggatgacgtgtggtgtgttcctccctacaatggaaagcagtgtagcagtgagggtgaatgaaacagagctgtgtgtgtcagaacagatgcacctcccaaaaagtgaaaacaccaagtcacagcacagtgccatccctgcaaacttcgaataggtgcagaaaaatgcttggtataatttatgaatacatacatgggtagtttatttaaaatacacatagtaacagtgaagcaccaaattcaagatagtgattgcccctggggaagatgaggattgaggtaagggctgtaattattccctgtcatcctgtcatgtgtcattttatttaaaatttttttaatcaaaggccagtattgcaagatattaagacttggcaagcagagtggtacatggatgcttctataatatctctaaactttatgcgtgaaatatttcactcacataaacacacagtgatgtcagttgctgccaagaggccacaggaggctcattgccttggtaaatttgttgcagtctaagacttgcccctcagctttgcaaacccagaaactttttttttttcttagttttttgcctgcagatgaaaactaggtttgtatctcaggggcagactcaaactcaatttacaaatcgaatgtatccagactgccagtatgataatttgtaaatacatagcacagtaatcaggaccttggaaataccacgaccttgcatgatcctcgtgttgtttgtcctggagtttttccacgggaacctgagccacagcccaaatgcctgctcatagacacgcagttagacgtagctgctgtggagaccagcatttcggagccccattgccagcagatttgctcctacacaggactccagtcctaatcagaacacacaactcccttagagggactccactggaagtgcctgcctccttcagggaggaactgagcatgccccttagcactggatacccagaaagtgcctgtggaggcttggcattgtttataactttccttttttatttttgacagtatctattccccatctcttccgtgatagaatcctgtctttgtgtaggcataaactaatgcttacttaataatcagttaagttgtgtagtattttccttacaaaatccgaattacaagggcagttcagggagatggtgcatattcatctaggagtttttccttcccatgaccctctgtttggtcttcgtggctatctcataagaagtgtggtcttactgttggccacatcccctctctgggccttgtagaggttcttgaactctccttcttaaagagagtttatttaaatatgtttcctcatcttctcccacctttgcatctcctgagcccttcttgcaggcctgggaacccttgtccctttaactgacagtgtattctctacttggagccgctgctgcatgtggacttggaagatgtctcagagcctgtctcatcggctgcctctccaagttgctagagaaagctccactctgacctcccagtcaccattgacacacagctgccaaatgcaaattataagcctgcattcattaaagtgaccttgacagttttcagagtcctttttcacacgtttttatttggtgttcccaataatcaggcaagatcgtcagggccattttcacagatgaggagtgatgttagttgtcacacattacacagtaaccaaggttaccaagggccctttgcaaaaacactaggtcacctggggtgagggtggggcatggcctgcccagggtagagaaggaaacctatttctttgttcctcccaacaccgtgaaacagccttctgtgttattggacagaagctggagcttcccagtccaaagagcttgcgtttggttatttcatcaatgtcttgatcaagcccaggtataacgtctgccctaaagacagagtcattcttctaccctgagagactctctatacaatgtggttgtttagattcaccagttttttccatttccagctaaccaagagttcaggtactgaaagccatctaatctcagagaaatttaaagctaaataaaggattcttaaaacagatctttacatgtccagtttttaaagcctccattttaccgaacaggaagtttgcagaatgatcacattagcaccagagccttggacactcaagtgaacttgagcccacaaagtcagcccgaaaccccgcccactcttctcagagtcactgcttctagcctgcgtcgtctggtagaacaaaccttactgcacactgttcctgccgctgacttcaaataaactgcagtttctactcgattcccaaagaaagctcaagtatgaaagtgcccctggcagccagctcccctgttgagttactatattgggtgttctttcactagttctggagtagtgaagactggttggcagggatatggctctttaaatacaaaatttattctttttctttttaaagacatgtttcaagccgaccccaccttcttggctcaatgtgaggacttattatctaaattcatgtacatacacacactcactctaactctgggatgtaaaatatttcttagtttttactttttatctctctttgccttaaaaaatgggatccctcttaagtttcctgaatgccagttctcagcaaaaatggatgccttatgaatatgtagatgaattttaataaaatgatacgaatgcagcagctctgcgtgttctgaaaaacgtttccagagccccgtgagactttcaaatgctcctgggagatgaggcttcctgcagagaaaaggaaaccgagagaataggacatgattggatcggttccgtttactatgatgtagcatgaaaaaatgctgccttatgtctctttttaaattctcctatagctgcataagctcatgttcagtaagtcattcaacctaggtctgctcgtctcagcaattcccgctgtgttaagtgggacctaattgcagaggatagctgcctcctaacgcggagtccttatttcattagcattacagattgggttcttgggaaggacattctttggtaatttgtttacagatgaagtcttgcagattctcacttccttaatctaacaatctgctaattcttaaaattggaaaaaagaaagaaaaaccagcctgtcagtctacttgtcaggaaagacttagatgtcaggagctctaatgaggtgcgatattaattcctgcctgcttttttcccccagacaaccgtgaacagtttccccccaaaaactagtatattatgcaatttctcatgattaattaaaacaataactataataaaagaagcccattttgtgattctgacctaattgctttttaattgcactgcttttcatgtttattttcaaaattcacttctctgaagtagtcacgagggaaaacgagtgtctgttgagcactttctctgaaggtgcggccattgctgtgaaattgctggtcattgtttggcagctgctagaccatccactttagttcttaactccttaaatgtttttagcgatggctgagttccaaatatatatatttttaatctatctccttcgtccactgatttcccatctgagatattatctctaattttgggggcagataattcatggctctggcaaacaatattaagagctacagtgggcttatattagggccaggcacagtggctcacgcctgtaatcccaacactttgggaggccaaggcaggcagatcacgaggtcaggagttcgagaccagcctggccaacatggtgaaaccacgtctctactaaaaatacaaaaattagccaggcatggtgatgggcacctgtagtcccagctactcgggaggctgaggcaggagaatcgcttgaacccgggaggcggaggttgcaatgatccgagattgtgcctctgcactccagcctgggtgacaagagcaagactccgtctcaaaagaaaaaaaaacctacagaataatttttttttaatgtattggtcccctggaaggcataagagtgaagggaatgtttccctccccatctgaaggtttgaatctttatgtcagctgaaataaactgacaatagattaataaatttgttattaatgtgcaaatgtgcacaggagccacacaaaatatgagactcaaagaagggccagatggttgaagcttaaatactctctgcataggggagaggcaagtgagggatgtaggcaattttagaagagtaaatgatgtttaggggagatgattaggatggaaatgcagacaatagccgggaacaaatttcctccacagggtctcggggaggtggcaacaagttatgggaaggcgaggggcagaactctattgtgaacagaggttattttatcatgcagataaatctctcaggtgacagcctttagaagaataattgaaagaatacgtgaaaaggctctccaagagtggggtcttggtgtgggcttttagtttcttctgctatatgagttaatctctggttaatgtagattccagagagggggtccaagacaattgcacatcttctggatgaacttccctcagtcagataagagaacttgagacaaagtccctccctgtgcttctgaagggaagttggagggggtggggaggagaaggtcagagagagaccttggttctgaggcttatttctgaggtctgtgaatctccttctttcaaagcactcagcatgccaaagcaatataatttggggtatcattttcggagccccagcaaagattttctgctgcttcaattccggtgccagtgtgtttaactgctagagttgcaggaacattgtgcagataataaatgccagcatggaggaaaccttggcatgggacagacaaacaggcccctcttgccgcctcacaggcaagactgttcatcctcaagaccacggggcatcaacatcaccatttaagaaccatttttctgaaaccaaagcctcttttccaagctggtatcagtagtattaccaatttagtaactctgaatggagtcaaaccagaaattaagtgtttctagaagtcctcgtgggctgtcagtcctgcccaggtgtgttgttctctcaggattctctgggaacattgctctgtactaggatgctcttaggtctgtagaccctgctttgaagggttcctcctgatgggttctgctgagcccggtaaacctttactgcttatttctagtatatgatactttagcatcttccacctatagctatcagctattttttaaaacagctattctgactgagcacagtggctcatgccggtaatcctagcacttcagaaagctgaggtgggaggattgcttgaagccaggatttcgagaccagcctgagcaacagagtgagacccccatctctacaaaaaataaaaaaaaatagctggatgtggtggcacacctgtaatcccagctacttgggaggctgaggtaggagcatcacttgagcccaggagttcaaggctgcagggagctatgaacatgccactgcactctaggatgggtgacagagttggaccctgtctcaaaaaaaaaaaaaaaaaaaaaaaagctacttactgttcttctagtcttgtgtctgtctgtagagcccaaatttgagaggtgccatgttgaaatctgcacctgctttgtaggtctggcctctgaatcagcttctgtgcagaggtgatcccagggttcttccctactgctggaagaggagagctcaggcaggctcagggtcccattgactgtaccctcactccatctccccatcttcatctcaccactgccctttggggtatttggggatggccttccagggcaagggacatgcatccctgctgtcccaggaagggaaaacctccagtgggtctgctgttcgtggtgagaaccaagttccaaatatcaccggagtaccacatgcttgttgtaggcaatgtagaaaacaagaaaagagcagtggcgcacagttggttctgcccttcggaaattacgactgcaaattgtgaaaagcgcatctctagaggtgtatctgcttgagagtagaaatgggatttcactgttttaaaacacttttttttaacgtgttagaaagatgttctcaatatgttactttttgccgaaatcgttcatctctcagaacgtaactccggttgtgtttttctgtttccttatgtcccgttggcagttcatctcagaacaggccaggaacttctgcagataacaagttaatcatagcatgtccatcccagttggtcagtctgcctgttctctgaagggctaaacaagctgtggctgctctgggggtcattgttcagaggaccatctttctcttcctgcaggtgtcagcggaagcagtggcgggtggatctgccggccaccagcgtggtgatcacgtttcacaatgaagccaggtcggccctactcaggaccgtggtcaggtgaggccaggagatgcattacctatcaggggtgttaagacattagctgtgtcccaggcacagtcagaccagggctgtcagtgggggctgcagacagggtctcctgactgctcagcacagggtgcagtgtgtagctcctccaaccaagggttaggaccaacatatgagaattttctaccccaggctaaaagtttatacccctaaaagacctataaactttatcttcttgtcttttcttagcgtgcttaagaaaagcccgccccatctcataaaagaaatcatcttggtggatgactacagcaatgatcgtgagtactgacactgattttatccctgtgtctggctcttctctgggcaccagtcttcctgtagtgggggtgctaatgaggcgtgaacaagccagaaatcagatccacagaaagaagaggtgcctctgtgatgccccaaggagataatcggcccttagatgattgagaatactatggttgaatgcaaagccctttatgaactccaggttcaaaatgctctgcttcttttcttttcctagctgaggacggggctctcttggggaaaattgagaaagtgcgagttcttagaaatgatcgacgagaaggtaagattcttcttaattcagcgccaagacagttgaattctgacttttcctgtaataacataaagaagtgctttagctcaaagagcaattaattgtctagcttttttctgtctccctctaccagagccgcttgggagacttctcccagcaaacacaggaaagacattaaaagcttgactaattgaaattattagtatattagagcaggatcaaattacattttcatttatgtatttagaaaattggcttctttctttcacaacctaggaagtcttatcagtcccttgaatacaaaagtttagaagaaaaacaaagatttagcaataagaagttgaatgactccatgctccaggcatctgataaaataaccgggattcaagtttgacagcctgctgaaggtgaaccatccaaaatggggagacagtactgcaattatatgctcatgcgattttgcaaatgccaacctcggaaccttctgtcagtcttatctgtgctggagctgagctcatgaggactcttttattggcagttagaagagaggctgtaaaggaggaaagtagtacactggagtgtctgggaaggaagctccaatcacaatgtaattaacatccagtgtgtcagtgctgttagagaccctgaagactgaattgttaggctcctccatggttgggagaaatctttcagtataggaaaatcacagagctttggaacccatgccacatttgctatttaagtctgactgttgatccaggggtggtgattgtattccttcatcagtgtaaaactctttcttctcattacatatgcactccagctggagtcaaggagtgaagtttttcttaccaggaatcttattggccaacacagtgattgagcctgttagaacagcatcatattttaaccaactagggtcatcaacctagacattcaagatacataaacagtgggataagccttgccttctaaacaagctgtttgccagactcacatcagtccaccaagcctggaataaaccaaaaagggggcaatttgctgccccctaaacaccttcaaaataactttatgaatttaaacccaaagtatctgccatcctaccccatcacctggcacaggctttaaaaaaaaaaaaaaagagaagtggggaaggaggaaagagagatagtgttggcactgtaaatcacttatgagccttatctaacagtgtctttgtctttaaactgcttagaaatcagaacaatgcttctcagtattaactttccgctagaatgttcatttcggttgaacccgtgctgatacgttgtttcggggaaggcatgagaagggtgggttgggagaagccagattatggaaagcctatatggaacagctgaagtctgtaacaattgaatgagaaaatatgtgcacacttgcacacacactcatgtatatatgtacccatgtgtgtgtataagatcccatctatgtaagcatacacacaaagtgcttgtagtgatgctactagatgacaaagtaaattaattgcctaaaatattatggtagtgaaagcagtcttaggatcattcttctgtggattttattgtgcattgattcttaacctagcaatttattagaagcacctagggaatttaggaccatgtcttgccctcattcacaattaaatagaaatttctggatttctctgggtggggtgtgggcagctgcatttttaaaagctgctaaaatgatgccgatgtacagtggaagttgagagcctagtactttcattttacagatggaaatactaaatctaaagaggctaggtggccttctcaaggcccttacagctatttaatgacaatagtaggaccaaaaccatgttaataatgagataaatctttttctctgcatttgtggagatagtcaagtggtatttctttttttaatctgttaatatggtgaaatacattggttgattttcagatgttaaaccagctttgcattcctagcataagccccagttggtcatgatacagtatccttttaatatatttttgttaaggatttttatacctgtgttcatgggaaacattggtctgtaattttcttaaaatgtatttttccagttttggcattatggtttactagccttataaaacaagatggaaagtgtgcccttctattttattttctaaaagagtttgtataatattttaattatttcttttttaaatgtttaatagaattagccagtctggaccaagaattttctttatggaaagatttttgataactaattcaatctctttaatggatataggcgtattcagatctgctgtttctttttgtgtctgtttcaagaaattttgtattttatcaacgtttttatatttattggctcaaagttgcttatgatattgtctctttttttactgtttgtcggattagtattactattttattgattttggtaatttatatcttcttattttctttatctgtctgctgttcatcgacgctgttcattttttaaaagaaccaatatttggcttttgtattaggattctccaaaaggacagaactaataggatagatgtatatataaacaggagtttattaaggaatattgactcacacaatcacaaggtgaagccccacaataggccatctgcagccgaggagcagggaagccagtccaagtcccaaaacctcaaaagtggggaagctgacagttcagccttcagtcagtggttgaatgtccaatagtcccaaagctgaagaacttggagtccaatgttcaagggcaggaagcatccagcgtggaagaaagatgtaggccgggggagaccaagccagtccagtctctctacatccttctgtctgcttttattctggccgtgctggcagctgattagattgtgcccacccagattgagggtagttcatttacatgtggcgtaatcattggtgtgactaggtttgggtctgctcttcggctgtttcttctctatttgtaccatgtgcattttgctttttgtaactgtgttcctgctttcttgccttcttttggattcaatgatttttttagtattccatttgaattattcttgtagcttttcagcaatacttttcatgtatgcacagttgccctgagaattacaacatacagctctaacttacaacagtctgcttaagagtcaacatcataccactttaaatttaagaattttacaatagttaaattgcatttccatttcccttcctatgtactatcgttatcatgcttttcttctacatacatcttaaaccccacaatacactgttacatttttacttcaaatagtcagtatctattaaataaagagaagaatatgtggatatgttaagcttatcctcatattttccatttgtagtatctttgtttctttccatagattggagtttttatttagcccgaataattttctttagaattttttctcataggcagcacaatctcaggttttatctgaagaatttttttctcctttgttattggaggctattttctttcagtggaatctgagttgacaattaatttttctttcagcactttaaaggtttcactccaggcagggcacagtggctcacgcctgtaatcccagcactttgggaggccgaggtgggcggatcacgaggtcaggagtttgagaccagcctggccaacatggtgaaaccccgtctttactaaaaatacgaaaattagccgggcatggtggcatgcgcctgtagtcccagctactcgggagactgaggcagaagactcgcttgaacatgggaggcggaggttgcagtgagccaatattgtgccactgcactccagcttgagtgacagggtgagactctgtctcagaaaattcatactgttgttcctttgtatgttatgggtcatttcctctggctgctttttgtctctatatctgtttttttttttttaacaatttgattatgatgtgcctagatttagttttctttatatttatcctgcttcaagtttgctgatgtaaattgaatatgtaagatgatgttttccaccaagtttgggaaatgactggccttttatttcttcatgtatttttttctgactcattcttgaacttcagttgcacatatgttataccacttgttattgtcctatagatgactagacttttcccccttaattttttctctgtccaccagatggatctatttctgttgttccatcttcaagttcactagtcattctgccatctccattttgctactaagaccagtcagtggatttttcatttcagataatttcatttttaagttctggaatacccatttgattcttttttatagtttttatttctctgctcagattccccacccattcactcattaaaattgttgcctttgagttattaaacatatttataatagctgcttttaaatcctcccctgctaattccaacctctgggtcatctcagggtgaacttctgatgactttttttctctttgatgtggtctccattttcctgtttcttctcatgtgtagtggttttttattttataattgacattgtggatgatatgttgtagaaacactggattatgttatctttctctaaagagtattcatctttgttatattgggcagttaaattaccagatgatgatgctgaacttctgtaggctctttttgtactttgctaggatgagtatggtttttttttttcgtttgtttgtttgtttgtttgtgacagcgtttctctcttgttgctcaggctggagtgcagtggtgtgatctcagcccactgcaacctctgcctcctgggttcaagcaattctcctacctcagcctgccgagtagctgggattacaggcgcacgccaccacgcctggctaattttttgtatttttaatagaaacgggtttcaccatgttagctaggctggtcttgaactcctgacctcaggtgatctgcccacctcagcctcccaaagtgctgggattacaggcgtgagccaccacgcccggccatgagtttgtttttatgagtcccttattcttgatacatagtctatattcctatgtgtggtctttctgaagttcctgtagaagaactgagatctttaccaagcatgtcacacttggcagaactcaaattccaaactttgttttctctgcagtagatagcagctgaaactcagttttttctgccttcttaactgttgcttttcatgttggacttggttcctgtgtggttcagaagtcagccaaagatttaacaggaggttattgccagatttgggtcctacctcctttccaggatctccttcagtttccagataccagaagctctgaactctctatcctctaacaactcaagccaaaaaaggctacattgcagtggattggagcgcatcctcgtggaaaacgccgtataaacacggagcttactcagtgttattttcttattttaaggggttggatcctatctagtttctgtctgcttctggctttcaaattgctgctttttatattttgctcagagtttataattgttactggagcaaaggtttgccccatacaagttgttttgcaattatcacaacttaaaatctttagtctttttccctgttctagcatacagccacataggaatcactgaaaacccattttgactgtggaaaaaagtacttagcagacttgtcctcaccggttatgaatagttgcatcatcttcacatagaaagcccagcatatatagcaaaagccatttatgaccacaacatccagggataaatatactattatttattttattttattttttatttattttgagacagggactcactcttatcacccaggctggagtgcagtggcgcaatcatggctcacttcccaggctccagtgatcctcccacctcagcctcccgagcagctagaaccacaggcgcacgcacaggccaccacccacggctgatttttgaaatacactatttgtattttgtgtcataatgaacgtgcacattattaacacatcacaagtatataaattgtagaatttgaccaatagtataactaattttgtgtaaaaggcagacagcagggctttgcaacttatgttatttagctcctgataagtcttagaagacagagatagtcacaacactgttgcaaatattatcaccactaaaatcaacaccattagcactggaagtctttgggtgacaccttccttagcccagttagttagaaaactgctgctgtgtcagaggaatgtagttataaaagttccacattttggttagttgataaaggagacttcagtaatgtaaagggcctttctcagaagacggtagttctaagaacgttgtcctcccagtcatccaatataactattaaaattaaaagttctgacaatagtctgtctcatggagcagttttgatctcatccagcaagtttacagtaatgtccgtgcccagaaagcaggctgcagagctgcgggcagggaggcgtcgccggttggcatggggttgtgctggccctgtggcttctctctcctgacgtgctttccaactcgcctctgcaggcctcatgcgctcacgggttcggggggccgatgctgcccaagccaaggtcctgaccttcctggacagtcactgcgagtgtaatgagcactggctggagcccctcctggaaagggtggcggaggtgagatgacgggggctgggaggggtgtcaggtcgtgggtggttggtagaggggacagaagggagcatggtccaggggaggtgtaacgcagggagtagggcgtcagggctggtaggggctgagctcgccgtctgcagttttccttgatagaaggaaaatgcctttggggcattgtagaaagactgttttactggctgtaggaatccatcagtaggaggaaccatccgttgacaggtaggaggcgaggatcagcagaggctggtgagagcctgattagttgaaggcagcccttttcatgggagcagtttccttccccgcctacagcttcgcagagtgcttagaacattgcccggcacctagcaagtgccatctcttgcagctcgcagagcggggcgtgctggggaagctgtccctggggccacctctctgctcttagtgagtagggcaggttagcccagcaggcttccaggctcctgtgggagagggttgtggctaggaagcatacagggaccggtggggttgtcagagggtgatccgcggctccacttctgcaccttctgctttctagaaacatcattgctaatattacatttggccttttttcacttctctcgccttctgcttgttttattgacttttctttccttcctactaagaaagcacttccttgggggcgataaagcaaacttaatgaaaggaaatagaaaatgaacaagtagttctgcctaagcatagcaaggatagctgatgggctgtgagtcatggaatactaagtaaccacaagctactaggaattatgaagatcatattcattaccctttatcaagttggggctaggccttttttatatgttacctgtaatgcacttgttatctccgtttgacaggtaaacaggctggggttcagggaactttaataatgcacgcaaaatcatacaggtagcagagccaggcttgcaaagccagtttcattaaatccctatctgagcccctctcttaacacatgtgcatacagctatatccaagaagaacccaccctggaatccccacccaccccaaccccacaacttcttgctctccctggctacgctccgccaggctgtctctcagggaagcgcagtcaaaaccaaaactgccatggcagtgtttgggtgtgcgaaggtcaccgagctcagtggtcagattgtcagaactgcttcgaacgcctgctcctaaattaaggagagaaagtgccaagcctattaactttcactaaattgagccttatgaaacaaaatgtaaagtagattatatcctttaactcatacacctagaaccagactgagccaggcaaggaaagttgtgttcttctctgccctcaatgcaccacacagcctacttttccctgtagatttgcacctgggtgttacagagctttgcagtgtttgcgtgttcctaattagcatgttccttcacctgttcctctgatgtagtatgttcttagctctgctggttctgttactaagttgtatttctaaatctttcttctggctaataagggttctctaagtggctcagggaaaacacttgctctttggttaactgtcagcatggggcacagtccagggtctctcaccagcatccgtcatttgagcttaaagaggttagagatgttaaaaggccttatgttcacaaactcttaccagaatgatggcaatgtggcataaagacatggctcaatctagggggattttttttttttaatagaatcacaggggctggacgcagtggctcacgcctgtaatcccagcactttgggaggccgaggcaggcagatcacctgaggtcagaagttcaagaatagcctgaccaacatggagaaatcccatctctactaaaaatacaaaaattagctgggcgtggtggtgcatatctgtaatcccagctgcttgggaggctgaggcagtagaatcacttgaacccgcgaggcggcggttgtggtgagccaagatcacgccattgcactccagcctgggcaacaagagtgaaactccgtctcaaaaaaaaaacaaaacaaaaaaacaaaaaagatagaattacagatgaggcaaacgtagaatctggaaatctctggttgatttggttaaccttctgctgtgataatattgatacttaccacatctctctcacacacacacactcccacatagaaatatattcctaattttgatgtatgagcattttagcagtgactccattcctgaagtttactgcagctcacaaatcactaatggtatttgggcaaacagaaaaggacccttgggacacagcaacacagtttttgcctttagctgggtgaactgatggctacctgtcccataaccatgggtgtctccactcctagagtgactcctgctacgcacccactcctgacctccctccctgcctcccagcaggccacagcacatctgtggatggccaagagcaagaccttctgggtctgggtggggaggctgggttcttgagggcctagggtagtaggtagtaagggccagttgggtttgccctgtgcctgcctaatactaatgccttctgtggttgggcaggttttttgttttgctgggattttgataactactcctctctttgtattttaggacaggactcgggttgtgtcacccatcatcgatgtcattaatatggacaactttcagtatgtgggggcatctgctgacttgaagggcggtaggtgtctgtcatggtgcccctgcctagctcgtcccgtctacaccagcatctgatcaccactccctctcattgtcaggagtgacagtgacaacagtgttcacgccgtagtgtgtgttctgagtaaaaaccacctgtgtgcttaacgagtaggacttcataaagagaaaaaaaaataggcttgctcccttaaagagcttcctgggtttccctttctcctcttccttgaccttctgtcacttttgcgagccatgtggttccatgaacagatatggcgtcctttatgaccagagatgatgaagccctccttgcaggaatctggggtgagaagcttcacggagctgaggctttgtgggattcaaggggctggagcctgtctttgccttctctgctcaccctggctatttctctgacagcctggtctctttctggttgctcagatggagacctgtgtcatcctcaaccccctcgccctcaccaagcccacgtgtgaccctgttctgctgatacagccccttgcatgtatcatggtttcttgtacccctctttcccagcccaacacctgtgcctacatcaccctggtccccttccgttggaatgaccacaccagtttcctgtatgtcctcaccgcacccaccctggagccccaagagcactttgtctgtttaccctcttaaaaattatcaaagacctcaaagagctttcatctgtgtgaagatgaactattctagatagacactgggcagagggttaactgatggtctaacatcaaaaaagaagacagtaaaactataaaatagggccttgaccaggtgcagtggctcacgcttataatcccagcactttggggaggctaaggtgggaggattgcttgagcccaggagttcaagaccagcctgggcaacataacaagactcttgtctctattaaaaaaaaaagaaaaaattagctgcgtgtgatggcatgccagctactcggggctaaggtgggaggatcacttgagcctgggaggtcaaggctgcagtgagccacgatcaaccctgggagacagagtgagaccctgcttattcatacacacacacatatgtgtgcaagcaagccttaaccccagaaaacagaatacttggactttttagggagactcagccacggtcctagacattgtgggctttggccccacctgcctcttgcaggccccgtcatcatgggcaggccattttgcctctgcttctcagcttccccctctgggaaatgggatgataattgtgctggccacacagggcataatggaattagacatcagcgggagggcgggcatgcttggaggactgtacctagggtgggaaacataacattcaggaacgattcccagcaaatggtgagaagtaaaatgtttggggacattaaagaggagggatccttagatagctagaaagcctggctttcagaatgttgtatttccccaagtattcgaagagctgagatctaccaggctctatttctcccaaagcagctgcgtatgtcagagcaggggcaagaacagccaggtgttccgtgtgggggtgcaggtcttctgggtcagaggaacggggccacgttcaccctaagagcattttatgaaattcctttagaaaaaaaatcaaggatgccattcttaacagatctttaatctgctatagcctctctctttggaccaaattaataaaataaataataagataatagtaaacatcaaaaaaacaaaggaaaggttatgtcagctaatccttaaccttctctgttagtgaaacagccaggacattgtttttctggttttccttcgtggcctttgaggcaccatgataagagccagctcaggggcccgcaggggtctcctctctgtgcatttctgtccccactgcctgggcccctgtccatttccctctctctttgcctgaggccactctatcctgcagtgagggagctgggaggcctctttgtccagagccataaattcttggccagcccaggacactcagaaaccctcacccgccatccttcagtcactggggctgtcagggcggacagactatgaattcaaagcatgcagacaaatccaaacttaggcattgcaaaagccctgttgacaaaaagcctgatggcagagagcttaagaggattgaaagatgcatgccctagagtcattaggttttgctgtcagacccttggaattggaaatgcagcaccatgagccatgtgtttgccaagaagtggcctcctgatgcaccaggacagcttccgcaggtggggcctgctggcctccaagaggcactatgtgtgtgaccctgggagcaagagcgagacctgaggccctgcagatgcccacaaccaagtccgggtacagggtctaggctcttctatcctcaggggtctgtggattccaaaaatgaaatgcaacaggtgccaaatatatctgaaattgaagcttatttgcccagcttggcaacttccgctggctcattttcccttaaagttttcatattcccagcatgttcccactccattcttgctgcaaatacagtctgaagtttgctggcccagggaactgacaaagcctcgttccctccccagcattgccttcccctggggcagtgttggaggtaccacggcttgattttcatgttggatgctctttttcctcacatccttacagcccttggacatgccctggttatcaccacacagaccccagttctctccccatatttcattttttcctatgcatttcaatattagaaaagcctgactcacattttctttagggaggggcagggagaagatttcaacattcaccctcactgccggtctctctcttcagctacacccacgcccccagtccccttctctctcctccacaccttcttttttggctttgttttggttttcattgagttctgtccaaacatcgaatatttttaagctgtgaggaatgggggtgtcgggaggaagtggccagtctcttgtcaacaccctgtttcttttcctggctggcaggttttgattggaacttggtattcaagtgggattacatgacgcctgagcagagaaggtcccggcaggggaacccagtcgcccctataaagtaagtgccagcatccttcagggtgcccctcccagatgagaccccaggttccagcttctttgctgggcccgcaccgcctggagacccagtgggggctgttcaccttctgccctccggtttcccctcgtctcagctcaaagatgagcaccttccaccaggtcatagaataaaatccttggagatttcttttccacagttgaagtctcacataggtttataaggcctatctgctaggtctgtgcattcctgtatgttgataatgtagagcgtttctgtagcagagcaggatctccgagctgaccccaggcccaggaaaaggggcttggtgggcagcaggaggcttactgctgctactgcccagcaggcctttgctctcctgcagaggaaggagcccatgctcatgaagcccatgctttaagattcccaggccgggcggtgggctttctggttgagagtcaggatgccttctctagctggggagagaagggggccacctcttccaagttggcacacggttaagtgagatagcattcacagagtacttagcgctgaaatatatttgctgacatttagccaacatctgcagtgtgccatagaccttcccagcactttacactgaattcgcacagcatcgcttctgggaacaaagtagggagctcagtgtacatctgttgtcaaccccttcctgggatgatgaagtgaggagcatggtgggttcccttgtaggaggtggagtctcatctatgatagtgataatgagagctggtgctgtggagcatttcctaagcgtgctcagggctttatgcccatgattttttgcaatcctcgtagctaccctataaggaaactgacacacagaaaggccgagttctttgcctatggcagcatgtcagtgagtagtgatccagccccagcagtcgctcccacataggggaggctcagtccagcccctggcactgtgggaacatccaggcagggacagtgggggaggcatttgaaggcagcagtggtgaagcagagagagtggcatgctgggcactgagcagaaaacagtggcagtgtggctgttctgaagatcagcttattgttagggaatcaaggcttggccttggcgcaagggtgctggcaatctaaccttgactttgccctctcctccctcccccctcttctttctgcctctttagaacccccatgattgctggtgggctgtttgtgatggataagttctattttgaagaactggggaagtacgacatgatgatggatgtgtggggaggagagaacctaggtatgtacaagcctcaaatctcaggacagagaagtgcctcagctctgcaaaaggcagggtgccaattggaaaaaaaatttaaaaggcttcagagtgaccattcactgggcttaatcgatccttgcaaacacatatgtaacaccccttttgctcttgaaagtctcatgagttgggcattaaaatgtgcctccctaggttagagtggaggatgccagaatacggataaagtctttgaagggaaatgcaaactctttcaaggcgtctgaacccaagtgtttggaatgttgcaggcttgcaaaaacagagggaaacagtccaggagctcagattcatgctgagtggtggagagtggaaaatgaaccccggcgaggctggtgggattgattgaattgaaatcatgaaaatccgatggggcagggaggccttggcacttaatcccttctcgactacctttgcgaatggttctcatttgtttttctgtttgtttgtttttttgtttttaaataccccatgcaaattatttttacccaggtttaggcacagcaaaattttgcacattgtggtctatattggtagccttatatttactgcataaaagatgaaaagatgtgttttgtttgtttagggtttggagtgggggagatcttttttgcttgtttcaattaaagccttttgtttcaaatgcttgacattctgagcgaattctcctgggctgctgagtgttgttaacttacattcgtccttgggtgagtgtaccctggaggacaggggagaaggaaaggggaaaatgaggccactcatttttaatagttttgagactttgaaagtttttgttactttaaaagaaaagactagcctagcctattatttttccattgttttatgatgttgaagtcagtgataccatctcatctttgaggatttctctgccttggtttgatgttgaaagcttctttaggctcgattactatactgcacgggtggagagaccgtgagtcaaactccttttgggttgttttaaaaaaatgatacattaacctctagggaaagcttggattgaagtcacttgagtacaaaaggcttcagaattgttaaccctctaaagagagttctgtcaccctgttccatgggtatcccctaatggtttagtggaaatccagcaggccagggtcgcccagtagggcagcgtatcgtgtaggtggccatttctcaaaaacagtgtggttttcagaagtttgcatactattagctgaaatgagacatcagccagcattttgtgtcatcgtgtaggaagagtgttgatttacatatctaaggaggcattcacccagagactggggggtagatttgttgtaaggagctgctttattgtggtttggtgtttgtatttattatgtagctgtgcctagaaggttctagggtctgagcggttcaggttggggtgaagatgaaccctgcaagcaggagcacatctctgcccaggaaggctggggcatctgtccctccgtgaggggctctcctgggttatgccaaggacttggactcccagtgaggtttggagggctcaagagcttcacgtgagaaggccatgccgtgagcctttctccttagcactgctctagcttctgcttctgggggccgtgcacactactagccattgccaacctgaggggcctctgtgggtgtgcattgggagaggtgtatggtgcagagaggcccgagtaagatccaaaaccacctcctcaacgtgtgccccgctggaatgaccagagcttcccattttcctaatcatgtaagtccttatgtcatttaagcaattaaaatggaggaccaagaacctaacccttaactctaacaatgggggtaaggctccttgggggcatcatctgtgtttctctacatccctgtcatgcaaggatgatgctaagtacttccagggaatcatctgtttgtgctttcttaacggagtgtggtctgcagaggtcatgacaccttgcccagggtctcagaaccaagatgtaaacactaactgcctaattaaaaagccattgagttttactgagtaattatcctcaaagttatagggttcaaatgaaatcaacgctgaagatactgtagttatacttagccttgaaaatctcccacaaaagccctggaaggatcccttgttggcttaacagattccccatagagaagccaaggggatttcctagcccctaattctaaatcttgtggtgaggcaaatggatatttaaattttattttctgaaatagagacaacttcttttttttttttttttttttttgagatggagtctcgctctgtcaccaggctggagtccagtggcacattcttggctcaccgcaacgttcgcctcccgggttcaagtgattctcctgcctcagcctcccaagtaactgggattacaggcatgtgccaccgtgcccggctaattttttgtatttttagtagagacagggtttctccatgttggtcaggctggtctcaaactcccaacctcaggtgatccgcctgcctcggcctcccaaagtgttgggattacaggcatgagccactgcgcccagccgacaacttcttaggttgtgttgggaactgtaaaaagtaaagtcggaaactttcactgcttatgcttatgtgattgtaaccatacattttctattagtacaagagagttgcttattaaagccccgtaacagctgcatggatcacccattcctagtgagtgaggcattagtttgctggacccaagtagaaactcatggtgttctgacccctgtgttgtatttcctgccatgtgcctggcattctgggcacctgttgccataactaggttgactgcctgcaggatttgccatcaactcactgtatggtctgtgatggacccaccctatttctgatcaatctgcattggtgacagtgactgcacactctgtagatactatatgtgtatatttttacttcttttaatttgttaattgacagataataattgtgcatattcatgggatacatagtgatgtttttaatacatataatgtatggtgatcagatcaaggaaattagcatatccatcatctcaaacatgtagcatgtttttgtgttgggaacattcagtatcctcctcctggttatttgaaactctgtatatattatgggtccctagagtcaccctaccgggctgtagaacacaagcaagatccctcttctctagctataattttgtatccttgaaaaaatccctactccttccttcccagcctttactatcctccgttatactttttacttctatgagatcagtgttttttagcttccatgtatgggtgaaaacatggtattcaactttctgttcttacttcacttaatttcctgggaatactatccagccagaaaaaaaaaatgaagtcctgtcattcacagtaactgttgatttttgtcctgcctccctaacatgttcttagggatcttagataatacagaggaaaattcccttttgtattatacaaaccttgtaaagaaaaactgttttttgcctttcagaaaattcttagtttttttgttgaatctgtttcttgcattcagtcggacccctgactcagactccagtcactcacctagtcagtggtgataagggcaggtacctggttggaaggtacctgtgtgtcacaaaaggcgcaccagtcagtctaagcttcgactgagttccaatgctcagggcagtctgtgtgtttaagtaggtgtgggtagtgcctagacctacacatctcattcctcctgccggtcagttctgtgttgaagcaagtcaacagcagccttccccagggagcattcctacctgggccagctggttactgactggtccaagcctgtgagcagcgtgcagatatcaatcagttacttgactgtccttggtcactaccatagtccataaggcagtccctaagtccatagtccgtaagtccaaactctgcctggagacttgagcctgctaatacacagggacttgtatttaataaacttttccatttgagggaagggattatttttccctggatgagaaaagccaagatgcatcctggggttcagtctgttaaaaataagttttagagaaagatggcatatatggttgtctagaatatgtaacaataaagcttaattgtacatatttatataccttcagtgttgccttttcccacggtgttgatacgaagcaagtgcaaatgatcgtgagccagctagtgaagaattcagcacaagtgttttgtcactcagtagttacgatgatactggggtatacatgatcttatgccaagaggcctttatatttacagtagaccaagaagcattcttgtctcaaggtgtctactccacatctgaaaaatatttccccgtgaacattttttcttgattgtattgtggtccagagatccaagtgtgtcaaatgtctctcctttagagagttctgcatcaggttctggaaggaggaaggtccttatcagatctccttcagcagcagagggcatgggagccccatgatgggatggtcagggggcctctgtacctgcttggtgtgtctgctgttgcagaggtgcgtcccaggctctgtcagtcacctgtgtcttgttcatcgtctcagagatctcgttccgcgtgtggcagtgtggtggcagcctggagatcatcccgtgcagccgtgtgggacacgtgttccggaagcagcacccctacacgttcccgggtggcagtggcactgtctttgcccggtaagtagtgaaaggctgagcggggtccaaaacattgatgactaccctgaaagcaggacctgaccttgggctgtttgaggacagatgtccttcagtgggtgtggtgcatttatacaatggaataccacttagcaattgaaaggcgcattccacggatgcaggatacaacctgggcgcctttccagggcatgatgctgagtgagagaagcagttacatacatgattccactcatgtcacagcctcataaaaacacagctttagggatggggccagaccagtggtggccaggagctgtgatggcaggaaagcggggagtgtgactgcagaggggcagcaccagggatgtttggaggagggacggagctgttctgtctcctggttgtggtggtagttggacaaatcttcatgagtgtgaaggctcttagaactgtacaccaccccccaaaatgttatgggaaaattttttaaagaagaaagttcattttataaccattcaaggtgcaattaaaagcaacattgtcttagtccattttatgcgtctctaaccaaataccacagactgggtaatttaaaatgaacagaaatttatctactcatagttctggaggctgagaagtccaagatcaaggtgctggtgtctggcgagggtcttcttgatgtgtcatcacatggtgggagggcaaagagagggcaggaaagagcaagagggggccaaattctcccttttataatagcatcaatcccccccatgagagtggagccctcatggcatagtcacttcttaaaggtcacctcttaaaggcctcacctcggctgggcatggtggctcatgtctgtaatcccagcgttgcgggaggccgagatgggcagatcacctgagtttgggcagatcaggagtttgagaccagcctggccaacatggaaaccgcatctctactaaaaatacaaaaattaaccgggcatagtggcaggcgcctataatcccagctactcgggaggctgaggcaggaaaatcgcttgaactcgggaggtggagtttgcagtgggccaagatcgtgcctctgcactccaacctgggcaacagagcgagactctgtctcaaaaaaaaaaaaaaagcctcacctcttaatactgttataatggcaattaaagtttaacatgagttttggagggaacaaacattcaaaccatagcaaatattaaagtcaagctgtactaattgtgtataccacaagacatcgtgacacagagtcacgattcttgatggagagtagatatattttagtaaacatgaagatgccaacggaagggctttccgaaagtaaaatagcaaatagccgttctatcaagccaagtgtccttctagggaattctcttacatgctaaagatagaacagcgtacaagccagatctcagggagattgccttctcttgagtgtagacagcaaaacacacagctaaataaggtattttcaaatagtaatcaatgctgtgaagaaggtaagatgcagtcatgtggtcgggcatgattaggacaagcagtaggagaggttttcatggtcaagagaacctttgaggaggtgttatgtgagttcagacttgaaaggtgggaggaggtccctctgggaccccgaggaatcagactacctgcaggaggagcagatccaggctgctgaggtgcgtttggcatatcagccaaatggaagccaagggtagctggaacctagagagtaaggggacagtgcacaggggcagaagagctagacaggcccgggccatgcacctttgcaggtcatgggaaacgttggatgttatttgattctgaaggaaaacactggggcttttcagcagtgcctgatgtctgttttatgctttggaaaggtccgtatggttgctgggcagagggtggccaggtggtgaccctatggtgaaacaatggtacgagtgccccctccactcttggagccagaagcaagggtcctgtgagcactgttgcagtagcccaggccagagatgtgatacagtcatgcacctgtaacagcgtttcggtcggtgacagtagtcccataagattataataccgtgtgtttactctaccttttctttgtttagatacacaaatacttaccattgtgttacagtttcctccagtgttcaggacagtcatgtgctctacacgtttgtagcctagaagcaataggctgtaccatgtagcctaggtgtatattaaggatacaccatctaggtttgtgtaaatatactctatgatgttcacacaacgacaacatcgcctaaggatgcatttttcaggttgtatccctctcattaagcagcacctggctgtacctggagcaggtgtgtagcagtggagatggggtgagatccagctccatggtgaagcaggcagctgtttgctaatagggcggcagagagaagggaggtagagcgggaaattaatttagggtgatgcccaggagctttgttacacaactgcgctggcgtgctgcccctacagaaatagggaaagccttggggtgggtgtgggtgtggggattgctagcttatcttttgtctagtttttttcttgagacagagtcttgctctgttgcccaggctggagtgcaaaggtgcgatctctgctcactgcaacctccactttccagattcaagagattctcctgtctcagcctcccaagtacctgggcttacaggcatgtgccaccatgcccggctaatttttgtatttttagtagagacagggtttcaccatgttggccaggctggtctcaaactcctgacctcaggtgatctgcccacctcggcctcccaaagtgctgggattacaggcgtgagccaccgtgcccagccatttttaaactttttggttttttttcttttttgagacggagtttcgatctcgttgcccacactggagtgcaatggcgtgatctcagctcaccacaacctccacctcccggattcaagcgactcccctgcctcagcctcctgagtagcagggattacaggcatgcgccaccacacccagctgattttgtatttttagtagtacatttctccatgttggccaaactggtcttgaactcctgacctcaagtgatccacccgcctcagcctcccaaagtgctgggattatagacgtgagccaccgtgcctggccatttttaaacttcttaaaagtacagattatacaatacacctattatacagaagtcagatttttcacatagggaatctgatttctgagaaaactttaatagaaggcaaaataacaagtaatgcttctgaccaaattatcttctctcaaaaactatgtttcttcacaaatgttgaaacttcatttttgttctttattaaaacaaaaatgtgatcttgtacaataagctttacaaaatcaaacaaaaatatggatatatgtgctttttcctggggcagcatgagattctttatatagacatatcagacgccccacaccaaagccattgatacctaccagcaaacagtgagatttcagaaaacagtatgttaaagtactcaagacattgcactctttgttagaagagaaacattttcaaattgtatttcacagcccaggagcctgtattctcaagatttggaaaagaagctgatccagggtttcattattttggggcagcatggatctgattaaaaagccctgctgttgaccttcagccaggttgctctttacctcagttgactcatctgaaagataaagaagtggaattatatcactgtatttctgaggtctctttccagctgcagtttctcttaatctcctatacaggttgaatatcttttatccaaaatgcttgagacaagaaatattttggatttttgactttttcaggatatggaatatttatatgtactacctaatgagatatcttggggctgggacctaagtcaaagtacaaaatttgtttgttttatatagaccttatacacatagcctgaagttaatttaatacaatacttttcataattttctgcatgaaacaaagtttgtgtacattaaaccatcagaaagcaaaggcgtcactgtgaccgcccactggattcaccttgcccgctgcccagatggagctgacttaccaagatgggaattgcaatagagaaagagtttagttcacacagagctggctaagtgggagactggaattttattacttaagtcaatctcccccaaaattcagaggctagggtttttcaaggataatctggagggagctggggactagggagtgggtgctgctgattggatgaggtgcaatcataggggtgtggaaaatggtccttgtgcctgccgagtctgcttctgcatggatgggtccacaggacaagctggagatctggatggagtcatcagaagtgcagaagcctgaaaagacattacaaaaggccaatcttacgttctgcaatggtgatgttatctgcaggagtaattggggaagttgcaaatctgtggctgatttgttagtccaacaaaggcagtctggtacccagacaaaaagagggtttgtttggggaaagggctgttaccatctttgttttaaagttaaactataaactaagtttctcccaaagttagttctgcctatgcccaggagtgaacaagggcagtttagacgttagaagttagatggagtcagtcaggtcagatgccttaaactgtcaattttgtcattgttaaattttttgcaaaggcagtttcgtcactatctcatgttggtgctcaaaaagttttggatgttagggcattttggattagggatgcccaacttgtaatagatgacatttaatatttatttaatacttatttaatactacctaaatacttgcaaatacctgcaaaaacaaggagggcctggacaaaagtgagtctccctcggtgccactgtatctgcagcactgagactgtttggtgtagataccaaataaatacctgagtgaaccaataaataaatgaataaaaggagctagcactgagtagcacatggagatcattccttggggctgcctagttatccttttctattacaaagacagaaaagagttgctttgcgtttaggaatttttaagtgatttagtcacttaaaaacttgagtgatttgaaaacagtatgactggagttgataaaacctttaaatcattaaggctgaaaggaacctaggacattctggaatcaaatcctttcatgtccctgttggggaaatccaggtgccagatgttacaagtatttaagttaataactggttaaaaactgactaggcataggttaaggcataggtcacttagcaaaaccccactaacaatgtttagtggctcttctgagaaatgatatgtatgatccagtatcccccagcactttaagtactcattgttgtatctgtatattttttaatagagagaaagtaaaaattcatcagtctcatcaccaaaccagttgtgccataacactctcataatttgatgaattcgtctgtcagtatctatttctgtctctctctcttgtttgctcactggctctccttctgcctctacacacatatccactatatgcaattctgcaaactattttattttcccacaagtccaggacatcatttctgtcaacatgtaagatgcacactcatgtttttagtggtcacagaatatttcatttgattccttcctcatatttagtcataaagtttctcttttttttttttttttttgctattataaacaaagcagaagtgagcatattttcacatgtatatttcattcctaattgattgctgccttgagataaatttctagaagtagagctgctgggtcagagaataggtgcattcatatgttcttatctgtgttgaatggcattatggataatagtccatattctacttactaaaatgaaaaagtatatatatcaccttatatgaaagatataggccccatacagaaattattttaataatggtatctcagatcagttgaaagtttcgccattttaaggaattattttaaaaggcgagcattacctccttactgtatttattttggaagaacacagtgccttcctatggggttcttaaggagggctagctatagcctgaagtgggagtccaccttatagccgagaccagaatatgggagcaaagaggttagctgtgtgcttgctacttcatggatgctttaagataattcttggcagaatacactgctgatacctatgcagatgatagcttttaatgcatgtcagacattcaagagtagcttgtcccaggggctttatttatggcaaatcatggttctctctatgagatttaagtacatggttttctttccttctagaaaagccggctgggcgcggtggctcacgcctgtaatcccagcactttgggaagctgaggcgagtggatcacaaggtcaagagatcgagaccatcctggctaatgtggtgaaaccgtctctactaaaattacacaaaaattttagctgggtgtggtggtacatgcctatagtcccagctgctcaggaagctcaggcaggagaatcgcttgaacccgggaggcggaggtttcagtgagccgagatctcgccactgcactccagcttggcagcagagcgagactccatcaaaaaaaaaaaaagctagtgcaaacatggcagtctttcagcttagccccgcagaaaagaaagtgattttcccaggaactcttatcttatgtagtctgaactttaatgcagagctgtctgatagtgtcgtagccgtgacggagaaggccgtggggcctggaatctccttgctgtgctctgtggccccggccctctgtggacgcgtaatgtgagagtttttaaagagtaactttcttttgtccttctttaagatatagaccccagtccctcctttaaaatattggctcgtgctgtaatttccactttgccttttgccctttgaccatctgtgtgacaagaaagccattccgatggttcagtaagcacccgctgaggctggctccccacaggtccagctcgaggtgctggtggggacagcccaccctctgctgtgtgccgtgatcccagctggagctgctgcacacccagagggagccgcctcagtcacacgccagcagacaggtgcaaatggagtgatgcagacagaaagaaaggaaatcacacctcaagatttattttctttctagaaacacccgccgggcagcagaggtctggatggatgaatacaaaaatttctattatgcagcagtgccttctgctagaaacgttccttatggaaagtaagtggcagttctgccttctcacaattactggggattcttggggtgtgggggtgggaggtaaggggctgcccccagcgttgaattcagctacccaggtgccaaggcgggaaggggttgtgggcacaggagcatgggcagtccacaccacaccacctgccccaaccctgttctcctcagcagattttcaagtttgatgtagaaagcccatctattcttaaaatttataaaggaatcttatttccctcttctccagtattcagagcagattggagcttaggaagaaactcagctgcaagcctttcaaatggtaccttgaaaatgtctatccagagttaaggtaagtccccagggatctggggtttcactttgtaagggcttagaagccagtaaggccatagaagcagcagaggggaaatggaggtggggctgcaggcatgagattgggcacctgggccccagtgagagcctgtggtctcactccatggtgtggagctgagaatctgctcccaagttggcctgctgctgtctctgtcctgcagagctgccctcccatgcttcggagtcccagaggcagtcccccgggcctcaccttgtttttggcttgttctccattggcaaggtgatgggctgggtgacctgaaggactggtgtctgacaggctcttcgagtgaccaggagcagtccccagcctccgcaagcatgcagtgtctgcagccagccctcgatccccccgccaggcgcctttgcatgcctccgatctgctgcgctcacccttgctgctcctgtgggccagcagataacagcccccacgaggctccctcctcccagctaggttaatcacatgtgaaacggaagtaataatgctgctgccccacgtccctccggaggattcatggcagaaacacctttctgagcattatttccacacccagcctcttgttttaagcgaatacgagctccccatctggagggacctgctgataacctcgtgagaagacctatagatccgctggggtggaggagccatctgcacttcatcttcttaaagggactgtcaggcaggtcgtgccttaatgcggcacattccttattctaaatattcccagagcattttacagcggctcacatatctccagcacagtgcctgcgaacgcaagacttgccaccattatctttccgctaacagctccttcagagcccttgtcacggagatttgttggacagttaggtaatgcggcctctctctgttgctcctgttcgctcacttggctctttggaaccgtttcctctgcttttcaagtaacatgccaggcgccaggtggcccatgccccctaggaggagaacaggagagaacacagcgtccttctccctcggatccctgccgtgcaggacagcttttgctggggattgagagcaccagatggtcaccagcgatggtcacctgcagcggcaagggtgcactggtcacagttgctggttgcagggccctggtcttcttcctgccagctctgtcctctcggccatgtgcactcaacccaaaagaacccattctgcctctgtgtctggccccagaatatgatgtctacacctcctgcctggtgtccctatacaacagattcttgactgtgggcactaaggcggctgctcatcaactctccgtcagccaaagaggggcttcaattcagtggattttaacccaaccatgccactcactttgctttttcagtcacagttgactgccatttctcacagaggtcacccatggtttgtagtgacactgggccccgcacccactgaagaccacatctgaggcactgagcaccatcctggctggcaaatctgcttcccctgtctgtggggggtgagggagacatcagcctcgtgttttgtgtctgtaatatcaccgccgtttactgagtgcctcctacgagccaggcaccgggccgtgtgctttacacgaaatgttctatgtaacacttgcagcagatctgggtagcccatagcctaccaaagggcaaatcgagcttcagagaaagtgagtcttgcctgaaagccagcacctggcagaggtgggctgaggtttggatctggttctgaagcacgttgttcttccccgtggctgtggctttgttcacattagaccacctgacaagtctgcccacctttcccgtctttactggataaaggtcagatcctaagtgtattggaaagttcaaggcaacaggatctgaccacattgattttctaaatgacttccaataagactaacattgaagagtatcaggagcttttccttcctttccaaaaaaaaaaaaaaaaaaaaatgacctgatatagaatataaagaatacttctgcaacatacagtcttaaagtgttggaagtccagagcctgggagaaatgccgtgtccctgacacacactacctgtggtaggaagaggcacgatgcctagtcactgggtctttctctcgttcctgtcacctgtcatgaggccactgagcaaaggggctggtggacgggagctggtggtcatgtgcagtgaagcaggtgattctcacgttgtttttcagggttccagaccatcaggatatagcttttggggccttgcagcagggaactaactgcctcgacactttgggacactttgctgatggtgtggttggagtttatgaatgtcacaatgctgggggaaaccaggtatgtgcatggggaagccaggtcacctgcaggcccagagagagcaggagttgggggggtcctgatgttagaagtcccagctgccacctttctcctgggatgggtgatgtctatgaggaagcacctggctcctgctggccacagcctctttggcagccagcaccagggccagatagaatgtcacacactttggtgcatcagctctgtcatcagcttcggaccaggctctgctgcagcggcaagggtgcactggtcacagttgctggttgcagggccctggtcttcctgccagctctgtcctctcggccatgtgcactcaaccgcaaagcacccattctgcctctgcgtctggccccagaatatgatgtctacacctcctgcctggtatgcctatacaacagattcttaactgtgggcactaaggcggctgctagttatagcccctgcctgttagataatagcttaagatagaagatactcagtattaattgcttccattgcacacatacacaccttttctgagaggcataaaaatgcacaaccgccaggcgccgtggcgcacgcctgtaatcccaacactttgggaggctgtggtgggtggatcacctaaggtcaggagttcaagaccagcctggccgacatggtgaaacccatctctgctaaaaataaaaaaaaaattagccaagcgtggtggcgggcacctgtaatcccagctacccgagaggctgaggcaggagaattgcctgaacccgggaggcagaggttgctgtgagctgagatcacaccattgcattccagcccaggctacaagagcaaagctctgtctcaaaaaacaaacaaacaaacaaacagaaaaacccactaccttctcttctcccatcattgcaaaggagagacaaaatgaaggcttgatgggcccagctgagacttcggattctaaaaacagttttcccatgagataataataggaattgggtgaaatgtgagcttcatgcaccaaagggtaatcctgtgtgctcttacccccttcctgaaaacttgcctggcactgggagagcctgcagttttaaaaaaggcaggttaactccgtgtgtgtatcctgaatgtattgatttcttaactttctttaactggaagtatttttgaaagggggcatgtgcttttgtgtaaagctgggtcctcctcccaagtgagtgtccaggcagactgcaatccacaaataccttgactcctttcttcacttggtgatgtggttttagcagttacttgcaatggcctggacatcctaaattagaagagagagaggaacctgcctgcctggggcttgactgggccagtccccatccagcatgggcatggggcaggtagccagggcctggccctggttcccctaaatctccagcccttaaatagaagatacttggctttgatgagttagaaaatgagagagagcctcattttctcgtgtggttttggtagagttgatcctggattctccgtatcagcgtcagcagtctcgatggttcagaatagctaaatgtgatgctatgtttgggtaagagccaatgggtcaggtttgccgacagatatgagtgtgcttccagtgcctgtgcacgtgtgtgacacacacacacacacacacacacacacaatagcacatatgctcatcacgttctcacacaacagctctcttctcctgattcccgggctcagtccccctctcttccttgtgcacatgcacctagactcatgtgctgcttctttcttctttttctgttactcagatgcagagcttgttttgctctctgtttcatgtacatgacttcatatcattgatctctgtccttttgataaatattgttggagggttttttacttggcagtactattttgctagagaaagggattagaaggcaaacaaagcaatcccttgccttccagaactcacagttgagcagaggagccactgtgggttatgaaacagaggaggcacctgctcacctctgtgctgtccaggtggctgcgcctcctgttattccggctgccctcacctccatgtttaatcactgggcttccctctgctgtgtggcaggactgcatgccattcccaggctcccagggcctggcgtctgtgtgtagcctctgggctgtgaggacactccccagggagcaggcttcaggtgtgggtgcacacacaagccagccttcagctatagcctgagggaccagttttaggtatttcacactgtagcaggtcagcccccctgggtactcgtcacaggccccacccgtgtcaggagtcacctggagggaggaacccatacagggggagggaagaacaaacagagtggaagacgaagcgggtgaaaggaggaggagccagctggtattggtggggtgggcagaggcggaggggaaggtgccatccccaccgtgtccatgcttctgtgtccttgtagctcctccatccaagaccctgctgttaactgtgttctcagtcactgctgggaagcggggggcccaggggactcactcagaggtgatggagggcgccgtgcggtgctgctgtgggtcccgctgtggtccaggtgtgactggaggaggcgtctccgctggctgtgttccttctacactgataacagcgtgtttatttccatggtttgggctttgttcttgagatctggaaagcagtgagcttggggagagatgttttatgtgtttccatctagaaccatagtgaaaatccaccgaaatgccctcagaaaagtggagctctgtgagggagggggaaatgatgggtctcattctcagcaagctgggtttcatctaaaccggacagacggtgctgcaaggcttggtcgatcacacagcattaatgcagatttcaccaaatgcagacatgtggataattcgtgtagggttgggtgaagcttacctctggtctgtggatgacaaaacggacgaggtgcccacccaggttccgtactgtctgggtgttgggcctcttgtgatccctggccagcctcacctccgtgtttaatctctggagttcccactgtcactctgcagtgttctgatgatttatggaaggttggagaggtcactcctttctgtgtcagcgcctctgctggaaagcgacacaccttacgctacagcacattaaacagaagcgtgtgctcaggccccggccgagagagttcgtcatcagagtctcgggccccagcttcatcccctgtgcgtcaggctctgtgactggctcaccccccgccagcattgcaccttaattaccgcacagctagtaacacgagacagagtctgggccctgtggaggtggcaggtctacgggaaccaaagactttgtctgtgtagctgctgcctgtgaccctcctcacctgccctcaggaggacagcctgtgtcccgccttcagggctgtggccctcaccccccggtcctgcccagtagagagtctccaggattcctctctgcacagtgctgagggcagccacagcacagacctttgacacagagcgcccattccttgcctctgcaccaacttcaggggtcagcaaagggctgtgccaaggagtgaacaagatcgggtctgcagggtgtgtctcccactctgcttttgcttttccttcttgctgttgtgcagccattactgttctcacatgtgggctttcccttcctttccagcagtaagtgctgactccctgctcactctctgtccccctccaatggccacatcctgggattgctcagagaaattttttttttctttttttttttttgagacggagtttggctgtgttgcccaggctttttttttttttttgagacggagtttggctgtgttgcccaggctggagtgcagtggtgcaatctcggctcactgccacctccgcctcccaggttcaagccattctcctgcctcagcctctcaagtagcagggattacaggcacgtgccaccacacccggctaatttttgtatgtttagtagagacgggattccactatgttggccaggctggtctcgaactcgtgacctcaagtgatccacatgcctcagcctcccaaagtgctggggttacaggcgtgagccaccacaaccagcctgcccagagaacttttacaaaatgctgatgccaggtgctatgcccagagagcctgatctaatttgtctagggtcagagggcaccaccagatctctaagagctaacaagtgattctaaatgaggatttggcctgctgtagtggtacacacctgtaatttcagcactttaggaagccaaggcaggaggattgcttgaggccaggagttcaagaccaggctggacaacatagggaagctccgtctttacaaaaaaaaaaaaaagattagccagttgtgatgacctgtgcctgtagtccaagctactcaggaggctgagatgggaggattgctaaagcccaagaggtcgaggctgtagtgagctgtgattgcaccactacactccagcctgaacaacagagtgagaccatgttcctaaaataatgtaaaataaattagggccgggcacggtggctcacgcctgtaatcccagcactttgggaggctgaggtgggtgaatcacgaggtctggagttcgagaccagcctggccaacatggtgaaaccccgtctctactaaaaatacaaaagattagctgggcatggtagtgggcacctgtaatcccagctactcggggagctgaggcagaagaatcacttgaacccgggaggtggaggttgcagtgagccgagatcgcaccactatactccagcctgggtgacagtgtgagattctgtctcaaaaaaataaataaaaatttttaaaaaataggagttgaggagcaagcgttttctagtggaaagatgaacacatcagcacatacaatgtgatgtgagatggcaggatgacatgatgtatgttacaccctcagcttgggagcaccttactgcctgggccagtctggggccagtgggctactatcagtactttccaatagaaccatgtgctatgatggggatgctctacatctgccattcagtatatcagccacattgtggcaactgggcacttgaaatatgactagtgtgaattacaagtttaatttcatttcattctggtgaatttaaatgcaaatggccctgggtgccctgtagctagcacattagacagtacggctcagatattccagctcacaaacccactgtgcgtgagtcctctctgaaccgatagaaagtgatgcttttttgcatagcgtgtgacacggatgagaaacgagagggtaagtaatatttcccaactgaaaatagggcctggtgctttggaagagtgaggtttgttatctggtttccggctgagccttggcagacacacaggaaatgagaaaattaatggccatgccttttaagagtggcagctcaaaaaagcatttcttaaatatttatgaactttattttacaaattcagataattgaaatgcaacagaagaacaaaacggcaactagctctgttgtttgcccagctgaattagtttttctggaatcctgtgtaaagtctgctttacagtaattaagcacacaatagcaaggaggttgtaaaaacattcagacatgatctttaactgggtgtcagcagaccatccagcatccgccaacacctgctgccagggacagtctggaacccttctccataccagcgttgtccctcttactcaggactctcctcttcactgtgagtgggcgtctctgtgtaccacagtttcacacatcctggtggtgtccccagcccctgtgagtgcagggacggaacaatgtgcttcttcctggccctctccatcctgaacgccatctgcctatgggaaacacacacggcttcctctctacactccacaccttccatactctgtgacccagtgaataggaaaaaagctgcttttcctcctttatactctcacaaaacttctcacctctgacaccagccctgtgggcttttccccccacaccaagcaattctccaattctccaattctctgcggacactgagtgtcatgcctgtcaactcagttctgacactgcctacccagagttagcacagaccccacgggttatgggcttcctcccacaagatgcttctactccagatgccagtcacaagtccaagttgtcacctgctgtctgactgtaaatcagggctcccgcgacctcgccttgaattcattcatttgcaagaatagttcatagaactcaggaaaacggtttacttcgtggcttacctgttcattaggaaagactgaaacccaggagcagctggacgggagagatgcatagcacgcggtgtggaggtggggtgttggagcttccacgccctctccaggtgtgccgctctcccagcgcctccgcatgtccggcagccacatcccggagtgcaaggactttgacggaggcctcatcacatgggcatgatctccagctcctcttcccttcccagaggatggggtggcgggggactgacggtttcaagcttctcagcataacctggtctttctggtgaccagccccgtccaggagcccattagagttgcttcattagaacaagacactcccatcacccaataaattccaagggagtaggagctgtttgttgggaaccggggtcaaagaccaaacactagaatgaaagatgctcctaaaacccctgtggctcaggaaatgacaagggttttaggagccttgtgattgtgccagagaccaaataattatttttatgatgtcacactgtcctagagtatgggtgacgtgagtgcctgtgggtgcttggaagagctggctggaactcacccatgttgaatgacagcatcatagaatgttgggattcgactcagggtcgggtggccttccccagagaaggtggccggcaggggtgggtgggtcagggctgcctccatgccgtgtttggaatgctacagtgcacaggccaagcaggtgcttctactctaggactcttcagagcctttaatagactgaatttccgagagataaacacagcacaaagtctgtttcccaaattcatttgacctagaatccgtctttcctaggattcctcacagagtagaatgtgaggaacactaattaaaaggtgagaaaatggaagacccgggaagtgagcaggcttgcccaagcctccctccctgttaggggaggaggaagtcttcagacaggtgaaggtgtcttcactgattcctagacgggtgtccgtgcctctgcatcccctctgctgatgctgagagctggagatggtgcatcccgccagtggttgtataaggtctgaatgctagaatctttagggtttggtttggtttggtttggttcggttcggttcagttcggtttggagacagggtctcggtctgtcacccaggctagaatgcagtggcacaatcacagttcactgcagcctcggcctcccaggttgaagcaatccttccacctcagcctcccaagtagctgggaccacaggcatgcactgccacacccggtcaacttattttttatttttagtacaaacaaggtctcgctatgttgcctaggctgatcttgaactcctggcattaagcagttctcccgccttggcccccaaagtgctgggattatagataggcctgagccaccacaccgggctgcatcttcaccttttaatgtttttctaatgacggactgtttgttccaacatgatacagatactagacagtgaggcttctttaaacactatttgttcctttccttacctctgtttccaagaaccaagaaaaaaacagtgtcttcatagcacataatagtgcctgaagttgcagaatacatttatttgtgtgtctttcatgttccccactagaaagggagcctggctctgtgacagcgctggtgtcatacaggtgtgcagcaggtggtcatgggacagaccgatagaaagacagacagacagacggaggggagggccactgcagcgtgctggggcttagagaggaaggggatggaagtggatagtgagtccctgtggggttttaaactggaaagggccttgctgcccctcgatattaaggggtgttcatccctttgagtgggacaaatggagagtgatggtcagaagcctcaccttccagtccctgctgtggccctgcctggaacaggctccggcctcctctgccacctgggaccatgtctcatttagtatccaaaatggttgtcctctcaccctgtcacagcctttaacttgtgtgtgtttgtacatatatgtgtgtgtttgtttgttaacatcatggtgtgttatttaaacactctctagctcagttttctcatctataaaatgagaataataatagccctcatggagctgttgtataaagggcttaaaataatgcttggcacatagcaccccattaaatttagctgtaatgtattcaaagaaattcatagatctattcctccagttttcagagggcttcatgagcacccatagatcaattagcattcacttaggaggctatacacgatatattttgcttacatatgcaatgtgttatttactacagttcacattcatcaatgctgtttgcaggccatacctgcatgagggcagagtcattccaaaatagcatgggtggaccagttgccaactgtctacctggtgtataaccaagcttgtgccacagtttttacagctcacattgaattatagaaaaatgaacaaggcagtctaacttgtatttggggctaaaatagttaatagttttattttagttactgaggtcctcaaagcacttctgcacatcactcagccaacttactgctcagttgtgaggttctcccacatctctgatgttataaatttgcccttaggcaaaaagtaattgtttcgttctcagttggctcaggggttctgaatctaagctccaccccgtgacccatttcctttttgagccctcatcgatgccccttctttcctttcacagcccggtgcatagcacgcctctgacttctggttttgtgttccaggaatgggccttgacgaaggagaagtcggtgaagcacatggatttgtgccttactgtggtggaccgggcaccgggctctcttataaagctgcagggctgccgagaaaatgacagcagacaggtacggcttgcaggcacccgtgggtgcccgtgattaacccagaccagggtagccacggcctgcgccctcttgctctgtgctgcctctcaaagcatccatctctgcgtgtacttatgtgttcttttgcatcactgtgaataatgtctagctgccctattagacttaagccacaaacctaatgttgcttatttctgattatattctcattctcttccctatgccgctgaaaatttaaagagaaattatctacttttgtttattcatcaaatacttttttctatttcaatttacaaaaattctaaatgattaatgttcacatggatggtactcgatacataatgcaagtgtgtgtgtctatgtgtgtatatatgtgagcatatatatacacacatatatacacaccacatatatatacatgctacatatatacatatatacatgccacatatatacatatatacacgccacatatatacacatatatacatgccacatatatacgtatatatatacacaccacatatatatacatgtatacacaccacatatatatacatatatatacacaccacatatacatatatacacaccacatatacatatacctgccacatatatacatatataaacaccacatatatatacatatgcatgccacatatatgcatatgtaaacaccgcatatatacatatatacacaccacatgtatacgtatatatagatgccacatttatacatatataaacgccacatatatatacacaccacatatgtatacatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccacatgtatacacgccacatatatacatatgtaaacaccacatatatacacaccacatatatatacacgccacatatatacatatatacaaacaccacatatatatacatatacacacacacaccacagatacatacatatatatacatgccacatagatatacatatataaacgccacatatatatacatataaacacaccatatatatacatatagatacatgctacatttatataaacaccacatatatatacgccacatagatatacaagcacaacatatatacatgccacatgtatacatatgtaaacaccacatatatatacacaccacatatacacaccacatatatatatacaaacaccacatatatatacatatatacatacaccacagatatatacatatatatacatgccacatatatatacaaatatacatgccacatatatacatgtatatacatgccacatagatatacatatataaatgccacagatatatacatatataaacaccacatatatacatagacaccacagatatatacatatatacatgccacatatatatacgtatatatacatgccacatatatatacgtatatatacatgccacatatatatacgtatatatacatgccacatatatatacgtatatatacatgccacatatatatacatatataaacacatatatacatatatagacaccacagatatatacatatatatacacaccacatatatatacatatatacacacacacacatatacacacagtttctttaaacatttcagaatagactttctacctgccttgtaagccggttttctctgacgtattcccttgtggcagcttgtggacacaccctttctcaaggcatggggtaacagttagtgtcaggaatagaaatgcaagcacaaaaggtcctccctgtatgcccatacttggagtgcctgcccctgttcttacagtcggtccttagagatagatgggatgtagggaaactgaggcacagaacctactggagccaagagcctaagccagcttctagtctaaccctgatttcacaacagaaaagtctcagaaagtcattgcctccaccctggagtcatctgggaagaccaaggccaggaccgagtccccggttctgaccccagttgtcagggagacgcctgcagagggccctctttcacctgtctgtctccaaacccctgcgccagctctgggtgctcctccttccctgctctgcagagtcccagcctgtcctggcagtgggagcccctctctagggttctgctcacaatccgcatctctaaatgtccatctgtgttgatgacttgataccaaaatgtgtaagggagtgcctgttaaacaagagaaggctagcaccgcttggacccaaaccacctagaaattgcctcactcattggcccctcgagaggaagctcctcgagggcaaggctggcatctgctgagccaagtactgggtgagtctcaaacacattcccctgggatgtaacggagcagagatgtctttggatgtaatggattgataaagtgatgactttagttgacacctttttaaaaaacaaatattacttcaatattgcttaatttcaagaattgacaggtgtttctgcttcagtcccagttttggggaaccataactgacacggcttaggacctttgtgaagcatgaaaagacctataaataataagtttttctggatgtatggcatgtataaatggggatctgttaggttttaaaccccaagactcaggctattagagaggatgtgggggctgtttcagtagagtctgactgccttgaaaatctgcgctccccacccccaaccacaatcccatcagacagacagatcagagcccacaaggccacctgtgcgagacggagctggggttttgttgttgtttttctaaggttcttgatttagctgatgctttgacacatgacaggcagtccctccagtggccagaatcagattccgttcattccgaattctttgttgagaagattcctggctgctcagagtaacagggcagcctcaatacatacacactttacatgacaatggggaaaaacagcatgaggggtgattgacagcaacgagggagctggaaatgaaagaggcaatgacaggcacttagcaaaagcctccccggctcctctgattgcactgtctttccctgctggcaagaactccaggtgagcaggtggacggaaataaggaaagcagggtacaagtgacaacatccttgtggtgtttcgcgcaggtcgggtccccagcactgggctcctctgcctgcaccggctcctccctgcctcactcactggcccctcaagaggaagctccttagcaaattttatcttggaactgaactggctttgccagttggaacatttggtttccaggcacgtccatgttttcatatgttgtgcatatttgcagagtcaaaggggaaagggaggcaggagtgagaaaatttaattctgcaatgtcaaaaggatttgcaaaaaatacttaggtgaaggagctttcgtgcacacagtataaaaaattaattagaaccacagacttcattatttgaaacgagctttggggaagaaaaaaatgttactttttttttttaagaacaaacattagagatttttaaagggggatttttctgtttttctttctttttttttttttttttaagagacaggatctcactctgttgcttaagactggagtgcaggggtgggtatgaccatagctcactgcagcctcgaactcctgtgcccaagcgatcctcccacctcagcctgcaaggagctaggacaacaggcatgcaccaccatgccctgctaattttttttaaaaaaaatgtttgtagagatgggttcttgctatgttgcccaggctggtcttgaactcctggcctcaagcgatcttcctgcctcggcctcccaaagtgctgggattagtgtcgtgagccgcctgcactcaggctgaaaggggtatttatgttacttgctaaacagggctcctcagatttccttcaggctgggttgtgcactttgattctggcttagttggtgggtaacgggtatgtgggttgagtttggttgttcgcttgatttgagtgttagtaaagaggcatcgtaccctgtactttacaagcggcatgttcagaactcagcaaacattggtccctgccatacagagcaccagggggctcaagggtagcagagacaagtttctcatatccaccaaggagcttgcacaccagtagagaacagactacatagaaataggcttctcaatgctatgttctgttcaaacaaccatctctcttcctgacatttggcctgacaccgttcctctggctcccccgagcagaaagccctaagtgggagcatggaggtgcccagaccaaggcctccaggcagggctgctttccaacagccaggggaggatctggccctgcattgtgtggatcccttcttggggtgaaccatcactggatcaagctttcatacgaaggcatgcaaattcccctacatcaaatcctgtgttaatgacgaaggggtgggtgcccagagctctggggctcagaggaggggacacccacagaaagtttggggcaggagacgttctgagttttgatccaaggcagagaatatgtttccttcctgggtcccagcagcacctgtggctggtttcctgtggggctgctgcaagctcctcggccgttcagatgagaggctgggaaaaacgtgtctatctgtgagtttttaatgcagccacaaggtcctgaattcacacgaatctgtttgtactcctttgcttgtgcccacactctaaggcactctcctgtgtcttgcagaaatgggaacagatcgagggcaactccaagctgaggcacgtgggcagcaacctgtgcctggacagtcgcacggccaagagcgggggcctaagcgtggaggtgtgtggcccggccctttcgcagcagtggaagttcacgctcaacctgcagcagtaggagggtccgggaggccctgccgtcctgtctcctgcaccattgggtggagtctggtgatcacattattgattatgtttcttaaactttccgcgaaactaatatacctcagtattccatcatggtctgaaagtcaaacttcggcaaggcacggacgactgtgcagacacagcagcggcaagaagcgagaactgccctccccctcctctcggtgcagcccagccgggcccccttccccaggccggagcgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaagaatgtacggtcagttccctatggtttctgtagatcatcgtcatcttgtatattccccacaaagccgttcgcagcttccgggagaaggggccagagcccggtggggccagtttctcacagagggaggaggtggcctttgtcccctggagcccgatcagccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaatataagacataccccatagctctgtgtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggctcacagtcctgcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcggtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatctcacgtgtctacccagacccttgtgcggcccatgccccgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagataccgctctttgctggccagagtctgtcctggtgtgtgagggctgggtggggtgggtgtggggactgggattggggtcagccttctgcagctcctgctcagtggctgtttcttatcaccttctgcagatgtgcttttattgctgtgccctttggttggttattcttacttgtaataataatcattatcatttgtggagtgtttatgatgtgccaggcacccagccaagcccttaaatacatttgcattttacagccacaggggaagctggtgaaggaagttgctagcctgctcaaggtcacgtccttcctgtgtacctgcctggagccagcccttggcactcgcacccagaccctgtgctccaaaccaggggacaaatatttttacagtttttcaagtagttaagatttatagacttgtttaccagttacctggggctcttcggttccatccaggcgtctctgaggttcttcagatactatttgttttattttattttttttgagacggagtacttgctctgtcacctaggctggagtgtggcggcgcaatctcgactcactgcaacctccgcctcagtgattccagcgattctcccgcttcagcctccaaggtagctgggattacaggcactcaccaccatacctggctaatgttttgaatttttagtagagatgaggtttcaccatattggccaggctggtcttgaactcctgacctcaagtgatccgccagcttcggcctcccaaagtgctgggattacaggcgtgagccactgcacctgaccttcggtaccttttaaattcctgcatttgagccaggccacagtagtgcgtgcctgtaatcccagctattcaggaggctgaggcgggaggatcgnnnnnnnnnnnnnnnnnnnntatataggtaaaatgcttcaacacattcggtagtggtagtcagcaggatcgtttgtgcactcgggttgaagtctcaggctagggcaacgaagtaagattcccatctcaacaacagaagcaaaagtacctacatttgaacagccccacaagggttcaaggaaacataaccttgaccaattatttaacaatttttttttcaagacagagtctcactttgtcgcccaggctggagcgcagtggtgcaatcttggctcactgcaacctctgtctcctgggttcaagtgattctcctgcctcagcctcccgagtagctgggattacaggcccccaccaccacacccggctacttttttgtatttttagtagagacgaggtctcaccatgttgcccaggctggtctcaaactcctgacctgaagtgatccacccgcctcggcctcccaaagtactgggattacaggcatgagccaccgcacctggcccaaattatttagcaattttgattgacattggggtgaagtaggaggttggccactggcaggactggcccaaatgagtgtctgaaaccttctagagaccacatgtaatccattttctttccctattatttgggacaccaaaaatttgctgccatctgagaagactaaaggaactctcagcatcgttttgtagcacccactggagccccttagggatcccgtgtgtggtgcctgctctggcaacagggagaggtttatttattcggtaactatttgttgaaaacctgtgttgtgctgatagtcccaaagaagacccaggctgaggaggaaacacgttaaatggtgacaaataggacaagccaaatgcaggctctcggcctggcgggtgctgcacccttgttggagccgtgtctcaaaggttctgtgggattcggacttggcgagggagagcgttgccggcaggggctcagcgtctgagaagtcccatcaccaggacatagcagcaagatcccctgatggggacagcctgggaggaagaggacagactggcaggcgggcccgtgtgtgagcattgtgaatgctggggaaggctgtgggggtggggaatgacaggagttcctgactggagcagagagggtcagacttgcaacgcttttcagaatgaaatatccaacccaactcagtgattggattctgcggtataacttcacattgtcaagaatattcaaccagaaaaataaaatgcctctgacacactcttctgttcatggacttacctacagaagagaagaaaaaactctcttctcagcagttcttgcctatttctcagcaatctcctaatacaattgctgtatttgattttatgcattgtttgtgcctgcaaataacatacatcctgtttccaaaagctgtcgtctcccctagggttccaaagaggagtgttcgcttagcagtttctgcctgagctcctggggtcccaggctagggtggtctggacaggggctacagagaagaccttttggtcctcagcccaggtgacacccacgggtgagtcagatttgaaccagactctggatgcaattataaggagcattgtagagcagtagccatgatttcctcttcaggaataaagacccagtctcaacaaggtgccagcctcctgaagggcgtggaaagaacccttgcggggcaccgaagccactgattcacactcgctgcggagtttccctgagactgtccttcttgctctcaagttggcagaattgtctattggagagcttccataaaaagcccacctaaatggaggcgagattaaaagagatgttgtcttgtataacaagaaatccaaaggtgatgggattccacgttgatcctggggcttgacattgctgtggacaaactgctccctatccgagcgcccctcccctccatcccctcccaccgtggttcatttagtacagtgggtgctcgggtctccgtctgttcacgttgctgtaaaggaatattggaaacggtaggttatttggctcatggttctgcaggtcgtacgaggagcatggctccagcgtctgcttctggggaggcctcaggaagcttccactggtggtggaaggcagaggggagcaggcatggcatggcgaggggggcgggaggagccaggctcttttcaacaatcagttctcactcactcctgtgataatggcaccaagccattcaggaggaacccacccccacagtccaaacacttccaccacgcctcacctccaacattgagggtcagagttcaacatgagacttgaagtggacaaacgtctaacatttatcactgaacagacctggagcgtgctgcctcctgtgcatctttgttttttgacttagggaagatgcacctttgccagtgaccaccccaccccttagtctccccaccccttagtctccccacctcttagactccccaccccttagactccccacctcttagtcttcccgggtcgcactgcccagagccgggtccttgggaagccgggaagcagtcacctcccacctcctcccatgtcatggaagtgggttttgctggcaaggaggacagggaagggatgactactcattgagcagcccagtgcccaccacacttgccatcactggaagaattctggcagcagcagatggacaggggtggcagcgtggtctcaggattccttcatcctaagagaggcagtcgcagaccctgttgagccccttcaccctgttgatgccatggactcctttggcgtgagccatcaactcagggcctcctctcagaaggtgttcaaatgaataaaacacattgattacatgggattataaagaagtctaattatgccaagacacagttatcaaaatattttcctaatatgtgcttcttaatgcattaaataacaagtcttcctgtctaattgctgccataatttaaagtagtgatgagcataaacaatgttttgaaaaagctacaataattaatgtgatgaaaatatctgtgattttttaattagtgacaaagttcctattttgttgtcgacattcgttgtagagtgttccatttcagttggaggttgtgaaaataacaatatcatttttcccatctaagttgctggaccccctaaattctaagcatctccatgtcggtgagatgcatggtccccactgtcctggagcctccgtgactttgtcatctccctgctgcagggtcaaaggggtgttctccagcgcccaggcagctgcccagagctctaatcctgattccaagagcaaaaacgggaacagaccgcccttgaggacaggcgctgctggagccaagagactcacagtcggtcacctgatttgcatttatattgagaaatcacagctggagggtaccctggcagatgggtgaggctgagccactcaggctctagggaagccacgctgtcctcacagtgcccacccattgatctgtgacacgtgggccaaggggcgtgggattttgctggtcagcttctctccctattgaagccgcatgggaaggaagtgggaagaagactgctcggcaagcaaggagccagagtactgaatgcaaggaccttcacaaagtgcctcttgaggtggaaagacggaggcgtttctgcgccgctgcgtggcctcagccacgaaactgtcattcggagactgcttggcctggactccagctcaggatatgcagggtgggtgctgcctgatgcctcatctgggcctgccaggtctgcggcaggagggcgggtaggatgggaaggagcccatcctgggacagagcatgtaaatgcatagccaccactgtcgggtgccacacaggagtgaagtccaggagtgaaaagaaacacttgagggaaaggaagaggggcgaacagaggaggtggcactgggtgcggcttctcaggccctggaatgggtgtcccacccttcaaataacctctcatctctacacaaagacgttaccccattttacccctggggaaactgaggctctgatcagctaagtcatttgcctaatttacccacacagtgccaagttaagcacccaggctgtgactgtcctcttcctggtccggtggggacacggggacaggaggtgatgggaagtgaaatgggcctttggtcgtagccaggggaggggcagtgactcccgttgctaacagggaaagctggagtcgcctccgcccgccggctcatgagggctggaggggaggagtcaggagactcaggggtgggagagatgggctccaccgctgcatcctgccacccaccacctgtgtcaccatgggatgtcactgagcctgctctgtgaaatgggaacccttctgttcaccctggaaaatcattgtcaagatcagagaggaagcacgaaaagtgcctcctggccatgcagtggctccacctgcaatcccagcacttgaggaggccaaggcaggaggattgcttgagtccaggagtctgagaccagcctgggcaacatagtgagactcccatctctacaaaataataataataataagctgggcatggtgatgcacccctgtggttgggctactcgggatggcttgagcccaggagtttgaggctgcagtgagccataattgcaccactgtactccagcctggagcaagaccctgtctcaaaaaaaattttttttaatttgcgctctgatctaggccagcccagagctgcagccccggcccatgagcctccccagctttcccggcaggtctgtgggccgtccagaaggaaagggactggagcaggggagccaatgggatttccacatctgccaagtcttcagggaatgtgggatggcacggggacccgggaaataagggtggaggtgtcagccctgcatttttacagcctagaagtgacgtcagagaccaccagagagggggacggcagagagagggaggacaggggcctggaaacacagatccacacacaggctggaaaggaccgagcaagacactgctggctgggcagaggcagctggaaggaaaggaaggaaggtgcgggacaaacgaggctgccccacggcccgagccagagcacagtgagctctgggaagaggtacctggatttttggcaacaaggaagttggtccgatgccagcaggtgaggagcatcctcctcatgtgaggaacacggggctggagcaggggaggacagggtgtgtggccactggttcaggtggggatgtctgggacggacctgagaagctgaggctgatgggacagcgaggggacagagaactctccggaaacttctggctccggggcagagggccgagctaaggggtggcatgggtagccactgtttccctcccactcccccagccccctgcactggggattttgaggctgtctgcacttcatatgtttgagagaaacccacgattgtagagctgaagatgtagaatttggcccgcaggtaactgcacaccaaccaggaccagccctgctcatgagcttcactgcggcacccatttcatcacacaaggggccaaccagaggccaattcaggagatgtcaatgtctgtgtgcctccaccccaaaattcatagattgaaatcctaacccccaaggcaatgatattaggaggtggggtcttagggaggtgggcaggtcatgaggatggccctgatccagtctgactgctgtgcttataagagatgatgacacagacccacacaaaggggcggccacgtgtggacgcagggagaagacagccgtcccacgccatggagaggcttcaggagcaaccaaccctgcagacaccttgatcctggacttccggcatccggggctgtgcgttgtgcaagcccccccgagcctgcactgttttgttctggcagctccaagctgactcatacaagcccagagccctcgcaattcccacacgccacatgcatggctcagctgcacctcctgccagctccaaacctcacggcacagggtacacacttgtgtgtccatatggtcagctttcagcactggacagggcttctaaggtcccatcccatgacatgctcccctcacctgggtcctccttccgacactcccaacatgtgttctggcatcagctggggggccatgcttgtgctgggagcttagaagatgagagctaatgttcactgggcacctgccatgctccagaaatgatgccagcttctcattcagggctcacttccacctttcaacagacggaccaagtaggacttagaaagcttaaggcatatgtgagtcatgtcagaacaggaatttgaacccagctctcaaacttcaaagccctgttctttgtatgacacttgtgcttctcaaaccttgctgcatattccaattaccttgggagtgaaacaacaacaatgcaatcctgcagtccctggagctaaggtcagctgtgtttgcaaagctccccagaggctcagaaagtacagctgggttggaaaccaaaccagcgcttccccaacctcagtgcacagcagagtctccaggagagcttgttaaaaccgagtcccggggcccagtccccaagttcctgattcggcaggactggggtgggatttgagaattcatatttcttctctttcttttctactccttcttcttctccttcttcatttttttttctttctttctttctttttgagatggagtttccctcttgtccaggctggagtgcagtggtgtgatctcggctcactgcaacctctgccgcctaggttcaagtgattctcatgcctcagcctccagagtagctgggattataggcacccaccaccatgcccagctaatttttgtattttagtagagatggggtttcaccatgttagccaggctggtctcgaactcctgaccacaggtgatccatccgcctcggcctcccaaagtgctgggattacaggcatgagccaccatgcctgccctcatcttcatttttttttagagacagagtcacccacactggaatgcagtggtgtcaatcatagctcactccagccttgaactcccaggcttgagcaatctacccacctcagcctcccgggtagcttgggactacaggcacacaacaccatgcctggctaattttttgtatttattgtagacactgggtttcactatgttgcccagggtggtctcaaactcctagtctcaagtaatcacccaccttggcctcccaaagtgttgggattacaggcatgagccactgtgcctggtggaagtttatagttctaatgactcctaggtgatgctgatgctgctggcctgggaaccacactttgaggaggcacaaggcacttagttcaggccgtggctagtttagacaatagggattgcccacacttcataccaaagggttattactgagttgcatggcggcctggagaagcggtagtgggtagggctcaggttgtggttctggggccggactgcttggttcatggcctcaggtccgctattcctgtgcccttggatgcttcatggctcggatgtggaccctgttacatgacctcagtctcaccatctccgttctctgtgctcagcttcctcctcagttaaatggggaaatgaaattcacaaagttggccgggcgcggtggctcacgcctgtaatcccagcactttgggaggccgaggcgggtggatcacgaagtcaggagatcgagaccatcctggctaacacggtgaaaccccatctctattaaaaatacaaaaaaattagccgggcatggtagcaggtgcctgtagtcccagctactcaggaggctgaggcaggagaatggcgtgaacctgggaggcggagcttgcagtgagccgagatcgcgccactgcactctagcctgagcaacagagcaagactctgtctcaaaaaaaaaaaaaaagaaaaaaaagaaaagaaaaaagaaaagaaattcacaaagttagagccttggggtggtgagattctctcactccccctctaccatgacctgcttcgtcagaaaaccattcccccttctgctgcttgaaggggtttaataccatggatctgcacctcgtagtttcaatttggaattttttagttcagaggactttgagtgacagacattctaaaaatcaaagtaggtaacaaaatgaataagggttgcagagagtattcaaatgcagacagtgagagctcatggaggtgaagaatcaggccttgatctgcacagttacccagaaagtagaatccctcatggatgctgagcttggggctgaggctgccagctccctctctgcactttagaaacaggtctgcatgtaacccacctaaacacagccctctaacctctctgttcttcttctcctggatgaaagatttgggtgatgaataaaatgatagtctgggccacccttttccacctcacctgaaaggccaggaaatagaactaagaagtgtgtttaaggaatcattttaggcctggggcagtagctcacatctataatcccagcactttgggaggctgaggcgggaagatgacttgagcccaggagttggagaccagccttgacaacatagtgagaccctgttgctacaaaaaattaaaaaattagccaggtgtggtggtgtgcacctgtggtcccagctacttgggtggctgaggtgggaggatcgcttgagcctaggagttggaggctgcagtgagctgtgactgtgccactgcactccagcctaagtgaaagagtgagaccctgtgtgtaaaaaaaggaagaaatcatcttagtacaagttcttccttttgaagaatttcagacacttaattgctttgtttgtgctaactctttaaggaagcggctgggtatagggccagctccctggggggagcggtgaagtggggagtggtgaagtggggagcagtgacggtgagggggaggggggaccggtgagggaggaaagcggtgtggggggagcggtgaggtggggagcggtgaaggagggagcggtgaggtggggagcggtgaggcggggagccgtgaatgggggagcggtgagggggcaagtggtgaagcggggagtggcaggtcctcctctacggtggctgttctctgcccctcaccctggggtgctgctctgccgcccggctcctcacactctcccttggattcgaatgacagcgtgacctcgggtcccctattcctgtgccct

SEQ ID NO: 1991 - DNA, 4502 bp, Homo sapiens
cactcgcgagcagcggcggccccgccggcggccgagttgggagaatgcggcggcgctcgcggatgctgctctgcttcgccttcctgtgggtgctgggcatcgcctactacatgtactcggggggcggctctgcgctggccgggggcgcgggcggcggcgccggcaggaaggaggactggaatgaaattgaccccattaaaaagaaagaccttcatcacagcaatggagaagagaaagcacaaagcatggagaccctccctccagggaaagtacggtggccagactttaaccaggaagcttatgttggagggacgatggtccgctccgggcaggacccttacgcccgcaacaagttcaaccaggtggagagtgataagcttcgaatggacagagccatccctgacacccggcatgaccagtgtcagcggaagcagtggcgggtggatctgccggccaccagcgtggtgatcacgtttcacaatgaagccaggtcggccctactcaggaccgtggtcagcgtgcttaagaaaagcccgccccatctcataaaagaaatcatcttggtggatgactacagcaatgatcctgaggacggggctctcttggggaaaattgagaaagtgcgagttcttagaaatgatcgacgagaaggcctcatgcgctcacgggttcggggggccgatgctgcccaagccaaggtcctgaccttcctggacagtcactgcgagtgtaatgagcactggctggagcccctcctggaaagggtggcggaggacaggactcgggttgtgtcacccatcatcgatgtcattaatatggacaactttcagtatgtgggggcatctgctgacttgaagggcggttttgattggaacttggtattcaagtgggattacatgacgcctgagcagagaaggtcccggcaggggaacccagtcgcccctataaaaacccccatgattgctggtgggctgtttgtgatggataagttctattttgaagaactggggaagtacgacatgatgatggatgtgtggggaggagagaacctagagatctcgttccgcgtgtggcagtgtggtggcagcctggagatcatcccgtgcagccgtgtgggacacgtgttccggaagcagcacccctacacgttcccgggtggcagtggcactgtctttgcccgaaacacccgccgggcagcagaggtctggatggatgaatacaaaaatttctattatgcagcagtgccttctgctagaaacgttccttatggaaatattcagagcagattggagcttaggaagaaactcagctgcaagcctttcaaatggtaccttgaaaatgtctatccagagttaagggttccagaccatcaggatatagcttttggggccttgcagcagggaactaactgcctcgacactttgggacactttgctgatggtgtggttggagtttatgaatgtcacaatgctgggggaaaccaggaatgggccttgacgaaggagaagtcggtgaagcacatggatttgtgccttactgtggtggaccgggcaccgggctctcttataaagctgcagggctgccgagaaaatgacagcagacagaaatgggaacagatcgagggcaactccaagctgaggcacgtgggcagcaacctgtgcctggacagtcgcacggccaagagcgggggcctaagcgtggaggtgtgtggcccggccctttcgcagcagtggaagttcacgctcaacctgcagcagtaggagggtccgggaggccctgccgtcctgtctcctgcaccattgggtggagtctggtgatcacattattgattatgtttcttaaactttccgcgaaactaatatacctcagtattccatcatggtctgaaagtcaaacttcggcaaggcacggacgactgtgcagacacagcagcggcaagaagcgagaactgccctccccctcctctcggtgcagcccagccgggcccccttccccaggccggagcgcccctcttccttccagctttcacttctgccggctccgcaactgagtgacacccagcgacaaccgactggggagtggtagaagcaactgaacggatgcgtgcgagctgaggacagggcgggaggagggggcacacatgccccaggggagcgaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaagaatgtacggtcagttccctatggtttctgtagatcatcgtcatcttgtatattccccacaaagccgttcgcagcttccgggagaaggggccagagcccggtggggccagtttctcacagagggaggaggtggcctttgtcccctggagcccgatcagccagttggtgctactgctgtggccagctggggggcttcctccagaccaccggcctcggccccggcatccctgttgggcgtcagcctgagagtccctactgtgcgtcagaatccaccttgcgtgctgtgcgtatctgtgaacctggagcggttacttattttgacagatatcactttgggtctttttacattaaatttcttttctctaaggaatataagacataccccatagctctgtgtgagccagcaataccgctgccccctggcgacagggcagaccaatgatgccaggcagctgtcacacgctagtattggcttcattgtgatctgagccctgcacgctgggccttcagaattaatggccagcagtgtcagggatgagcccgtcagccagggcacaggcctggctcacagtcctgcacacctgctggcctggggagctccagccaggcagcgagtcctgccccgcccgcagctccctcccacaccccgcctggccaagatgactgcttcagggggctttggggaaagaattaggaagggtcagaaccaaacaatacctgctcatttacactgaggattcagggcgggagacaggagccttggggtcctgttaaaccacagacagttatgaactgaaagtcataacggggagaggtgcctggcttctacctgggtgctcaggaatgttcctcgtcacccctgccactctgtggtcggtgccctgcttcctcctccactcctggccgccttctccagcgccgcacacacagatgctcggtctcagagaggctggcacggcctggcagtctgagaaaagcgtcagttaggcacacctgcaggcccctcggtgggacagcggcggccttggagttaggagccaccctgggaggttgtgccggtgccatgctcctccctgtgtcttgtatgaaaggggccactgtgtgtcttcctccccggcgggagccccacatgtgtgcactgtaggacagcggccccgaggtggaagcctggctggagggctgccctataggtcttctcttcccgcctcccctgccatgcaaccagatgtgttgtgagtgggcagcgtgcccccacgctggagtaactccgcacgcttctgtctttcacggtgggcgctcggggggagcctgaggaaaacccccttaggtacctgtgcgaggctgtggagtgcaggccagagcagggtgtgcgtagcccccagcacccaggttcttctgtcagaccctgtgacctgcgagctgctactactgtaaggagggaaatggatgaatctggctcgttttaaaatcacgttttctgacgaatcctttgccccttcacctttaccccgcccgcacccctaggccctctcagccttcctatcatctcacgtgtctacccagacccttgtgcggcccatgccccgggggcggcgtcctgtccctgagctgggaggcggctttggatggtccgggcgtcaagagcaggggtgggccggggaggggtcctttgcggtgagctatgtttacatgacacagtgtgccaaagtgacttactgcggttgcgttagtttctagtcatcaggactatctcaccctcccactcctgtttttaaaactcagaattctttcctaagagcccttcgagcaaagcgtgccgaagttagttgtcttctctgtgctggtcctttcttatgtcctcataaaagctcagatgatggtatctgtgagtatgttttgcaaattcaaaatatagtttggtaatttttttttccagttgatttttaaaaagaactgctgtacagagcttgtactttgtccattttatagatggaaaccatccttgaaaattgtttaacttaaataaagagaagatactttctagataccgctctttgctggccagagtctgtcctggtgtgtgagggctgggtggggtgggtgtggggactgggattggggtc

SEQ ID NO: 1992 - protein, 571 aa, Homo sapiens
MRRRSRMLLCFAFLWVLGIAYYMYSGGGSALAGGAGGGAGRKEDWNEIDPIKKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRTAKSGGLSVEVCGPALSQQWKFTLNLQQ

SEQ ID NO: 1993 - DNA, 39924 bp, Mus musculus
  misc_feature (1)...(39924): n = A,T,C or G
gaccttttcttatgatttgactggaactggggattcttgtttagaattccacagaagccatgctgtgttgcgcacccctgagtgcttcctttcagggtgtgtgatgtttgaacgatcgatagtttggtgaagatgctgcctgtggggttcccattgtacgttcactgtccctttagttccagcctttgttctttgatgtccaatgactatgcccagtcagcaaaagggggcagatggaagtcagttctggaagcaagacttagctgcccgccttgcttatggaaggaagatttgtctgagaaaggcgtttaaaagctaattccagattattagactacaaagagagaccctgtctcaaaaaaaaaccaaaacaacaacaacaacaacaatgaacaaacaaacaaaaatgatcttctattgtccaggtatcctattttttattgatgttggaacaaaacaacccattgcctatgatttttgtgggttctaataatgtacacagcatatgaggcatctgtataaaatgatttactttctaatagagaaagagtttaaagagaagccaacaacaaacagtcgaggtaattacatattagtgtgagcatgacagtaagagagcctgcaatatgcacgagagagactatgataactcgggggtggggggcatctgagagattacaataccacaaggtcagcccgagatgcggatttcttacagagtagttagaaaagagaacaacctgatttgtgaaactctacggtggtctagctgaatcaggaaatggtcctggccatttcagaggtcaactcaacagggccatgcagatttggttaaacattgctctgggcctatttttaggctgtgtgtctaagtgagattaacgtacgaatcagtagagcaaacatacatggactacctacccccagtgtgtcgggtgtttttggttattttcttattgctgagaccaaacacctgacaagaagcacctttacaagctgctcgttaaagtgatttgtttgtcacgtgaggagatccagtccattaagaaggggaagaggtagtgacaagtgtgttcagtagctgactgtatcctggtggataattctggaagctgaaggactccagctagagccagggcccgactacaacccacagtgtctgcccttccagtaacttgcttctgcgagtgtggccccactgcctaacaatttcataacttttgataccttgcctccatttgagaaacaagtgaacctgtgagggcatttcacactctgactgcagcaaggggcatcttcaaatctcctgaagaccttcgtgcaaccaaagggccaagggtgggatgtttgctaccttgctgtccctctgaactggcacattggtcttttacctttgtggatgaagctgcaagttacatgaccagctctcctggttcgcaggctttctggttcagactggtataacaatgcaggttctgttatttctgcagcctgctggctgagtgctaacgcgtgtgcccataacacaacaggagttcgttgtggttactcttcttcacccacattcatctattactggaggcttggtccttggggtggcaatatttggatctgctgtggactttgaagaggtgggacctagtgggaggttcattggtctacagggcgtgccctcggaagacactgaggtattggtcttcgcagcccgtttagcctttgtgaatgaatggactcttcataaaggacaagcctggcctctccagtgcgtctgacttccacaccatctctctctggcatgaggcagtacagccgacggaatgttcatcggatccagtactatgctggttggactttcaccttcaaaaactgtggcctacacagatttctgtttctttataagtagcctatgtcgtgtatttttatggtgagggcaaatctaccaatgctgggctggagtggcagagagagagagagagagagagcgagcgagagagagagagagagagagagagagagagagagagagaggaatgggagaggaaaagggaaagagagagggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtctatgttgttggttttaagggtctatgcctgcctttcctttctaacctttctctcccacctagtgttggggagggggctggaagggattagggtagaataagggttggaatggaggtagagttacaagaacccaataaaatagtaaaaaagtgaaaattttctttaaacttgtgcttcttggaaaaactatctttgggcaccaagttatagactatgacaaataacttccattttcttcttagctcttatttatattttccaaatgctacataataatcctgcctggccttgacgatctgaaggagtttctttttaaagagaactattagactgtgttaataataatagaactattagaaatgtgttagagctgggtggtggtggcgcaagcctttaatcccagcacttgggaggcagaggcaggtggatttctgagttcgaggccagcctggtctacaaagtgagttccaggacagccagggctatacagagaaaccctgtctcaaaaacccaaaaaaaaaaaaaaaagaaaagaaatgtgttacatatttaatacagaatgtccaatatgtggcaacttgatagcatatcagacagtccttcctcagtgactcgaacttgaagaccgtgtttaaaaatgagttatcaaaggtttcgtacagtgatcacgttgcttcctgctctcttcatccaaacggacaacaccaggcccatcaagtatatacccaaaaggcaaaaaccgtccctagtgtcttgtaacttttctgggccatggtatgcagcaagcaccttcagatcactcacagagagccccagactgcaaaccacaccaacagtgtacagtggacatgggcgggacattctttatgagagctccaggttgaatcagttggagaaccctgggctgcaagctgctcagtaaacactgcagggcgtgcactttgtacgacagccatcttagcagaattacagtggcttttggtcattcagtctttgggggttcggggtttgagctcctccaagctttaagttattcctgacttgtcatcctttatgcttgaagcagctcacaagctctgtaagtgagtagctatttttcttaaatctttcttagctgggaaaaattactttagctaaagtatattaattcccacagcttaaaaacaaatacttgttctttttatagtctcttgtctctaaaaatggtctacatatgactattgagtaaatataacaatatagacataatttataattaaaagcacagaactgatatggccaacttgtccaggaggaccctaatctgaggtgggtgtcagggagtaatgtggtgtggatagcactaaagcccttgtcttggcctaatggacacttgggggactaattttatgtggtacagcttgcactgtgttttggatgttcagcaccaatatatatgacctccacccaccagtagggcagaggtccagccccccaaatatgaccatcgaaaatgtcaaacgagctagagaaaagaaaacgacttccagctgattaagtgcggtgctgggcagaagaattgcaaaaccaagtcctttgggcctctgccaattcaaattgttcatttggctctgtggtgaacacgttggttaggttttgcttttttgttttttttgtcaatgtgacacatactcatttaatttagatatcaactccatccgatgggccggtggccatgtcggtggggcaggtggtcctggcttgttttagagagtgagctaagaacgccagggaaagcaagatggtgatcatcacccctccctggtctctgcttacgtttcttcttggagctcctgccctggtgtccctagacgatgcactgtgatatggaagtgggaacccaatgaccccctttcctccccaagtggcttttggtcagcaataaaaagcaaactagagcaaccagtctctactgactcacccggcaaccaccgtaaagcacggacacacagacgtgttcttacattccccatgtaagaactttttaaaaacattgtcttatttatttacattccaaatgttgttccccttgcaggtactccctccaggaggcctgagtggccagcttagcaagcaggagagaatttgcccatataaggtacccatgcccaacagttcactaaaatgaatgcttattgcttttaataaccataaactcacaatacattactggtacttagaaatgtccctaacattatttaaaaaaacagacaaggtcttattatgttgtcaaaactgatctcatactgtttggactggagggatccccctgactcaagaaaagctgtttctagcagctgcaaggcattgtggctggctgccctctttttccatctactagcaatgctctccaatctcatacactcccacaaatattatctgaaatattatttcattgtatttctcatttcatacttaaataaacagtcaaatctcaagatatttccaaacattaccctagattacaatctattaattaaaaccatgtggcttatagaataaatagttcctaacaaagaaacatgtcattttactcggttacttctctgtttctgtaaaacaaaaccaaaaacaaccccccaaaacaaaaaaccaaaaaaccaaaaaaccaaccaaccaaccaaccaaccaaccaaccaaacaaaaaccagcaaaaacatgaccaagagcaacttgaaaggaaatgcatttatttcagcttccattcccaagtaagtccatcacttagggaagttagggcaggagttcatagcaggaacctggagccaggagctgatgcagaggccctggggagcatgctgctggcttattcttcgtggcttgctcagcttgctttattataatacgtagatcagaccgtcagtctagggatagcattgctgggctgggccttcccgtataaatcattaattgagaaagtgcgcctcaggattgcccacgggccaacctcatgggtccattttctcatctgaggttacccaaatgactctaacttgtgtcaagttgacacagaactagccagcacagcatgctaagacatttcagaatcaactcttccctctccaaagggcttgttgtttgaacaacaatggaaaatggtcagggggcattgatttcctctctgaagacaaattatttcattttttttttcttgtggagaactctgaaaagtggatctgccactgcgggattcatatcttcaagcaaggacctttttattgccccaccccctcacctccctcgttcaccaagaggggatttcatgggagtgcagccggatacacacacataggctggccctcctgatcctcctgcttcactttccaaatgccaggactgcaagcttgagtcatcctccacgctcccccctcaccccttccatctttggtaaaacgagagcgatgacatctgcacttgggagctgttaatgttacgctgtgaaataacctggttagagctatcagctgtttctgacattcagggtttttgtaggtgtcattctgtgggtgtcacttttattcttccccctccccccagcactggttaattaatatgcagggttcagttacagaacgaaaatgtgctcctgtaaaaaaaaaattatgaagagcactagtcaacagcagaacattaaagcaagcgtaggtcccgtgtgacccacggaggagctaggtctgcatgcttgccagcatctccagggctccacttgtccatctttctactaaattaaaagccacacttcaagtccgacaattgacaagggaaataaatgcaactcagtaatgaggactggactgtgtgtgtgcgcgtgcgcgagtgcttcttttccatgctggcttgtttaactcaggcaacatgctgaatgttagttagccttcgactcctcggacaggactggattcctaggccaggctgtttcggtggtttgcatcattctcaatcgtggagaattggaagaaagaaagaatttagaaagaaaaaaaacaaaccctagttgtttacaagtaattggaggcttgatttatagtccaagagacactcatggccaaaaagaaatttaattctaaagttctgtttctagttttgccaaatagaattcgctgaagaggcagcatgtttttaagaaaaataaagtcatgacctgtttctttctttattgttgttatacacacatgtatgcatgtatatctacccctaagtatataaatacaacctgctctgtctgtatgatgttactgagatgtggatggtttcagggttgaccacttggctttgataagcaaagcagggtgaggggtctttcccggggaaggctgctcccagcattccttacttgcctgtagctctttgtctagagagctgaggccccaggagattatccccttctgtgctggtgtgtcttttggtgtcgtccttgctcatgtcctgtttaggcagacactcttgacatttctagacgaaatcgcccatgcaacttcctgttcctgctgttctcacactcttactactgtcatttccgccatgatctctgggccttaggtgcaaggactgtgttgtagatagaccagttggtgctgggggaccacatggtcatgtgttctcagcatctggactggttgtggttttctgtaaaggtttacatctgttggaagacttttttttgggggggggtgagacctatgcttatgtgtaaggatgagtatttagaatgtcgttaggaattatggtgattttagtaaactgttctatgtaggctctcctccaaaatccataacttcattagccctgggtagttggctaggtttttactaccaagcataatctttagatgaatggtcataaccaattcaattagagagctgtcggttatagctaaggtatgtgatatagctaaggtatatcctaagctactgcacccttaggatatcatgaacgctggccattgatttcaaaggcagcacagctgggtaggactagtagctgcttccttcccttagaaacttacagggaacagtatggtccttaagatttgattttgatcctatgtagactttttttgggggggggggattactccatatgtctaagaattaaatatgcaatggtgatttgtaaagaaatatattggacacacacacacatcatgtcacttgctattactctgcatggctgcactggcactttataactttttttttaagaccctcacttcatacttgataagaaacagaatcacagtgcccatgcctataatcacagaagtgctttggtcaagggaagaagatggagagttagtgcatggccagtctgagcaaggtagaggaagtagagaagatggggggtggggggagagaaggaggaagtagaatcatgtaaaaaaaattaatgtattattcacatgtatgttaattgttcatattttattctgagccaaatgagaagaaccatatcttgtatggaaatttccttctaccttgaggcatcttgacagctctggactcatcagccctgttggggtggggtttggatgatcggggtggggtttagatgatgcagttgcctttgggcttcccatgctcctgaagggaaccccttcacccacactcctgtaagcaacctcagtaaactcagtggtcgagcaaggtgatctacggtggtgtctctgctttgttctgtcagtttcctatccagggtgagcagacttgtgtcccatctccccaggaagtttcacaggacgcttcggtagagggacgtggatttttaagctaccccagatgacacattgcaaaatgaaagtggcagtgtgaacatttttagtcaaaggaatagaacagtcgggacatctaataaatacatcgaatccagcaaatctttccaggggtttccagatgttaccgcacttggtagaggttctcgatttgctgaatttaacaatacattccaggcaaggcacagaggctgaaagtgagtggctatttctctaaagggcctaaaacagccgatgaaggctgttttgtcttttgacctgtgtgctgattagttttcccataaacttgaaaccaggtagagtcatcccggaagaaggaatcgcaaatggggaaacgcctccatcagattggctggtaggcactgtctgtgtggagtttcccctgttaatgattaatgtgggagggcccaacctactgtaggcagtcctggccctgaggagttgcttctgggccacttcttctggagaagaaagcaggctgagtctaagccaaataaaccctcttctccccgtgttgcttttagtcatggaggttatcaaacccataggaagcaaagtgtgacattttctcgctacaatcagtatgttctacttcaccaaggtagagagaaaagtgtatcagaagaagcacacagaaacgagtatcaacaccgcagcacacatgcaccccgagaggaggcatggatgcagtgagctcctaacgtgctaggtgcttcatagacattaaaatatgaaactgtcttgttctttctccatttacgtaatcgagtgtatgctgttttgtttgtttttacagtacgggttcagagcagttatataacctactcaaagtcacgtcagcaaaatcagagtctggaatggtgattttatgacccgaagctcgtgagtcaaagccctactttttttttttttttttttacataaaccaatctggggttgaatgcatcagtttctctaaataaaacaaatctcaacaaacctccacatccttgctagtcacatcttttacttggtcactcagggttaggggttagcattggaaagaaaatatatttaaaaagtgatttttttttctaacatgagccgaacactgaagctcataaactcaaatcaacaaaaactgaatcaacaaaaggaaggaatagggttgaagagatgtctcaggggcgagaatgctcgctgctcttccgtggaacccaataacacttcctagaaaccagagttcccagaaaccaccaggggctcacaaaccccagttaattccagttaactccagttcctggggatccaacgctcttttctggcttttgtgggcgcttgcattcacacagcatacactctcacacacatgtttaaaaaaagaaagaaagaaaaaaagattaaagaagagagaagaggaggcatctggctgggttcttcctactccacttaccgaccacaaccagatctttcccattctccccgcctctgccacgctcgggctgtttcgcttcagtgcgcaggcgccaggctggaggctaggccgtggtttcctaggagaccgtgcagcagctgcggtgcggttggcccgaagggaagatgggggtggagtcggaggaggaaggcggccccgcggaggaagaagacgctcctcgtgccatggagccctcgcacgcgggggcggcgggcagctcgcggggtgcgcgccctccgggtgatggcgggaaagggagggaaagatgtgaagggcgggagcccggggcggtcgttgggtcgcggccttctggtcctgctcgggcctggggagtgccgtgttggctgctgaagcctgggggtgacggctgcattcctgcgcacaccgtcggggtgcacctgtctccatggcgggcaggacttttctgacctcccgtggggacccctgatgcttcttgcgactccaaatcagagaataggaggattttgtcgccccatgtatgcttagagacctagcctcggcctagggaggaaaggcttgcccgaacctagcaagcaggctggagtccctaggtgatccacttccgaccccaggccgtggttcagccttgtggcgccaggatctgcactggattcccattccctgacacttcccacctccaggtaacagaaaagtagtggcagaacaaaagttgtgtttcttttatatcaacattttacatctcctgggtacatatatcaaaattaaagtctgtacacaaccagtcctctttaatggaagacacccattcggttttgtcagtttccccacaaatgcgcttttcctagcctagggttggcattgagcctgccttgtaacaaaggaaggcaactgttccctgttgcttcctgtcacactcatatcataaactgtttacacactggcctgatggtttcaggtgcagccgtgaccccagtttttaaaattagatactcagttttgttttgttttgttttgttttaattgagtgcttaaattattcgttttctgttgcacctcacactgttgtaggcactggggactttaaaacaggaaatcttaacgcttgtggggactaaatttagtgtcttggaacccacaggttgtgttggtttggtgtttttaaatgtaggaacaggccactttgactagttctccagtcggttgaaaataatattgctacagtttcgttgcctctactgtttaaaagcttctaaaaaacttaacatagtactaggttttgtgccatccattatttatcaagagttcccccctcttaaattaactactcagaaaaggaagtagctgaagaaattctagttaattaaagcaggactgaagaccttttttgttgatggcgttttatgtctttatgttttgtagataccgtgaagcagataaaaagctggcattggatacttcataaatccaaggggtctggggacaatgttgaattgaagccactatatatatgttctttattagatgaaatgtttaaagggtctgttagttgctcattgatgataagcagcctaaatatgttggttttcttttgtgtattgtgcagcagtttgcagtcaagggccacctacacaaatctcttcgtcgagagtcatagtccacgtagatctggattgcttttatgcccaggtcgaaatgatctccaacccagaattaaaggacagacctttaggtaatccacattgatggtggctttgttgagtgatgataaaattagcaattagcttcaaccgttttttttttttttttttttttttttatactaactgtattaagacagttnnnnnnnnnnnnnnnnnnnnnnnnnnnnnnnnnnnnnnnnnnnnnnnnnnnnnnnnnnnnnnnnnnctagcttgcttctgtgggctcaagccttaagtaaggaaagcaggtttatgctcgcagaaaggatcttttagtattagcacgaagggcagtctttggggtccctgcttccttccttttcttctagtacctggcttgatgccataagtcgtactccagcctaggactctgtgaatcacaaagggatgcctgggtttcagttcttcagggtgacactaaacctgtaagctttcctaagaggccaaggatttaagttaggccatcgggtttctttttttttttttttttttcccctctgaaataatttctaattagcacaagatgcccagtagttatttcatactaaaagtattttgtggtgaagaagtagctataagtggttatcatgaagagagagtgtcaggccaggcatactgtggggagtccttttagctagggaggagtttgccagtctggccttttataatatagagctttggagtcatggatagctacctttgactcagtgactctcagatattgaaaaaaactgtatctgcaacactgatgttatgtctgaggatgtcaggttcaataatatgcaaaaaggatgggttaggtggtttctatattgtcattctctgtattgcaggtgaatatgacttacagtgttatgaaacaatcaacttgtgtaagaagaaaaagagcatataggtttagcaagcttaaatgcttggtacattttgttttaatgtgttctataggtggtcataatgtaggtggtcataatgtcaattttaaaaagaagccctaaataattcctcatggtagcactacaaattattatgagctatagttcattgctcagggtgtttattggcacaagatttctcacggtttctgtagcttggctcttagaatattgcttctattcactggcagtatggtcagaagataaatgagtttttaataacatcaaccagtatttaattgttttttttttgttgttgttattttcatcgggcttattgtttggtgaacatacccaagagtattacatgacaatataaaattaattgggctttgagttgtctgaaaagaatcttagaaggatttaatttatgttttatcactgaaaagtccaaagaatatattggctcgaggataatttaaatgtgagaaacacagcttccctttgggaactggtatctgtccacattcttatatgtaacttctgctacaatttttcagtgttttcatagttaatatataatttcttttttctctaattattttataatgtgtaagtgggaaatagcttgaaaacctgatgcttcttaggaatcggggttcttcttctctcagttatctttttgttcttgtgaaaaacccactcagctgggcaaggtggtacaaaatcctgtaattttagcacgtgtaaaagggaggcagaggtgggaaggtgagaggccagcttgtgctacatggtgagctcaaggccactgtgaaagggagggggagggggagtgtgtagcaaaggccccaagagctctgaactagcagtgctgaagcccttgacaagcacgctcaaggctgtgagtttgaaccccattgctgcaaacaaccacagctgcaaacagtgggttaccacctacgctgttacagcatgaagctaggaagctgtattttaaaatgctcaggtccgcagtttccccaggtgcttatttatttatttatttaataggtgtgcaacagaaatacttggtggttacctgcaactatgaagccaggaaactgggtgtgaggaagcttatgaatgtgagagatgcgaaggaaaagtgtcctcagctggtcctcgtgaacggagaagacctgagccgctacagagagatgtcctataaggtcacaggtgcaagctggatgccggcgacttagcatgtttatgtagggtgactagttactatacaaatatccatagaaaagtgccatatatggagttttttttttacctaacacttaaaaaaaaagggcctttcccactttaaaaatccttatggagttggcagatggctcagtggaaggatgctcttgatgttaaacgtgacagtcggagttcttcgcggggcacccacttggtagaaggaaagaacagacttggacaagttgtcctttgatctccacacatgttgtcacatgtgcccccttcctccatcaacaaattaaatgtaatacatttttcttagctatataagatgacttcatatactcccagataaataaatacaaatttttaattatataagtaggccgctttcactattgcagctgtgaggaaaaaatgaatagccatttattccttgacatccgcttcaagattttaactacctcttaagcaggggttgttttatttatttgttcttttagtggactacagataaaaaagtcatggatgtggaaaaagactgagttagatttattcctgtgagtcattgtcctcggaatattatttttgggctttttttctttgaatataaccgttactcaaaagtctgttaactgaggaccttgtccaagatgctgtgcggagcttggctggagagatggctcagctgttaagagcactgactgctcaggtgatctgcgttcaatttccagcatccacatggggttcacaaccatctgcagctctcgctggcctctctaggtaccaggcacacacacacaatactacacagacccacatgtcaacaaaatgcccatacatataaaataaaagtttaagtaaaaaattcaaggtgggaaactggtgcatatggtatcatacatatgatgtgcacatatttcatatgtcatatttgctaccttaatcattaaacagtgagatcgcttctagtttgtaacttaattatatctgtgtcccaatgttatttcaattagaattgttggaggaatttagtccagctgttgagagacttggatttgatgaaaattttgtggatctaacagaaatggtggaaaaaagactccagcagcttccaagtgaggaggttccgtcagtgactgtgttcggccatgtttacaataaccagtgtgagtgcttcctccgagccccctcggtgactgtaagtgcacatatcccatagccagtgagctcactgacagatgtgtcactatgtcattcggtgtctaaggtggccaaaatgaagtcttgccagtctcgtcaaggattcagaaaagtggagtggtgtgtagggcggtgcccctcgaggtgtggcttagctctctgaggccattaacctcttgttctttctgctccttatttttaagagctctacctctgtaggttatccttaacttacagatgttgacttagtactttttgctttgtcatttttttttaagatttatttttattgtatgtatatgagtacaccctcttcagacacaccaaaagagggcatcggatcccattccagatggttgtgagccaccatgtggttgctgggaattgaactcaggacctctggaagagcagtcagttctcttagccgctgagccatctgtccagcccctcctctgtcatctttaattctgcattttgataggctaaatgtgttgtcgattccttctgaccctctgaggactgaggtcccctgctggatcctggccacatcttgtccaggccttttgtcacaggccagtctgctatttgctgttgacctccccaggcttcaggtaaccagttcaaatgaccatcagtaactcgtggcaaaaagcgacatggtttatccccacatatgaagaaagtgtggaagacagatgtttttcctggggtactcacaggtgtaaataagttgtagttaatgcctgggaatatctaattaggctctgacacccatgactgctggagaatgcatgtggaggaccagcttttcctgtcagagcggcctgacatggtcggtcctatgtctcagcatgcaccccctcttatgcccctctttagagtgtcctgtatcatcaccacagacgacaggggcagaacctctcttctaggagacatgcagtctctcctatgtagtttgtacctgtgcccttttgtcagtccctagggtgaaaagccagaaagataacagatacatctttgtgcagcttttaaagctagcgcagaccttactgtttagaaaaaaaatgagtgtagagagagctggatttcctatttcaaatgaagaatgcctaattacttagtactttttcttcctttatgtaagttatttaattgaaaccggtctcactctgtagcctggctggcctggaacttaggtgttgaccaggatagctttaaattctgagatcagcttgcctctgcctcccgagtgcctggctcctcatagatctaaaggcagtttctttcaaaccagtatatagacaggcagaatcatggtgtggacgctctggtccgttatagacaagccagttatcactttggtacatttattttatcttgcctctatggactgtgtgtgcgctctcagctaggctgactgatgggccacgggggagtaagtcctgtgacagactcttcgtctccatgtccttccagcatgggtcctaggatgggtccacaccaaagaaaacgtgtttctttataacctccctatggtatcataagcagatctcctaacctgtgggccagtcattatttccagcaggttatgtggtgtgtgacatccagatgccattctaaagctctgtctgtctccctagtgtgtgtttccttgtgctcctttattggtaaaggtgaatgaagggttcatgcatgtcagctagaattgccaggagctgcactttcagtcagtgagggagcgctccctgcatgcattccttagcacaggcccttgggacctgctcagtttgtgatgacccagggtaaactaaggaagcagttagagagtggtgaggtgtcgggggttggaggaagagtgagtatcaacagaatcctgggctcttttaaccctatttgtgagagagaaaataatgcttttgtggtgataccattgtcgttatagctgtgaacctacacaacatcatgcatcggagacttgtggttggatcgcagattgcagcagagatgcgggaagccatgtataatcagctcgggctcacaggctgcgccggagtggctcctaataaactcttggcaaagttagtgtctggggtttttaaaccaaatcagcagacggtcttactacctgaaagttgtcaacatctcattcacagtttgaaccacataaaggaaattcctggtaagaccaatacatttgaagagtgtatattggctttgctgtgatttctttaaatatgcatttaattcctaaggacatacacttggcttttggagaaaaccaaaaacctgaaatgttttgtggaataaatctgtgttaagatatatgtgcaagtactttttccatacaagactttgagtggtgccctggagccatatggtggaaacatctttaatattgagagtagcttggttttgaaaagcaaagctgtcataacactgtgtgtgaatttctgctgtttaggtatcggctataaaactgccaagcgtctcgaagttctgggaatcaatagtgttcatgatctccaaacctttccaatcaaaacattagaaaaagaattaggaattgcaattgctcagcgtatccagcagctcagttttggagaggacaagtctcccgtcacaccgtcagggccaccacaggtgtgtgagcaggggctgcttatgatgctacttgggctgaagatgtctgctttcctgttcacccccctgctgtgcagtgctgtgctgtgcagcttgtgagtgatccttgcccgggagacgcgtattctgaaattgaaacttgcccgctagtagtcttaaatctaattatctgttctttgttactacttccttaagatcttgatacacacacaaacatatgaagaaaaccttttaaccttttaacacatccttgtttctagactaattcagtgatttggaaagtggggaggggataattacccagttagcaagggtgttttcctcatgtgctaggcctgtctgacatcgctccacccactcatcgcattgaatttcaccataacctctgagcgaggcagtgtagtttgttcagaccttccttcctgcccccgtgcttcctctttccctctttaagatcagggcactgcactataaaaaggttaaataacttctccaagcataaactcagattaaggttctagggccatgggaaccttgctgtagtcctatagaagaattagaggtggccttcgtgcgttacattgcatgactcttggtgcacaataacagtgcacataataactgcacacaacaggatttagcgcaaaagtgaatctggtgttactgattcataaagacaggtagtaaagaacatgttgagtgtttggcatgaacactgtgttagcttttccattaacccttatttattcttctttggtagtcctttagtgaagaagatacgtttaaaaagtgttcctcagaagtggaagctaaagctaagattgaagaattactttccagccttttgaccaggtgcgtttcaccttgcctcatcatcttttatatttaggctggatgcagaaccacctcatgttctatgttgggttttacaattaactgtgaacgaggcactgttattcaagataggtcatttgccattaggtttctcttatctgtgctcttaattaaaatgaccgacttgcattggttgtctttcaggtaacatggtggtttacctgatcttaagccacagtggttacctgagggttcttgagtcatctcatcataacctagactaggtgagaaggaggccctcagtcttccctgtagctgctgcagcctctgctgcagacagtaggactggcttttgcagttaaagggagccacagagaagaattcagtctgccagagtccccggtcctctgggtgatggctcagagtaggaaggagctgaggagcagggagagggggcagcagcagaagcccctgcctccctctctcagacgcttgaactcggagtcaaaggaagggatggctaaacagtgtctgtgcaatgcaagttcatacgaggggctctgagcagacagccaacagtgatgtgccaactgggatctaaatatacaaaaaaatgtaatgcaaactgtgcaagaaatgctttcctagtgttccttgttatctttcaaatgtgcacttctcaattcccataagaaagtagtcatctcccatcacgtcatgtccttagaagtgtcctaagttggcttagagcctgtgtgcttctgaagtgctccgaggatggctggctgtacagagatgagacagcctgatgtttgttgcacagatctgctgtcacgtgcagcacgtgcgttgctggctgcctgctctgaggtagagcgtgactcagctccagagagatggctcactctcttctggggactctgctgccgaaactgggtcatccactccgcctcagctcacgcgtaccctgaactcaggggccatggagaacggcccggtcctgtgcatgcaaacaccagaggcaatatatgtggttactttgcgttctccacctgaagactcgatccggaagagagcgggtactctaagcctctgagacgtcagacgtctagagtcctcagcccgagtctctgttgccagtgctccctaacaccacactgttgtgctgtgactgaggttaatagaagtcatgtgacaggtataaaataatttaatatatctgtgtgtctgtatatcctgtatatctgaaaatacagttttcttctagagactttactgactaatcctacaggtaggagagaaaggtcagctgtttttttaaagagccaggctctaggcacttggttaaacttggggttagcctttcccagtgtcctgttgaacagacctcaagtccgacgaggtggttggtagttcccacctaagtccaagtgctgctcttccaccattgttggaacgtggctggtgcagtgactgcttttggttcgtcggctttgccaggttgcattgtcctttctgatcctatgagccgctcctcacagatgagcttctcagtcagtcccagctctcgctcctacgccctgggtccagactgcacgctgtcttcatgagcaggcgctcactcaccttacaattctaggaatcggtctggggcaaggcagtagctgtgttgttttcagagttgtgcactgccctgccagcacttggaaggggcttcctcatgcatgctgcccgggtttctgttcagcagtctctggctcttggtaaggcattattacttcacgggctgtaacttctttaaaccacatataaatatataaaagtaaatatttatatgcagtttatgtgtattatatgatatatattataaaatttacattgtttatatacatacatgtataattttaggtaagcaggaaatctttattttttctttattatagctattctacacctcccctgccaactcctcccatgtcctcttccatacgtctttcagccctgtcttctacttctgcctcctccctcagtggccgtctactgcctttagctcctagctggtgggaggctgtgtatcccttgctggcatccatgctgatgtggactcctatccaccagaactgttggtggctcctgagtgcctcatcctggtcaggtccagaagacaatctcgtggcagttaccctggctcttactgtctttgtctctcacttcatcactgtccactaagccttgggtgtggtgtttgttgtagatgtcctattatttgggtttggccactccacgggtgctatgattctctgcacttttgtccatttgtgcttctctgtaattacctccatctgctacagaaagcagcttatttgatgtggaggagagctgctgtcacccatgggtattaggataagtatttagaaggcaagtagatgctatacctaccggttgagtgaaatggtagaggcaggtgctcctctagggtctgtgacctctccagctaaaggtttctgcttgtcttcagcaccaggtatgaagtccttctgttcagcagactttaaagccaattctatgtatgtatgtatgtatatatatatattggagatatatctatatttatatctagtgagagcaagcaggcaaagagagcaagcttccttcttctatgtccttatataggctgccagcaggtgtggcccaaattaaaggtggatcttcccactttaaaagatctggattaaaattgtcttcccacttcaaatgattggaaagagaaaagaaaaaaaaaaaaaaagccctcagcagctgtacccagccacttgggttttagttaattccagatgtagtcaagttggcaaccaagaatagccagcacagcttgtcattatgggagttctccggacttccagctgggtggggttcctgataactctttcctggtgtcctgcatagcacattcctgcactatgacagctagtcagaggagggggatgtggggagcttcaggcttagtaccagcttgatttctgcaagcccagtgaccagtgtgtagtgtctttagtacatcacaagttaggacattcaattaagagcagtgacaattgcatgtattgtcttgtaatattttttggcccacccccacccccaccccgaccccgacactggacttttgataagtgcatgggacttgtggggagcatcgcctcactgtaggaaggattccgtatggccttttcaccatcgctagtgtcactcctccctcctgggcttctctgcagtctaccctctcatctcgctctccagttaactctcccccctacccttgcccccgttcccttcatagaccagcgctccactgtcctctctacagggcttcccgctgcacagtccttttctccttggctggattgcacacctgctccaagttagaaactcctaagtaagagagaacgtgtagagtttgtctttctaggtctaggtgacctcactaggtttaatattatctagtacccaggccaaaatctatggccagattagagttagaaaacaactagctttatgtgctctttcattgcgcatgaccattacctgcattcgtccgtcctcgtccccatatagctaagcttttctgtcctcttttctttatgttatactgtactcctcatacacacacacacacacacacacacgtacgtacgtacatatgtatgtacatatctatgtgtgtgtattggctagattctgcatatgagaacatgtttctttctgagactgtgtgatcttgcttaatattgtgtcacaagtcaattgatgggcctctgggtatctgcccaggagtactatagctgggtcctgtgatagatttgtttttagctttctgaggaaactccacactggtttccatggctaccccagtttgtcttctcagcagaagtgaacgaggagtctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtagtgttgttttcttgatacatggtctttttagttctttatatattctggctattagtcctttattagatatatagctgtcatggctttgctatgttgactttgagatacttatttggatatttttgaacatttattactttattatttcattttctatggtgcatttagttgctatagttacaggatctgatacttcaataaataagtattccatcatcttaaaatcatgttaatttatcttattattgtgttttccatttctattttagagtatgccaggatggaaggaagccccatacagtaagattagtcatccgtcggtactctgacaaacactgtaatcgagagagtcgtcagtgccctatcccatcccacgtcattcagaagttagggacaggtatgggccagttctctaagaagatattgaactctttaaaaagcaaactttgagttagaaacatgccacattaaagtgttttcatgtattcttcaaaacatagttatattttaccaggaattaacattaggaaaactttttaatagataataaaagtaaatttactcaatcaactcagtaagtacgtagttaaaaatatttcctgacttcagaggatacaaatctaatataattataaagtacatttagtaactaatctcagatgcgtggggatcccaatttagattttaagttcttaatccaagtcatataaataatattgtgctttgaatactaataaaagtgcatgtgtttattacatccttctacatgttacttaggaaatcatgactccatgcctcccctgattgatatccttatgaaacttttccgaaatatggtgaacgtgaagatgccctttcacctgactcttatgagcgtgtgcttctgcaacctgaaagccctgagcagtgctaagaaagggcctatggactgctacctaacgtccctctcaacccctgcctacaccgacaagcgcgcctttgtaagtacaccctggctgcactgctgctaaacccaccatctgcattgtacctagtgcagtttggagattccctgaggtgctattgtttggatgatatagttgtttctagttcctatcacgggatgcttgctggccttaaatatactgtaatctaagaggaaaatgtaaacacagaatcagagagacagccattatggcgcttctgttttgggaagtgttaacacatttcctgggggggggtgtctatacaaacactatggattggcttataaatgtaaacatatctagagattaattaccactgcactaggattaggatactagtggaataatcgcggagctgtagttgagcgcgtgagtgtttatggcataggaactggaagggaaattcaggggaaatttatagaaaaatggagtaacttagcttgagaatgtttctaagtcttctatagatgtagtaaatattacagattaaacatgatatactttctttttttttttctttccattttttattaggtatttagctcatttacatttccaatgctataccaaaaagtcccccatacccacccacccccactcccctacccgcccactacccctttttggccctggcgttcccctgttctggggcatataaagtttgcgtgtccaatgggcctctctttccagtgatggccgactaggccatcttttgatacatatgcagctagagtcaagagctccggggtactggttagttcataatgttgatccacctatagggttgcagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtgtatgcaatggtgtcagcgtttggatgctgattatggggtggatccctggatatggcagtctctacatggtccatcctttcatctcagctccaaactttgtctctgtaactccttccaagggtgttttgttcccacttctaaggaggggcatagtgtccacacttcagtcttcatttttcttgagtttcatgtgtttaggaaattgtatcttatatcttgggtatacctaggtactgggctaatatccacttatcagtgagtacatattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgcctcactttgattttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaacgtccttcttgatgtcctctaccatcatcatgagatatgcttttaaatctaggtctaggttttcgggtgtgttggggtgccctggactgggcgaagtgggagtgctgggttctgatgatggtgagtggtcttggttcctgttagtaggattcctacgtttacctttcgccatctggtaatctctggagttagtagttatagttgactctgtttagagattgttcttctggtgattctgttaccgtctctcagcagacctgggagacagattctctcctctgagtttcagtgctcaaagcactctctgctggcaagctctcttacagggaaggggcgcagatatcttgtttttggacctcctcctggtcaaagaagaaggcccaaaacagggcctctctcagaagctgtgttgttttggcagttcccagaagctgtcagcttctgtggtacagactctcacctgtgcagactaagttcctaagttccagggagtcctggaaccaagatggcgatcgctgctcctgaggctgaggccgcctcccaagccaggcggacacctgtcctctggtccggacggtggccggctgtgtggggcccgccaagggtgctgcctcagcggctctgtgcttccgcccgtcccagaagctgtctggttctctcatgatatactttcattgtgctcttttgttactgttaaatgttaccttttagacaagcagtttttgggaaatcatcccttcctgctttgtgcttctatttttaccagcattagatctcattatctactgagttagatgtgcagcccatggtggctgggatctttcctcctgcgtgtcttgtcccctagtctgctagctagcagggactgcatgagtatgatgataggccacacagtagtgtgagacacgggatggattgctctctgtcaaggtcagaggtgccgggcaggtttgcaggtgtgtgagacactagctccaggagaactgcggcagtgatgtgcaaggcgtgcagactcctgagctctgctcttccccttgtgttgtagaaagtgaaggacacccacacggaagactctcacaaggagaaagaagcaaactgggattgtctaccaagtagaagaatcgaaagcacaggaacaggggagtctccgttggatgccacctgttttcctaaagaaaaagacacaagtgacttgcccctccaggcactgccagagggtgttgatcaagaagtctttaagcaacttccagcagatattcaagaagaaatcctttatggaaaatctagagaaaatctaaaagggaaaggaagtttaagttgtccgctgcatgcctctagaggagtattgtctttcttttctacaaagcaaatgcaagccagtcgcttaagccccagagatactgcgctccctagcaagcgggtatcagctgcatctccctgtgagccgggaacgtcaggactgagccccgggagcacctcccatccatcgtgcggaaaggactgttcctattacatagacagccagttaaaggatgagcaaacgagtcaaggccctactgagtctcaaggatgccagttttccagcacgaaccctgctgtttctggtttccattcctttcctaatctgcagactgaacagctcttctccacacatcgcactgtagacagccacaagcagacagccaccgcctctcaccagggactagaaagtcaccagggactagaaagcagagagctggattctgcggaagaaaagcttcctttcccaccagacattgatccgcaagttttctatgagcttccagaagaggtccaaaaggaactgatggcggaatgggagagagctggagctgcgcgcccctcggcgcacagataagtccagaaagccagggagtatgagtccccaggtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattatttctgttttatatcattgtcaataaaaggaatatcatggtcaacactaggctctcactgtaagttgtgagacagatgttttatgcctgcatgcaaaataggagctcatcacagcatcattatgcataggaaagaacgggctttggttttggttttctttgggttgtttggttgtttggtgtgtgtgtgtgtgtgtgtgtgtgtgtgtgtgtgtgtgtgtgaactgtgccgtatggcaaagtcagtccatgacatccaaataggaaattctcttctcagcttcaaaaggtaaatactttagctaaatcactacatacaatttaataagttgactttcttttgattttgtttctgaaataatatcctagtgtgtaacccagtccagccacagttttctgatctttctgccttaaccccctgagtttagagactgcattggggtgcaccaatatgtcaacctactaactggtttactggtttatgaagattttgtgtgttcaagtgtacctgtgtgtgtgtgtgtgtgtgtgtgtgtgtaagtgagagagattgagagagagagagagggtcattccatagaaaccagaaaggggcatgtaaccccttgaagatggaggcacatgtgtttgtgggccaccaagtgtgggtgctgggatctgaaccccagtcctctgatagagccccggacactctcaaccaccgggccgtcccctctgatagaactgtaagttccagccactgggcctccatcctcaccgcaaccaccgggccgtctccctctaatagaactgtaagttccagccactgggcctccatcctcaccgctgccttttcaaagagcagttcctgatttctctcacagttagaacttaccataatgcattagtacatatggaatgaacgaacattgtgcctttactaatgactgagataggtgtgtacgttgtagagcagtggctctcaaccttcctagtgctgcaaccctttaatacagcgcctcatgttgtgctgatccccaacctaaaatcatttttgttgcttcttaactaattttgctactgcaatgaattataatgcaaatatctgattatttttctgatgggtttaggggacccctgtattgagagctgttgtaggggatggtgggaggaggagcattatttgaaattattatgggaaacatgggcaccaggagtgtagagcgatgggccaataacactattagcactattaacaaagtccatttccgcctagacaatcagtctgcggggtctagaagccgtgggtgatgaacagctctgctgttttttacctcctgcgtattggacaggagcctaggatatgtcagaaacacaaatcattactaggtggtcctgtgattaccttccctttccctttttctggctaaagtatgatttatgattgaggatgtctcgttttgtaaagaaatttctagaataccaaagtatccctcagcgctaatttagaggggtcatcttgtggctgtaatttttgtaaatacagtctagagagttaaatataaatgtggctttagaatacttttttccaggtcagacattttgactgggctatagatttcttatggtttaactactaaatctgaaatgtgtgtgtttgttcgcagtgtctcatgtagtttgtattggtctagaactcactattgtacctgaagaggaccgttaactaatctgttttcattttctaaattcaggcatgtacaaatttagtttgcccagtagtttgagattaactaaaattatttgtgcccaagatacccagagttgtgaaccaaacaactatttagagctaatatagtattaactcataaaaggagtatcttagttgcggtgttaccactgtgaaccgacaccacgaccaaggcaactcttataaaggagaacattagggctggcatacaggttcagaggttcagtccattatcaaggcaggagcatggcagcatccaggcaggcatgatgtgggaagaggtgagagttctacttctcattccaaagacagagaagacggacttccaggcagctaggacaagggtcttaaagcccacacccacagtcatttacttccatcaacaaggccacacctcctaatagtgccactccctgagccaagcatatttaaaccaccacaaagagtatttcagtttggccattaaaaattgttttgttaatttaaaatattaatatgtttttcagtatgtatgcgtatatatcatgtgcaaacctagtgcccgtttggggctcagcataggctgccagatcctctggagcgggagttaaagatgacagtatgctccaaaaacaagtgctgaggtatctctctagtccaccactttcattccaatttggtatactggggtagatactggagtaacatgtagtctagagtgatgtcatcccatatggttgggagacatggaggcagagacagtagagcagagaatactgttacagagggtcagagactagggaatcaaggaggtttattaatagtatgtgtttgcaattcagataaatataaaacagcaaataaggaaatggagcatttaaaaaaatagcaccgattctgtgctgctagcacagttcatcctctgaccacctgacttcatccattccccactatgtccaacctcaggccagtcttgcccagaacaacttgcaccgtggcctagcctggtgagtgcctgattccaggtctttccacgcttcccagctccaccctgagggcgtgggtgccctgccagctgctaaaggaggcaccttcttgagttttcagatctatgttttcagtcatatggattattaaaaatacttgtgaaatttgtacacagaaagggtgtatatgcataaaatacaactaagtactttttttcgttactctatttaaaaatattagatgcatgtgaaagtataacatgcacacctggtaaatttgaggatacacagaaatataatctaagccatttccagttatagaggttgttaagagaatgcctgaggattatcctgaatattcaggaattcaacagctcacttcgtcacttgagggaggttcctgtgacattgggtagagtggagatagagtcctttctggagtggttacaggaaaagccaagtgatgacgcttttctctgagcaacttgaccttttgaaaacactgagactttactaagtacgggccccctgaagaacgaaggtgtagtttagtcatgtgaggatgaactataattgggcaactacgtgcttataagcaacaggtgtgcaatgaagcaagaaataagatccagaagttttacatttccaattagcagttatagagtgtacaaacgtaaagagaatgtatcacattaagtgtatgcattaggatagatatatatgtatcgaatatgctacttatgtagatagtacagaaattaaaaatgtggtcattttacaatagccatttattttaaattacaaaaggaactggaagaacattcagcatgtgcccgatttacctaaatatccagtggttgcttagtaatagagataaaatatttgagatgttagtcagtagaatacttttccttaggttggctagaatgtagagttctagtttgcctttgttatggatgggaacggcagtgctgggatgttgcctagagcctcatgcatggcaaataagtacgcaagccctacggatcgctccagcctaggctcactgatgactacctatccttcacccgggtaatgtacccgtgcagtatcggatttagtcctgctgttgagctaattccgtatttggttttggggagccgagtgatcagacgtctgcttcagacccttagtggggtcccgtgacgctgtgcacacccttgtcacgcaggcgcggaagcttcccctttatctggagtgattccagcctcactgacagatagtgttgtccgcttggatattttcattccagaatttctaggcacacgtaagcaagcatctgaactagtatgtggcaatgtttggtgaggattcacttcttgttaaagtccatcgaactataaacgtcattttcattgcaaaaaattgaaatgatgaatgtgaaattaattttatgtaaaaaaaacagcttccaaaggattggcagtttatgaaaacattcagagaatatagtatatgggtcattttataatggaacaggcttttggggagagggaggtctgaaagtaattgctacaaaagttggtacctaaaaatgctgtggtgccccacagaaatatggagtctgtggtctgaggcctctgagtaacaaggggctgaggaaacctagtaaaagttgcaatattgtcgagaaagttgaccaagctgtctacaaaatgtggagagcgccacctggtggcatttgactacacaggagtaaggtatcaaagacttgttttgtttgtttgttttttgaattcactttacattctgctcactgccctgctcctggtaacccctcccaaagtccctcccccatttccccccccttctctgaacgaatgggtggcccgtgggcatctccccaccctggcacatcaagtctttgctaggctaggtgcatcctctccactgaagccagacagggcagcccggctagaacatatcccacagataggcaacagcttttgcgatagtccctgctccgggtgttggggacccaagtgaagaccaagccacccagcagctgacttggacagatgcagagaccaacggcaaaacagtggatgaagcttggggactcttacggaagaatagaaggaaggattgcaggccaaagagtatccttgtcagcgcgaccaacagagtcaactaacctgcacccttggggccctcagagactgaaccaccaaccgaagagcatccacgggctggaccttggcttgtttcttttaagagctctgctttccccagcttacagtgtcatttatttttcttaatttttctatacccctcacttaagtcctcccagatcctccccacccatccttaaactgcaagttttcattccatgtgggtcacatgactgaaattgggtggagtcactgatttggcaacagtaagaagtttctggatgtgtaagcacacacacacacacacacacacacacacacactcacacacacacacacacacacacacacagacacacacacacacacacaaagtcagccatgaaaagcatcactgactgtgtggcttgtgttgaatagaagggctcatctactacacgtggctctgaatacaataggagcatcctgttttcctcactcagctctgtgcttttattccattgtgctcaaaaaacaagggacttactcacttttccctatatgttaagatttgctctatgtctgtgtgtgtgagagagagggggggagggagagggagagggagagggagagggagagggagagagagagagagagagagagagagagagagaactgttctgcagagatcttcaaattcatttggtctatcacgccatttcattcaggaccccccacccccaccccattttcttgcctggatgagagtggagtactgaagtcaccagtgctgtgctgggattaatcttatctctaagaatatttgttttataaaattaagtacgcctatgttctatgcctatctatttggaactgccatgtgcttccgatgggttcttggctaagtcattatgaaagtgacttttatcgtttttgattattgtcactcttgtcagcaattaaagcagtgattatttcccagtgttcctagtcacctggaacacgttgtccatcctttccctcttggtcagatggtttgaacgagatgtcacccctatatactcccaggcacctgaatattcagtccccagtagggacactgtgtccctgaagaagtatgtcacttggggttggacttaagtttaaaagcctgcacctttcccagcgagccccctgcttgcatgctgttggttcaggatgtgagctcactgctgctgcgccagccaaccatgttctgcctgctccactattccccactgtggtggcgatggtctcagaacgggaagcccaaagtgaaccctcctttctatgcggtgtctctgcagtgctttgcttgtggtgtcttcaagctgatccaacagtgactagtgaggtggcagctctgctttgtgatgtctcttagaacagaaacgagaccctgcacttgacccattacaccagggccttttcactgcaaaactgggaccaatgatatttagagctattattgatgtgtattatttcctctcactttgttgacttcggagtgtttgtagtgttttcttatcctctcgcttccccagtagttgaggagtggtttgtttaatctctgttgagatgtttgtctttcctgttagcctgatacccctggtgagaggctgagagctgccagtgctcacttctccagtggagcagccttgagctgaggaaggctgagggctgtgggaacgggagtgtttttcccttctgcctgaaatgtgacccagtttctctgtgtgacagcgctcaatcctatcactgttttaaaactttctgccactctggtaagtgtgctgacacctcagctcgaatgttacttgaatttacctaatggctaatgctgcttttaattagattcccttccagtgcattggccttggctactttttaactggattgtttttatattatatgttttgaaagctccttgtatattttaggaaagtgttctttgtcagaaatgtcttgcacatgtttccccacctgtcttttcatctccttcccaggggctcaccactcggactcacacagcatgcacacttaactttgtggtcactctcctttgtaagaatcgtgctcagctgtagcttatgggtagtttctaggatgtcatgtctgcgcgttcaagttccattgttagttcattattacagatggttgttaggaatggcacatgactaggtgaaggcctcttgctatccaagtgctccaatatcatttgttgggcaggtgtctgtcctctgctgaagtgcctttgactctgtcactatgaagtatgattccacatgtcttgctttctgaagggccccagatcctacgtaagggtccctttaagaaggcagcgtcactgtcggctgtaactagtgtaagagctgcgtggtgttatctccttagagagcagagcactgacggaccctgctggcaggcgtctgtggcagttcagctccatgtctgcccttgctcatcccttccgggtggcggtggacaagtgacttgcagtgacggaagcagagtgacaccgggcctgtgacttgccgccttgttcctcctcattgatacacaggggaagaggtgtatattttcagataaacatcactggctgttcactggagtggaactcttattgttttctgatgctaaagatggaatccaggctctttaaatgttaggcaattattctaccactaagctgtactctgaggtccctagtggaaatctttgaatttttatgttcaccttttccatgcttctcaatttaagcagtagataaaggaaaataatttaaaatgtatactataacccatttatttatttatttatttatttatttatttaatttattggcatagggtctctctgagtagcccaggctagtgtcattgtgctggtcctgttttagcttcttcacggcagggatttcaggtgcttaccatcactgccagatgaatatttaattaagttctaattaatgctaactactgacggtatctccttctttaggatccgaatgcacagcatgctcagatggtcaaagtgtattaacggcacattatttaatgttatgttagcttaaaaactgtatttaattgacttttcttgtccagtgaagttcttactttgacaaaatattttacgtactctgtacaaggttaatgcctagagacactgaacaggcttattcacgttgacttaggagtactctgcaggaacaaactccacttactagtaggctgtgctgtctgaaatcgctacggtttaatggcagaatgtccttctttctttttgtgcacagaggagtgcgaactgtgccgggcacgtatgggtggaattctgtacgtctttacgccatctttcacattgaggaggaagcttactaagttggaaggcatagacttttcaattaccgatgcaggcaattttcctttcatctctgtctggacaaaaatcactagcttggaataggctgggtttctgtaagtgaatgaagaggtacaaaagataaagcagccttcatctgatcttatgagacggcaagtttatagagggcaagattcttaaatcaagtctctttggcactttctacagtgcatatgacaagacagacagataactcaaggagggaaatggagagtggcctgaggtcaattataaaacattaagtagtcagagtatatattgaagttttacatccttatacaatattaagtagtcacaatgtacattgaaattgtagtttaagtacctcctccttttgttatttgatcctttgagcagatacacaaccctcagaatacagcagacctttgcttttctctggacacctgatctgatcatgtttatgtagcatttatgcagcacttttctatatgtaaattatgttcttaataagaaatataatatttgcttcttaaaataaataaacaaggaaataaaaagttatatatgttcttactatatatgcagtttttagggaactatatttaattttcccttttattataaacatagatccttttttcatacaataggtcctgattctattttccactctttctactcctcccagtgcccccacctcccctcccgtttgaatctattcccttttccatttctcacaagcaaagaacaggtttctaggggacaatgaaatacaagaaaacaaaatatattaggaacacaggactaaagctacaaacacattttctctcttacaaatttatattttaccatcccaaatcttatgttcactttatatatcaatattgatttaataagaaataacagcataaattaaaattaataaatatgtgtggtgatatatatgcatctatgcatatcctccacctcaatgcatgtgtacttttactgagcctatttatctcttgaccacctgttggcagcacctctaatctgactttggcagtttttatctgaatattcctattggatgtttcgttttgtggatattttataaagcaggtgaacccatggaaataattctctcaggataaaaatattcatggtttagaaatgcgggctgtattttcagggaattttatttta

SEQ ID NO: 1994 - DNA, 2283 bp, Mus musculus
gcagcagctgcggtgcggttggcccgaagggaagatgggggtggagtcggaggaggaaggcggccccgcggaggaagaagacgctcctcgtgccatggagccctcgcacgcgggggcggcgggcagctcgcgggcagtttgcagtcaagggccacctacacaaatctcttcgtcgagagtcatagtccacgtagatctggattgcttttatgcccaggtcgaaatgatctccaacccagaattaaaggacagacctttaggtgtgcaacagaaatacttggtggttacctgcaactatgaagccaggaaactgggtgtgaggaagcttatgaatgtgagagatgcgaaggaaaagtgtcctcagctggtcctcgtgaacggagaagacctgagccgctacagagagatgtcctataaggtcacagaattgttggaggaatttagtccagctgttgagagacttggatttgatgaaaattttgtggatctaacagaaatggtggaaaaaagactccagcagcttccaagtgaggaggttccgtcagtgactgtgttcggccatgtttacaataaccagtctgtgaacctacacaacatcatgcatcggagacttgtggttggatcgcagattgcagcagagatgcgggaagccatgtataatcagctcgggctcacaggctgcgccggagtggctcctaataaactcttggcaaagttagtgtctggggtttttaaaccaaatcagcagacggtcttactacctgaaagttgtcaacatctcattcacagtttgaaccacataaaggaaattcctggtatcggctataaaactgccaagcgtctcgaagttctgggaatcaatagtgttcatgatctccaaacctttccaatcaaaacattagaaaaagaattaggaattgcaattgctcagcgtatccagcagctcagttttggagaggacaagtctcccgtcacaccgtcagggccaccacagtcctttagtgaagaagatacgtttaaaaagtgttcctcagaagtggaagctaaagctaagattgaagaattactttccagccttttgaccagagtatgccaggatggaaggaagccccatacagtaagattagtcatccgtcggtactctgacaaacactgtaatcgagagagtcgtcagtgccctatcccatcccacgtcattcagaagttagggacaggaaatcatgactccatgcctcccctgattgatatccttatgaaacttttccgaaatatggtgaacgtgaagatgccctttcacctgactcttatgagcgtgtgcttctgcaacctgaaagccctgagcagtgctaagaaagggcctatggactgctacctaacgtccctctcaacccctgcctacaccgacaagcgcgcctttaaagtgaaggacacccacacggaagactctcacaaggagaaagaagcaaactgggattgtctaccaagtagaagaatcgaaagcacaggaacaggggagtctccgttggatgccacctgttttcctaaagaaaaagacacaagtgacttgcccctccaggcactgccagagggtgttgatcaagaagtctttaagcaacttccagcagatattcaagaagaaatcctttatggaaaatctagagaaaatctaaaagggaaaggaagtttaagttgtccgctgcatgcctctagaggagtattgtctttcttttctacaaagcaaatgcaagccagtcgcttaagccccagagatactgcgctccctagcaagcgggtatcagctgcatctccctgtgagccgggaacgtcaggactgagccccgggagcacctcccatccatcgtgcggaaaggactgttcctattacatagacagccagttaaaggatgagcaaacgagtcaaggccctactgagtctcaaggatgccagttttccagcacgaaccctgctgtttctggtttccattcctttcctaatctgcagactgaacagctcttctccacacatcgcactgtagacagccacaagcagacagccaccgcctctcaccagggactagaaagtcaccagggactagaaagcagagagctggattctgcggaagaaaagcttcctttcccaccagacattgatccgcaagttttctatgagcttccagaagaggtccaaaaggaactgatggcggaatgggagagagctggagctgcgcgcccctcggcgcacagataagtccagaaagccagggagtatgagtccccaggtcg

SEQ ID NO: 1995 - protein, 748 aa, Mus musculus
QQLRCGWPEGKMGVESEEEGGPAEEEDAPRAMEPSHAGAAGSSRAVCSQGPPTQISSSRVIVHVDLDCFYAQVEMISNPELKDRPLGVQQKYLVVTCNYEARKLGVRKLMNVRDAKEKCPQLVLVNGEDLSRYREMSYKVTELLEEFSPAVERLGFDENFVDLTEMVEKRLQQLPSEEVPSVTVFGHVYNNQSVNLHNIMHRRLVVGSQIAAEMREAMYNQLGLTGCAGVAPNKLLAKLVSGVFKPNQQTVLLPESCQHLIHSLNHIKEIPGIGYKTAKRLEVLGINSVHDLQTFPIKTLEKELGIAIAQRIQQLSFGEDKSPVTPSGPPQSFSEEDTFKKCSSEVEAKAKIEELLSSLLTRVCQDGRKPHTVRLVIRRYSDKHCNRESRQCPIPSHVIQKLGTGNHDSMPPLIDILMKLFRNMVNVKMPFHLTLMSVCFCNLKALSSAKKGPMDCYLTSLSTPAYTDKRAFKVKDTHTEDSHKEKEANWDCLPSRRIESTGTGESPLDATCFPKEKDTSDLPLQALPEGVDQEVFKQLPADIQEEILYGKSRENLKGKGSLSCPLHASRGVLSFFSTKQMQASRLSPRDTALPSKRVSAASPCEPGTSGLSPGSTSHPSCGKDCSYYIDSQLKDEQTSQGPTESQGCQFSSTNPAVSGFHSFPNLQTEQLFSTHRTVDSHKQTATASHQGLESHQGLESRELDSAEEKLPFPPDIDPQVFYELPEEVQKELMAEWERAGAARPSAHR

SEQ ID NO: 1996 - DNA, 45158 bp, Homo sapiens
gtacagtggtgcaatgtctgctccctgtaacctccacctcccgggttcaagcaattcttctgcctcagcctcctaagcagctgggactacatgtgcacaccactgtgcctggctaatttattgtgtttttagtacagatgggttttcaccatgttggccaggctggtctcgaactcctggcctcaagtgatctacctgcctcagcctcccaaagtgctgggatcacaggcatgagccactgcggccggccctatttctctccttctccttttttttttttttttggcagagtttcgcccttgttgcccaggctggagtgcaatggcacgatctcagctcactgcaacctctgcctcccgggttcaagcgattttcctgcctcagcctcccgaatagctgggattacaggcatgcaccaccaccccggctaattttgtatttttagtagagacggggtttctccatgttggtcaggctggtcttaaactcccgacctcaggtgatccacccacctcggcctcccaaagtgttgggattacaggcgtgagccactgcgcccagcatattcctctccttctacactctattcttcagcaaccagtcactatgtctagcccaccagcaaaaagggggagattaggaaagggggagattagccttcctacaggagggcttatctacatatagtgtttggaatttggtaaggaaaatttgtttataacagtcttttaaatctgacatcattcaggtgtcaatttttccactgatgttgaaataatatttgttggccaggcggggtggctcacacctgtaatcccagcactttgggaggccgaggcaggcggatcacaaggtcaggagttcgagacctgcctggccagcatggtgaaacccggtctctactaaaaaaatacaaaaaactatccaggcatggtgttatgtgcctgtaatcccagctactggggaggctgaggcaggagaattgcttgaacccaggacgtggaggttgcagtgagcagagattacaccactgcactccagcgtgggcgacagaatgagactccatctgaaaaaaaaaaaaaaaagaaataaataatatttatttaccgcaagtatatttttggtggattctattaaagtacaaggcatacacgttttccaccctaatatgttctaataggagagagagacattaaaaacaagtaagatgtaaataagataattacatattgggataagtgttataaacgaaactcagtaagatatgagagaatgtggtaactctgggggaggccttctgagtcagtgcagtttggaaaggtcagtctgaggtgttgacatttgaacagagaactcaaaaaagagaacaaaccagttctgtgaaaaacgttccaaacttcagaatgatttggaggcagaaaattgtcctgtgatggttaattcatgtatcaacttgactaggtcatggtggacccagatatttggttaaacattattctgggagtatctttgaagtgtttgtagatgagcttaaaatttgaatcagcagacggagtagaacagttttccctccccacggtggatgggcgtcgtccaatccattgaaaacctgaatagaacaaaaaggttgagttagggagaatttgcaccctctatctgactgtctttgagctgggacatcagtcttcacctgatgttttaggcttgggctggaacttacatcatcagctttcctggttctcaggccttctggttcagactagaactataccactggctctcctgggcctctgggtatccaacccacaactaatatgtgtcgccagaatagaaaaggggctagaggctgggcgtggtggctgacgcctgtaatcctagcactttgggaggctgaggcaggcagatcacctgatgtcaggagttcgagaccagcctggccaacatggtgaaacaccatctgtactaaaaatacaaaaattagccaagcatagtggtgcacgcctgtaatcccagctctttgggaggctgaggtaggagaatcacatgaacccaggtggcatgggtttcagtgaaccaagatcgtgccactgcactctagctgggctacagagcaagactccatctcaaaaaaaaaaaaaaagaaaaaaaggaaaaaaaaaggggctagagtagcccaagtgtaggaaaagatggtcacttgctatgagaagtagagaagagatggagcctgctccatcagggccttgaggaccatggcgagtaaagggtttgatttttactttaggtattgtaggaagcctttgaaggatttttggcaggaaaaggaaattagatattacatttttaaaatattattctggctgtcctaaggctcacagattgtaaaaagcagatactaggagcccagtacagcaggccaaaccagagataactgtatgtatgtgggctggggcgcgggggtgggggtagtgtcagtacagacacagagaagtagagggatttgagagaacatttggaggtagacccgacaggcctcatgtgtcataatgtgcttgtaaataaagtctgcaagtttcagtcattgagagaaagggaactacttgatgtaatacagaaagtgcaagcagattaacatagatcaggcacactgtgttaaatttatagacatctaactttaatgtaattttttaagtacctcattttttgtttgtttttggaaaacaatgtccctctgttgcctagtttggagtgcagtggcgtgatcatagctcactgtagtctggacctcctaggctcaagcaatcctcccacctcagactcctcaggagctgggactacaggcacacaccatcatgcttggctaatttttaaagttttgtagagatgggattttgttatgttgcccaggctggccttgaactcctgcactcaagcaatcctcctttcttggcctccccaaatggtaggattacaggtgtgagccactgcatccagccagtacctcatttttttaattgaaaaagtaatccatgattatgatggagaatttggaaaatataacattattctagaattttaggagattggatgtgtcttagggaagggtgggatcaaacccatgaagaagggcacaaaggtatatgaacaagaatgttcactgcagcattactggtaacagcaaaaaatcagaaataagtgtccatgattatggaattggtgaaacaatgtagccattaaaaagaatgcagtacatttttgtgcactgaaaggaaatggtgttcaagatatactaggtaaaaaagtctaatgcaaatagtatacatagtgtgatcccactcatgtgaattagaatatttttcattgtgtcttccttatactaagaatattataaataaaagcctaaatgtatcaaattttgttagcaatggtcacctcaaggtggagtggggattaggaaggattttaactttatgctttatacctttttgttttagtaagatttcttaaacaatggatatgaagaaaaaaaatttttaagtagacacagaagcagtaattttaggatcaataagtacttcaatgaagtctttgaagcaacagtaagaaaaagtcctataaatataagcattacttttctttatagagagtttatattaatctcaaaccagaaaaatggagattattaagttgaatttgttagcatttccaagatgaagttgagactgtctttattcatgttcttcgaattaacattaaaaacaaatacatggatagaacgttttctgtgtcatttatttaggcaatgcatcttacagtggttttcgtggtttggtaaataaatacacaaatttattcatggaaaatacagaaaattagtggggcatggtggtgcacacctgtaatcccagctacttgggaggctgaggcaggagaattgcttaaacctgggaggtggaggttgcagtgagccaagatcgtgccactgcactccagcctgcgtgacagagtgagactctgtctcgggaaaaaaaaaaaaaaaaacccgcaactttctttttgtcatgctttgtgaaaaaatgattaaagcatggttttctgagcatcaagattatggattattacagattatttccatcattttcttaagtcctatgtttttcaaattctctataataataatgtattacttttgcaatcagaaaaagaggtactttacaaaatgtttcattaaagttaaatgtctataaacttaaaacagtatacctgatctctactgatctgcttgtaccttctacgtgacaccacgtagtttctttctgtcaatggctgaaccttgcagactttatttacaaactaggaccaaatgacttgtattgtgatcatattggtctgcacctctctccatccaaaatgatgaggctaggtccattaagcacacaccctggcaaacaacatttaaaatatcattactgaaatgactatgcaggcttttcatcagacttttacagcaccacaaagaaaagtcagagcaagaagatgactgttagaaaaactccagtctcttacaccttcttttagccccaatcacatggtgtgcagcagatacttttaggttacacagagtaaacctgaaactgcaatctgcagctatggtgtgcaatgtgatggtggaaaaaaaaaaaaggtttctttggacacttgaaatgttcatgcaaaaggtttgagacccatggatgaaaggtaagtaaataccgcaggacatgtacattgtactacagccagcatagcataattatagtttgcttttaaccttttgaagcctgtgttttctggttttagtctcttcgcttttcaaattattcctgactcattagcttttcaccctaggggcaattcataagctccataaaagtgtggatattttttctttttctttttcttttcttttcttttcttttttttttttttgagacctagtctctgtcgctcaggctggagtacagtggcaggatctctgctcactgccaacttccacctcccgggttcaagtgattctgctgcctcagcctcctgagtagctggtattatgggccatgcccagctaatttttggatttatagtagagatggggtttcactgtgttggcaaggctggtcctgaactcctgacctcaagtgatcagcccaccttggcctcccaaagtgctgggattgtaggtgtgagccaccacgccaagccgtggatatttttcttaaatttcttttccagcaaatgcataccatttgttttttagtatcagaatgtaaattcccacagtgagaagcaactaaataatacttattttcatcttttatacccttttttcttttcttttcttttcttttgtgtgtgtgtgtgtttctttttttttttgagacagagtctcactctgttgcccaggctggagtgcagtggtacaatcacagctcactgcagcctcaacctcccaggctcaagcattcctcccacctcagcctccctagtagttgggattacagccatgtcccaccaggcctggttaatttttttttttattacttttttttagagacgaagtctcactatgctggtctgaaactcctgggctcaagccattctcctgccttggcctcacaaagtgttgggattacaggcatgagccaccaaacctggtcctatctataattaaaagcacgtaactgaagaccaattcttcattacaactggagaccctaatctgaagaggctagttgggagcaaggtggtgtagacactactggtatcccaaccacggaccaattgacactttgggatgaataattctttgtcataaaggtttgtctttgcactgcaggatgttcagcaatatccctggcccctacccattagatgccagtagcacagagctccaacacagagatgtgaccacctaaaatatctccagacactgccaaatattcactagggaacaaaatcagcttgcttgagaacgattgcgttaggccaaagacctcacaaaatcaaatcctctgtgcctttgccaattcaaattgctcctttaactccatggtcaactctacccacttagccacccaccaacataaaatacagacacaaacaccctcacattcttcatatgaaataccttgaacattgtctagtgttcttcctctgagccatatgtggccaatttggctaagaggagagaagtaaccactgatgcctatttcctaccctccactgacatgggagttcatgcttatccttttaaatgtatttaagttcataatgtgctgactttctttctttgtttctttttggagatggagtctcgctctgttgcccaggctggagtgcagtggcataatcatacatgactgaagcttcaaactcctggcttcaagcaatcctcctgcctcagcctcctgagtagctgggattacagatgtgagccaccgtgttggcatgtcttgacttctgaagctctaaaatgcctccagcttctttatccactagccacgctctgtaaatccatgctcctccataaattttgtttgaccataatattatttaattaactatgtctattctgccttgaaattgttttcttcatttggcacttaaatatacagttatgacccaagctcaagacagctatttcctgaagttattctagattagatcctattaattaaaactgggagtagggatttttagaatcaaaccccaaaatccttttttcctaaaacattccaaaacaatgagacacgttagcttatataaattttattttcgtgcctcttaatacctttgagggatgtttattctccccactaccagccgtctggtgtttgaagcagtgaggaaaatggtcagagctaattgatttcctatatggagaaaacattattaatgaattcttcactgtggaaaattctgaaaagtggatctgccattactagattcatagccttgagcaagcatgttaatctctcctaggctatttcatctttggtaaaatgaggatgctgacatctaccctctagggctattatattgaatgaaatgacctgtttcaagcttttagccctgtgcttgatatacaggtgttttatgagtgtcctttttagtgctgcttctcttctttgtttccagcacttgctaaatactttctggggtccagggcaaaatgaaaatatggggcttccttgttaaaaaattaagaatttcaagacaagagcagaatatgaaatcaagtgttgagccctatgtgactgcctacgtcacatactcatcaagccagccctgcttgctcccctaggatttccaagggtctacttttctatcctttcacgaaattaaaagccactcttcaaattaaacaacggatggggaaataaatgcaactaactaaagagggcttgattacgtgcattgttttttaacactgtctcacttaagcaacatgttgaatgttagtgagcctagggctcttctagagagaccgttttcatctgccatagtattttagtgtttatatcattttctatctggaagaatgaaaagaaaaacaaactttggttgtctattagtaatcagaccactgaatgttgtccaagaagcacttagtggacaaagagacactcaattcaaaagctctctatgtaggctgggtcgcggtggctcatgcctgtagtcctaacactttgggaggccaaggcgggcggatcacttgaggtcaggagttcgaaaccagcctggccaacatggtgaaaccctgtctctactgaaaatacaaaaattagctgggtatggtggcacacacctgtaatcacagctactcaggtggctgaggcaggagaattgtttgaacccaggaggcagaggttgcagtgagcccagatcgcaccactgcactccaacctgggagacagactgagactctgtctcaaaataaataaataaataactaaataaaatgaaaaaccaccaaacaactatctagacttatcaaacagctttcacaaagatagcagcctagctctctgaacaggtaatttataacctagatagcagactttgaaagaactggtccagacatctaagaattaaatatgcaaagaggaagattttgtttccaaaccactgagacccagctctgcttgttattcccttttcttcatggatgcatcaacatatcctttaaagcaggggtccccagtccccaggccatggaccagaaccagtccctggcctgttaagaaccatgccgcatagcaggaggtgagtagcgggcccgggagtgcagcttcatctgtattcacagccactctccactactggcatgactgcctgagcactgcttcttgtcagatcagcagcggcattagattctcacaggagcctgaacgctactgtgaactcgcatgcgagggatctaggttgcatgcttcttatgagaatctaatgcctgatgatctatcactatctcccatcaccccagatgggacagtctagttgcaggaaaacacgctcagggctcccactgattctacctcattatctattaaaatgtaataataatagaaataaagtgcacaacaaatgtaacgcacttggatcatcccaaaaccatccccctcccttctgtctgtggaaaaattgtcttccatgaaaccagcccctggtgccaaaaaggttgggaatggctgctttaaagggtttctcaaggttctaatattttatttgataagaagtagaatcatataaaaaaccaaacatatgtgttaatttgggtatttatacagatatagtgtatatacatacatacaggcatggaggaatttccaaatttcctctattgtaaaacatacacatacacacaccaacacacacatgcacacatggtatcctaatagaaggcaaggagaatagacatttactgagcacttcctatgtgccacatgttttatatacattaggatattacagtatatggtagcttttatccattcattcaatctcaatacttttttttttttttaagagtagagcaactgaggctcacagcagttatgtaacctgcccaaagtcacacagcatgatggagggtctggattggagattttgtctgactacaacactcatgtatcaaatcctattcagttttgatgttaaaaattctgtggttgaattcgtcacagtgtctttaaataaaacaacaacaaacaaaacacagcaaaccttaacatagttgctaatcatatgagtttacaaggccacctgtgtctttactatcagttacactccttcccaccccatcacattaatcactcaggtctagggatttgcaagtttgctaacagccgaatggaacaaagacaaaacgctaaaatttgtgatgtgggcctaactccaaagccttcaagaaaaaaaaaaaaaggccaggcgcagtggctcatgcctgtgatctcaacactttgggaggcctaggagggtggatcacctgaggacaggagttcgaaaccagcctgaccaacatggtgaaacctcgtctctactaaatacaaaaaaattagctgggcgtgatggcgcatgcctgttaatcccagctacttgggaggctgaggcaggagaatcgcttgaatccgggaggcagaggttgcagtgagccggtattgcgtcactgttgcccactccagcctgagcaacaagaacgaaactccgtctcaaaaaaaaaaaaaatagccatttgtgctttcaatctctccgcttccggcctccacccggcgggaaaaaactcccgcacgtgggcctccacgattccttggcatgcgtgtcactctgggcaacaggctggtcggccacgactgcgcaggcgagaggcacagagcgactggagactgtagtcccccggtttccctggagaccaggcggaagcggccggaagtagcgctgcggttggcagcggcgggatggagaagctgggggtggagccggaggaggaaggcggcggcgacgacgaggaagacgccgaggcctgggccatggaactggcggacgtgggggcggcagccagctcgcagggtgcgccgcagccagaggagccagcggcctccttgggtgtaaatgagaagggtggggcaggcggacgctcggggcggcggccactggggcgcgaccgtccccgccccactcggctcctctaagagagggctgcctccctctgccttgtgttacgcggcgggtacctctagaggaatggcttcacccagcaggagtagggtggggcgcgtccacactacaaatacgtgtcgagggtttatctgcgccgtcctttcctctgtgaggggcgaggtggggcgggaatccctcagccagcccgacgaaaactgcagaggcttctgggccttttaactttggagaagttgaggaccttgtcgctcatttggcagaaggtgggacccggatctcagtcctggcaggaagggatggctcagaacctaggcggagtcaggtccgctgtggtcacgtctccggtgacccacttccagctctggtctttaccttgtaccgcccacctcagggcctggatgtaaaggcaccggttctcatttcctgctggttttgtttcattcattaatttagagacgaggtctccctgcagcctcgaacccctgggctcaagtgatcctccgccccagcctctccgtcccgagtagctgggacagcaggcacgtgccaccacacctggctgattttcagatttttttagatcaggtgtagctgtgttgtccaggctggtctcaaactccagccacaagcgatccttccacctcagcttcgaaaagtattgggattacagtagttagccatcgtgcctggccttttaaattttggaactttaggtttacctgaaagttgcagagctagatccccctagtgttaacataaactcagtacatttgtcaaaactaggaaattaacattggtataatactattaattgaactacacgctttattaatattctaccagtttttctgctaacgttcattttctgttccaggatcccaaccagaatattgtattgtattttgcctgtcttgtttttagccagtgttgagagaaggagtcgcctctgtcattccctccccgacaaataatgacctaacaactttttaaaatcaaagaactattcagtctttcaatttagtgaatatttattggtggtctgttatgtcctagacactgttttaggcactggcgatttagcattaaaccagataatcctgctgccatgggagctaaaaatagcccacacttgtacccactggttgtcttttgccattttgtatttcagtttttgttggtttgtttgttttaaatgtaagggcatgctgcttagaataattttcaagctgtgtgaaaatcaacgtcatttcaacttttctgccccttctggtttacactaagagctactataaacttccaggtgatagtattagctctttcatcatccattatttatcacattttttcccttcaaacttattactatcctgagaaaaacgcagtgcacaaacagtaattaagaggactgaagaccctaccctaagtggagtttcatgtctttgtaatttttcgatgctttcacacataatccaggagaaaacacgtcactctgcattcttccttcacaggtaccatgttttaaggaactgtcagttgctcagagataataagcagcctgaatttctttttatttctttgcatattgtgcaggagttcatgatcaagtgttgcccacaccaaatgcttcatccagagtcatagtacatgtggatctggattgcttttatgcacaagtagaaatgatctcaaatccagagctaaaagacaaacctttaggtaactgtagatttataatatttttaattgcataatgattagattagcaactcatcatgctcattatatactgatttattaaccttattaagaaagattttggaagcagttcttacagtgctttatagctggtcatttttgcttcactaccaagtgtaaattttacaagcctcatttaataagtggtgaatctgagaatagtgtagtcggcagaacaaatgaagagaaagcagaataaatgttacttttctgtgctggttagtagcttagtttgctggtcagatttctttttctcactatttgaaattttacaggctttgttctcaaaaacagcctcttattacattttagtggaagtgttcgtctgtcctcccctttctgaaattatctcttaaattgtgtaacatctaactaactagttggattttgaacataaacctaagtattattaagacagcaaacttgccgtaaaaacataagcatctttttaaataaaagccaaaataaattttatattggatatttgttgatatgctagcttgttttatcatttttattattcatattttaaattgagaaagataaagagattttctttcatgcatgcaggaaagattcctcttttagtgtaagcataaagaacatttttggttcacttgctgctaccctcttgtgcccactttggcttaataaatcccaatccagcctagctgatttactgaagaacaaagggatgactagtttttgctatgccaaggtgagtctaggatcttaaaacttttctaagggtgccaaggagttagaatcaggggacctaagttttttctcctgaaggcatttctgagtagtagcactgtgttataagatgttctgtagataatgcttaataaaaaaactgtaattaagtacgaatgaatgattattgggaagtgagggatatgaatgctccatgtttttgggggaaaacgaaagtagtctttcattttgtttttgttgttgttgttgagaaggggtctcactctgtagcccaagctgcagtgcagtggtgcgatcttggctcactgcaagctttgcctctggggctcaggtgattctcctgcctcagccttccatgtagctgggactagaggtgtgcgccaccatactcggttaatttttttgtatttttagtagagacggtttcaccatgttgccctgggtggtctcgtatgcttgaattcaggcgatccacctgccttggcctcccaaagtgcggggactacagacgtgagccaccgtgcccgaccagtagtgacatgcagtgatgaggccatataatgtaatgctctattaaaggactcctttttttagttaagaaatctagcaatctgattttttatgtagttcactgaggaatctcaaattattattacctttggttccatgattatatttttgggcattacctgatatatgaaaaaactttatataaaaataatgttgtttatgatatcaaaattttagaaacaatgtctaatagagaagtggacataaccttttttttctacatgtttgtattttacatattttaggtgaacattactcttacagtggtaagcaagtagtcaacttgtataaaaaaagagcaaataatttttagcaatcttgagtcaccaataaactagaattttttatgcagtctgtaaataaatgatcataatttaatcatttttgatagaacagttcaataagtagtacataactgttagatccctaaaaattgctgtagcccagcacttgttttatatattttatatacatattatattttatattgctttatattagcaagttacggagaagagaagttgagtttttctagcagcaaccagtatttagttgtactcaattattttcatccgttttttttttttttggtagaacatgccctattatatggcagtataaattaatctgcttttatattgtctggaaaaaaatcctagagagatttgatttgtatcttatcactgaagattccatagaatatattgatttaggttcatttttaaattttagaaatgtaatacatagattgccttttgtatatgaataattgatctatcgtctaacttttaattctgtgttattcagtgttttgttatttaataataactttccttcttcaaggagacaaaacaactagagattaaaagtggggtatggaaaaataatacattggtatattataattcataattaggagatagcttgaaaacctaatgtttctgcattatagagatttgatatatggaggctatgttttttaattgagacagggcttttgattcttatcaaaactgattgtcttacaatttagacaaatgtaatacggaattaataatatctttaaatgttttcttcaattgtgcttgggtttctcataaaatattttttacaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacaggtacaaatgataagcaatgtacttttagcattaatttttatgtaggatgcctgttcattacatgaattttttaataaatgtaaaataacataagtcaagatgctttttcctaataacttcttattttgggtcttgtcaactttaaaaattatgtgaaaggataactgtatgctatgaatagtatttttaagaagatgtatagttggaagtaattttaactcttattattgatgtttatataacagggaaaagtggaaaacaaagtttaaaagtgagaaaatgggaaactgtactgtaaaagatgccaggtctttaaaattttaagtttaaatgaattacgaagaaatatgttgttttctaatgcactaatgataattgaaagaggcttctgtaacatttgatcaacataattaaaaactgatttcttatgaaatattaataaaaatattggatatattaatattttcttaggttttatatatatactaaatattacaatgtagctaaactttcctatgctaaggtttgggtttaaatcttagtgttatagtaaattacaggaaaaatgaaaatgagtgtgcactggcacattgcaaatatagtaggttgatgcaaaagtaattgtggctttcacaattacttttaattgcgaaaaccgcaattacttaatatatagtgtaaaaatgtataatgatcagctttgcaattatttgtcttttttactttttttgtttttcttttatgatagcaattttcagatgactggattaaatgtctataatatacaaagacctcttagaaattaacaggaaaaataaacctaataacaaaggacaaaggatatgaataggcagttgacaagaagagcctaacccagtgtctaacaattatagggaaaaaatgctcaaattcattagtggccaaggaaatttgaattagtaagatattttatatctgtcatacttgcccaaaattaaaagcaatgtgagaaaaaagtatcaagaacacttactgagtttaaagatgaatgttcttcaatccagtgatatcattgctgggagtttatcaaatagaaataaaatcataaggctgggtattgtggctcatacctgtaatcccagcacttttggagctgaggtaggaggattgcttgagcctagaagctcgaggctgtgagccgtgattgtgtcattgcattgcagcctgagtgcgcatgacagagtgagactcttgtctctaaaaaagaaagagaaccacaagtacataaagacatatgtacaacaatgtttatcatagcatggtttatgattgtcaaaagtatggaaggaaaaatgcccatcaagagaaatagccaaataaactaaaacatctgtataatggatattatatagccattaaaaagaattcattggtgcaatactatttgactgatggagatagggcttgttgagtgaataaaaggcaaggtacaaagtcatgtatcatgtttttccaaatgtgtaaaattatggcctaaatgcctcctctcatattcatcatatagatgaagaagagtaaatcattgttttgatttgcagttttccatgagtaaggttgagtattttttcatatatttttggtcatttatgtatttttttctgttaacgtattcacttgcacctgtttttaatttgggttgttcatctttttctaagtactaagtacctagtactttttgtgttaggtattttttgaaaaaagttactttatcaatttttctcacagtatttttctgagttgaagtaggcgcgtagccagttagtcctttactgtatttatctctgatctgtttataaccttattatttatttcatattttgatgctactgcatatatacctttcttcaaggtattttttttttctgtaattacagactcctcttttgggccctatataattatatgtttaataaatgtatcttgcttatgaagttgataccaagaaagaggttaacttcaggaatggaggctgggcatggtggcttatgcctgtaatcccaacactttgggaggctgtggtggggtatcatttgaggtcagtctgggcaatataacatagcaagaccctgtctctacaaaagttaaaaaaaaaaaaagttagctggtagcatgtgcctgcagtcccagaggccgaggtaggaggattgcttgggcccaggaggtcaaggctgtactgagctgtggtgtgctactccactccagcctgggcaacagtgagaccctgtctcattaaaactacagcaacaacaaaaaccttcagggacgggataattagggatttgtcctgtgacctaaaatcagtcaatatttagtgatccaccagcttcgtgcatgattctgtatttaacttgcttttctatttagtgcttaaagccttatcctttatttttcttatgtagtattcttttgataaactcttgttttctacatgttactttgcatatcaggtatatacttttgaaaataaattgccgaaattgatgaaggaaatgcaaaacaatcattttctttgattagacatattgtcagtctgtcctgaaaggaggtaatagttttctctaggtaatagttttctcaggagtgatttttggtgtttgccatgtcacattgttacctttattggtttcccctcacattgtcaatgttgacatcaacaaaacaaaaaagcacctttggtgtttgtgaaaaaacatgatctatgtggaatgagatagtccttttatttctgagcttcagattatatgaccttaagaatctatgcatttttgtatactaagagacttgcatttgttttctcttatccagctggtgtcagtagaaagtgattcagagggaagtgaaaaactttctcaatgattttaaagttattagtctcaatgttaatatatgaaaattgatagtttttttgaatttattttgaattttggttcagcttaatctagtaaacatttgacttgaggactagatattgtgctagacgctgggcatttgaatacctgtaagttgtggttcatctctgcctctctgtcctaaggaatattcttgggaatggctaataaaaataccacgttatagtatattttgaaagttgactgactttctgttttattcagtaataattggacattttaaatattattttgttttgcctcttttaaactcttggagaaaatatagctaaaatatactattacttgtttttaactttcctgagcagcctatagtttattctttgacacatttcttcaaggtcaccaatttactataagcattgatatttaatgtactacagatataaaaattataggtgtagaagattgagctagatatattgccatgaataactgccctaggaatgtcatttttagacttttttgaaaatattgcctttatacaagatgtggtacagaaaaaacgtcaattaactgagggctttattaaagatattatagaactatgaatgtatataaaacctttaacaataaatttgataaatttttaagcactagatagttaaatttatcctagttataacttcatttacatttgtgctccaatattatttcaatttagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtgtgagtgggttcttattcattctacctactaactaaaagtacatacatttcttaatgttcagtgagttcgctgtgtgattctgaaagattcatgacttttgttggaggtatagttatatttagtcagtaatctgtctaggacagctaaaattaggtgctgctattccataataagtgttaagattttgatgacatgtagctcaatgctctgtgcacttttcatttgcacagagcattgttcctgttcatctgcacagagcattcatctgtgcagagttttcgtctgacacagtgcattggttcccattttagaaagccatacccagctgggcacagtggagcgcccctgtagtcccagctgtttgggagactgagctgagaagattgcttgaacccaggagtttgagtccagcctaggcaacagagcaagatcccatctcttaaggaaacaaaaagccatacctctgtaggtcattcttaagttgtaagagttggcttcttaatatgctttttggaataattttttattattctaaaacaatctctaagcagagttttcaggtaggctagatttgcctttgatgtgtcttttacatgttcccttcgattcccctttgatgtgtgttttacatgttcacttcgattcccctgagaccctcatgttgctctctgaattcccaagttagcacttttggaatgttgtccagggctatctgccatgtgctagaatcttctccaagctcctatttaatctgttcaaataatctttgtcaaagttagcaagaaagcagaatggtttgtctccttcatatattgagatatgaatgactgatggtgtttccagtgatatttacatttgaaaataagctgcagtaagcaccagtgaatatctgattaggctttcggacatcttatgactctgctggtgactcccctatcataccacatacaagacaaggtactctgctgttgtgtaagacttgtctgacccttttgctcttaagcctccccatgcatttcctcttatcctcttttttgagaactagacatcggtctacagaatagttctccacagaagaaaagcagtagaaccacagtttctagaatacatggagcttttcctgtatcttttgtacttgtgctcatttgtaacttaaaagggctaactagcaagaatatttcaaatatatttctatataatttttaaggcaaacttggattttattggttagagtacattatagagagctaggttttatatcccaaaaaggaaatgtggaattattgattaattcttcctctttcatacagattttattaaaattttttgtaaacctacagaaaagttgacagaatagtacaaaaaatacccattatgtcttttcttttttttttttttttttttgagacagagtctcactctgtcgcccaggccggagtgcagtgatgtgatctcggctcactgcaacctccacctcctgggttcaagcaattctcctgcttcagcctcccgactagctgggactacaggcatgtgccactacacccggctaatttttttatttttagtagagacggggtttcaccatgttggccaggctggtcttgaactcctaatctcagatgatccgcttgccttggcctcccaaagtgctgggattataggcatgagccactactcctggcccattatgtcctttcttgtagataaaccagttgttatcgttttgccacatttgctttctcttgttctctctatggattgcttggttggttgatgagctatttggaagtaaattgcagacatcctgacatttcatctctaaatacttttagcgttagtctctttgaggttaggatggtttcatgtcattccaacactgttttacacctaaagcaaatttatttttatataattttcttacacttttcataaaagagctctaaaactgtgtacaggtcagagattgtttctagcagcatatactgctagtgcgtggttaagatttagatctttaaagtataatgttagctttcttgttatataataatacttctatgcctacttacgggtaaatatgagtaaaagttttgccaatgtcagtaggaatttttttatgagatcagttttcacaatgtgttaattattaagcactcccactacacagtcactatcacaggcccttggaatttgcttattgaatttgtttacagtattcctatgaagcatgaaagagattagtcaagtggataacagggtggcagtgatctcttagtccatttagtgttgctttaacagaatacctgagactgggtaatttataaagaaaaaaaggtttatttggttcatgattcttgtggctggaaaagtcaaggttaggcctctggtgagggcctcaggctgtttccactcatggtggaaggcaaaagggagccagtgtgtgcagagatcacatggtgagagaggaagcaagggctgggggaggtgccaggctcttttaacaaccagctgtctttggaactaatacagtcagaaacttacccctgagggagggctttaatctattcatgagggatccacccctgtgatcccaacacctcccatttgaccccacctccaacactggggatcaaattacaacatgaggtttggaggggacaaatatcacaaccataccaggtgatgatggtggtggttgtggtggtggtggttgttggatatagactaagccctctaccttttaaaaattattttgtgaaaaagaaaaaggtttttcttgtgactttgaatgacatttgttgtttttaaagctataaacctgcttgacgtcttgcacatcagactacttgttggatctcagattgcagcagagatgcgggaagccatgtataatcagttggggctcactggctgtgctggagtggcttctaataaactgttggcaaaattagtttctggtgtctttaaaccaaatcaacaaacagtcttattacctgaaagttgtcaacatcttattcatagtttgaatcacataaaggaaatacctggtaagacaaatatatttgaaaagtacatatacgtcttattttatttcttttaatttaaaaaattatagatacaatgtaattaattcttaggtagagttgtctgtgagtttgtgtgcatgtgtgtgtgtgtgtatacttggttcctggaaaaaactaagaaaaactgtaatgttttctcaagcaaatttggattaagaaatatgtgaaggtacttttcttattttatctacttttgtatggttagaatatggtcatgaaagttatagcctagaaacatatggtcctttatttccagtccctgggtcatactcttatactgtacattgcctctagagaggggagttcgtcttttactaactcttttgggattacatataaaatattaaggctacaatggactttccaaaacatctaggccaaggtcctcattttaaagattaggaaactgatttccatgaggagttcggtgacctatttaggtcatggggcaagtttgtatctttgaagattaaatacccaagtttttataggccatcaatatgttgaactacatttctgtggtattgctagggaataagatgttataaaagagttctgtggaagtgaatttctaataccactgaaacttagatgtcatacttcacatttttaactgatacttgcgtgattccaaaatgtattatacactgccttgccttccttagtatagtataactataatttgaagttttttggatgactttggtagtgcattctgaagaacaatgtcaggttgtaataaactgaggactatatactggtgcaaaacattcttacttggctttactttcgagttcttgtatcttttttttttttttttaacaggctttctcctttctcacttattgccaaattgccaaccttcttttttttctgctgtgaaaaatctgtcactctactttaatagttccccctacatagccatctcctccaacttactgcttttactgtgcaagaaaaccagataactgtggaattactgtttttgaatgaaaagaataaggagacattaaatagcctgttttctcttgtgaataaagtatgaccgaattttagtgcaagaactttgtgacagttttgctagcaagattttttgtttgtttgctttctggctcatagttgtattctggatggtaaatgttagatatgacttatggataaatgtgtggtggtgcgtataggaatcagttaggttacctaatatgtacacttaatttattttaattgctctagtggcagcctttttgtatattaataataatcatgatttctgaatatttctggaatattacataacaggtggtaaaatttttgttttagtaagacagcatttattggctgtctctgtattcattttattttactgcattttgtgaggacttcaaagaggtgcatataattcaggagccctgagtggaagaacagcaacctagtttgcaatggggtttgatctttgcaaaatacagtagtcccccattatctgcagtttcacttttcacagtttctattacctgcagtcaactgtggtctgaaaataataagatattttgagagagagaggcagagaccacattcacataacttgtatattgtatattgttatagttctgttttattattattgttaatctcttactgtgcctaatttataaattaaactttatcataggtatatatgtaatgggaaaaacagtactgtatatatagggtttgatactgtccatggtttcaggcatccactgaaggtcttagaatgtatcccctgtggataaggggggactactgtataaattatagaacttaaagataagattgatatatttataatattttaattagctttgttttaaggagaaaagctattttaacattgtatgcatttctttttatttaggtattggctataaaactgccaaatgtcttgaagcactgggtatcaatagtgtgcgtgatctccaaaccttttcacccaaaattttagaaaaagaattaggaatttcagttgctcagcgtatccaaaagctcagttttggagaggataactcccctgtgatactctcaggaccacctcaggtacatgatgatacttattttaattaagtactggttatcacattatttgagataaagatttctagttttagtaccatgttcttactattctagtttgcttagtatgtgatccctttcctattagaaggctgatttattattaatagattggattaataagtattcttaaatggaatcttaagcattgatattttgatatcttaagttagctactatgattgaagacagtgcaacttaattttaatagcctataatgcatatatgaggcaaaatattttaatctgttaaaaatcttgttttcagagtagtccagtgatttagcaaatgggaaaggtataatcacccagttaacattgactgatttttttgctatgggacaagcactttactgagtgctttaaatatgttagtccatttaatcttcacaacaaagcatcaaggtaggtagtactgttgtttgtccattccttcttacttctcttctttccttccttccttccattctctctctctcaagatgaggataccgtactttagaaaggttaaataacttgtccaaggataaacttagattcaagtcctaggtgattaagaactcttgccataatcatacaataaagcttggagttggtactagagctttagagttttcataactttgaattattttatattaactgttttatattaactgttaatacagtaatattttatattaactttctagtgagtacaatagcttgcagataaaaaactgttaatataaaagtgaactaaatggctcaaactaaggacaagaggtaagttagtgaagaatgtattgaatatttatttgactgtacactgataataattagatatagttatttgagtttgtgctaatccttatttatgcttctttgatagtcctttagtgaagaagattcatttaaaaaatgttcatctgaagttgaagctaaaaataagattgaagaactacttgctagtcttttaaacaggtgattttcaatccattttgccaagtcatcctatgtattcattctatatacggtatgtggaaagaatatttgatgttccatcttggaactgacagattatctggagactaaacaatgtaaaaataatttatcatgggatttctctgctttataaactgttgtaaagatggtaatagggggtcttacctaaattgaattcattggtcttaattctgttaacactgtggttatgctatggatctaaagctgcagatagttacctaaaggggttttatggatatttctaacatttctagacttattctggtcttcaggtgagaagaagaagttttaatttttccctgtggcaattgcaaagcctctgccctcaacctaatagttagttgcatttcattaagttagtaccatgctaaatacaaatacatgcgaaatacaaaacccgtgaaattaaccatttatctgtgcctctgctaatagttacttgcatttcattaagaagaaaaaaatgcaaagaggaataatactgtcataattctaaaactcctgatacaggaacaactatataaatttgtgattgttgaggataggaaattattaaagtaacagtgatggaagaagcagaagaacccttgtatctcttttgcctcagactgtaaaataaaatggagtcgaaggaaagaatggctagctggcgctgtgtgtgagtagggtgagtgactgcaggtgtgtgcagggtttctgatctgtatgtaaagagtatcaactggggttataaatatatgagtagtacaagataaactgaaaaggaaatttaattttgtggtgctccttgtcattatacatgtatttctcaatattccatattccacagatgagtattatctgttttcgtcccatttctttgtttctcctcttcttgttagaaatttctcaaattgtggtttcagggctctaacagtttagagtaggtgtgcttctctaatgattctaggaggactaactgtatttagagaaaatggtttttggttggttctaagtctgagaaaactgaagaagtgaaatttcctccaactttgctgtcgtgtgcaatgtggcactcaaatgtcttgagcagagccatgcagctcattgttggctgcatgcagctggggctggctgtatgactggcctcccgtgatatgactcaggctgggcctgcgagtatgctagtgaaactgggtcatttgcttcagctaaatagaagactaccctgaaatgcctaacctttggagacagttcttcacatagaaaaaccacaagaagtataagttttacaggttctcttatttgaagagtcaacccagaagtgagaccaggtgctctaaacctgtgacatacaaaacctgtgaaattaaccatttgtctgtatctctgcttcccggctccttttctcccacaccacgggcccttatttcagtgactgaattataacaccatctaagtgacttgcaaaaaaaaaaattacaggagtgtgtgtgtgtgtgtgtgtgtgtgtgtgtgtatttgtgtataattagttttgttttctctagagtatgttatgattaatactataggtatgtaagaaatgtaaaaccgtattatttttaatccatcctctaggcactagtttaagattgcttacgatacagcctttttctaatgtgtcttaattagcatatcatactctttgaattgcataattaatataacacgtttaactggaagatatttaaactagtaaccatttaaggtattttatcctagttaagcagccatcgagaagttttgtcacaaagcagtaagagatagaaaaaattatttactacagaactatttaattttttatgtttttgcgatagggtcttgctctgtcacccaggctggatggcagtagtgcagttagggctcactgcagcctcagcctcctgggctcaagcaatcctcccacctcaaccgccagaatagctgggaaggcacctgccatcaagcctagctaatttttaaatttttgtagatgaggtcttgctatgttgcccaggctggtcttgaactcctgggctcaagtgatcctcccacctcaacttcccaaagtgttgggattacaggtacgaggcaccgtgcctggcccagaactatttttttcagatcagaatcttcaagttgagtgtgtttaacaatgtgcaatacttgcattttatgtttgagatttggttttatatgcattgccatgtgtataaaaagggaaatgttatcctttaatgacattttttccagtactacttaagtgaatttgtcatatcactaaaacctttgtttcaacaccaaaaccaagacatttgcatgaaactcttctaaaaaatgcatgtactcatattgtatattaattatatactaaatatagtatatgctcttttaagatattgctctaataagctatcatataatggtaatagtgattactctttaacaaaagtaatgtcattttgtaaaaaaaaatcttttttttggtaatctcgtaagaaaaaagtttgaaaaaagttcttttgttatttttcacttatttgcttttgtcagtgaatgattcagtttcttaaatttcctgctgattttaatttgttgccttttggttaggtgtgttggcttacgtctgtaatcccagcattttgggaggctgaggtggggggatcacctgaggtcaggagttcgagaccagcctggccaacatggcaaaaccacctctctactaaaaatacaaaaattagccaggtgtggtcacacatgcctgtagtcccagctactcaggaggctgaggcaggagaattgcttgaacctgggaggtgaaggttgcagtgagctgagattgtgccaccacattccagcctgggcaacagagcgagactccatctcaaaaaaaaaaaattggttgcttttagttttgttttggatctgtattataaaacagtttgttatgattgtatcttatatctcttctatttctgacagcactcaattctgagtgaggcctgagagcttgacatctaaacattcagagttttagtgcatagactttgtgatgattatttggatactcagggacctttattgcttactattttgttatctgctatatgtataattgtcatatttaacaaaatctggcacctttagataaatgagatgttacataatttaaaaaggtaatacttttctaattccttatttccactttctctttatttttagagtatgccaagatggaaggaagcctcatacagtgagattaataatccgtcggtattcctctgagaagcactatggtcgtgagagtcgtcagtgccctattccttcacatgtaattcagaaattagggacaggtatggactagttttccaacagtttcattagcaggttgaactcttaaataagccaactttgaatgagaaatatgctccaaaaatggagggtcttcacagggaattagcaagcaattaaatgcttttattctatcaggaattttcactggaaaactttgttgtttgtttatttatttatttattttttgagacagggtcttgctctgcaccaaggctgaagtgcagtggtgctgtgatagctcactgcagcctttgtctcccaggctcaaacaattcttctgccccagccttcccgagtagctgggacagtaggtgcatgctaccagacctggctaacttttttgatatttaggatagacagggtctcaaactcctgagctcaagcaatccttctgcctcagcctccgaaagtgctgggattatgggcatgagctactgcacctggccttgtttttaaatagataattaagtaaagagtcatttaagaatgttttccaagttcaaagagaacaaaactgtgataactgtatagcatgagataacttctttatgggcatttagattgtttccattttgaagaacatttaaatgcaagtcattggatgggcatatgcatatgttttcatttatcttgggtagatttcaaagagtggaattgctggatcatatggtaacatgaactgtttaagaagctgccaacttttttccaaagtttgtgtattaatttacattttcatcaacaatatttgaaggttccagtttttcatattttcgccaatatttgtattatcagtctctttgattatagttgttctagcggtatatagtagtgtggtttttcttttatggatagtgtttttggtgttatatgtaaaaattctttgcctaactcaaaggtcacagatatttttttctgttttctgttagaagttttatagtttttaagctttatgtttaggtccattttgagttaatttttttatgtgtggtatacggtaagggtcttcattctttgctttgcatgtgggtatccagttgttcctgcatcatttgttgaagactattctccacccactgaattaccatgacatctttgtcaaaaattaattgaccataaatataagagtttatttcctgactttcttgtttcattggtctatatgtttatccttaacactgattccaccctgtggtggtctctgctgctctgtttatttttctgtagtctttttttttttccgttttttcttacaaagtggataatttgtattgagctgcctgtaagttctctgattcatctgtcatctcataaccgctgttgcccctgtagtgatttgttggttttggttactgtactttttaactctagaatttctgtttgtcttttgtttatatgtttggttttgtttctttatcaagattctcctttttttgtagtcattatattttactttaattctttaaacatggttgtctttaattctttggacatatctataataatgaatttgaagtctttgctaagtccacctcaaagtcaatttatgttaactgcttttcctcccaaatatgtatcacactttcctgtttctttgcatgttttgaactattttattgaaaactgaacctcatagataatgtattgtagcaactctggatttacaattttttcttgtagggttttttcttttttgtttcctgtacttctttttaggtaacttgtctgaacgtaatctgcagaatttacctcccctgtgctgtgtagccactgatttctctgctcaagtgtttttttttttttttccattcaaatttttattttaatactggcttctgggaagttgcccatgtctgtatagtttcatggttagccagtgattggcaaaggttttgctcaaacactagagtctggaagccgtctacctctgccagtggataagtgtatgggttggagagggcttaaaaaatttaggccattttcccatactgcccaaagtaatttataggttcaatgccatccccatcaagctaccactaactttcttcacagaattggaaaaaaatactttaaattgcatatggaaccaaaaatgagcccctatagccaagacaatcctaaataaaaagaacaaagctggaggcatcatgctacctgacttcaaactatactacaaggctacagtaaccaaaacagcatggtactggcagaaaaacagagatacagaacaatggaacagaacagagccctcagaaataacaccacacatctacaaccatctgatctttgacagacctgacagaaacaagcaatggggaaaggattccctatataataaatggtgctaggaaaactggctagccatatgtagaaagttgaaactggatcccttccttacaccttatacaaaagttaactcaagatggattaaagacttaaatgttagaactgaaatcataaaaaccctagaagaaaacctaggcaatagcatttagtacataagcatgggcaaagacctcatgactaaaacaccaaaagcaatggcaacaaaagccaaaattgacagatgggacctaattaaactaaagagcttctgcacagcaaaagaaactattagcagagtgaacaggcaacctacagaatgggagaaaatttttgcaatctacccatctgacaaagggctaatatccagaatctacaaagaagttaaacaaatttacaagaaaaaagcaaacaaccccatcaaaaagtgggcaaaggatatgaacagacacttttcaaaagaagacatttatgctgccaacagacatatgaaaaaatgctcatcattgctggtcattagagaaatacaaatcaaaaccacaatgagataccatctcacgccagttagaatggcgatcattaaaaagtcaggaaacaacagatgctggagaggatgtggagaaataggaacacttttacactgttggtgggagtgtaaattagttcaaccattgtggatgacagtgtggtattcctcaaggatctagaactagaaataccatttgacccagtgatcccattactgggtatatacccaaaagattataaatcatgctactataaagacacatgcacgcgtatgtttattgtggcactattcacaatagcaaagacttggaaccaacccaaatgtccatcagtaatagactggataaagaaaacgtgtcacatatacatcatggaatactatgcagccataaaaaaggatgagttcatgtcctttgcaaggacatggatgaagctggaaaccatcattctcagcaaactatcacaaggatagaaaaccacacaccacatgttctcactcataagtgggagttgaacaacgaggacacatggacacagggaggagaacatcacacaccggggcctatctggatggagggctgagggagggatagcattaggagaaatacctaatgtaaatgaagagttgataggtgtagcaaactaacacggtacatgtatacctatgtaacaaatctgcacattgtgcacatgaaccccagaacttaaagtataaaagaaaaaaaattaggccattttcaagtttttcttgaattttaatttctgctaggccctctttatctccccatgatgtgcatgtagccctttcagtaaggagtgtatggggagcttgggccctctgtggccttccatttatttgcatgtagcctcctagtcaactagggttgtacggggagcctatgtagtccctctttggttctctcatttccaaatctcctggtgacatatctggctggtccactgatctgtccttcacccgaaccacgactgaagcttcagactagcagagctgtgggatcttcccattcgtttcctatcaaatttgctcattttactggcaacactgctgagtgtgggcttttgcccactgcctcaaatcaggtctgtcccctctggaagtgaaactgctggcttttgcagccttcaccctgtaccaactgagctatgtaaagggacattcgaacagtcccagacagtgaagctgctatctcctactttcttagctaacatatagcagctgttcatagatcagtacttctcactttgtttgcctttggttcatttccagatttccaccaaaatgattgtttttgacaatgttgttcagttttatagtagctttttgagagaggattttctgaccatatcagtgtagtataaccagaaatcccatatttcaaatcttttgaaaatttttaaccatttagtattaatattgaaatgtcttaatttggtatataatgtcaagatgcccagtgatatttaggattttaatttcttaatctcagcaatataaaatatattatgctcttaatattaattataatgtttattcttaaacattttatttaggaaattatgatgtgatgaccccaatggttgatatacttatgaaactttttcgaaatatggtgaatgtgaagatgccatttcaccttacccttctaagtgtgtgcttctgcaaccttaaagcactaaatactgctaagaaagggcttattgattattatttaatgccatcattatcaactacttcacgctctggcaagcacagttttgtaagtacactcttttttgttcagttttctaagtatactcttatgggatttgtgtggttacattacaaatctaagtgcttgtctttttgatatagtttagagattcttttgggtgatattgtttaggtgattaacttgtttataatacctatcttatggtttctggccttaaatatgctgtgatctaagaagaaaacataagcatcactggataaaagagagaaccattatggaggttctctattttggaattgttaacacattttatagtatataaaaatatgatggattagctcataagtattaaaatatttgcagatattagaaatcacatctttttgtcttttagctgacacatgagctactagtacctttcccatgattcttttgttaaagtatttacattttcttcattttgaaatagtattgaattttgatagcaatattgatagatttgactactgatttcatagttgtaaagttaacagtgtggcaatagaaaggcagaggccagtcacattttcagacgactaaaacaaaacccttttattaatagacaaaccactatttagtaaatgtgggttgccttaaaaacaattattttttactaaattgttcatgcctataattaactcaatttaaaatacttttttgtttgtttagtcagtataattttagtaaccttttcattttcatttaagtttaaagtgagaacaggatagtgtatggaaatagtgaattaatgctctcttcaaattacttttttctgtgacccttcttattccatttattaaatttaaaaaagtgttttctttttacattttaattaatctgtgaaattggaattaaaagtgctcatttatagtggcattagaaaagtaaatataagtgaaagtaccttgtatgtatttgtcacacagtaggtagtcaataaatataagggcctgaatcttttctactacttttacttttttggagttcatattgtgttgatgtttacggagttatatttgactatgtttatatttttatggtgcttgaaactaaaggatttaaatgaaaaactgtatagaaaaattatgcaagttagagttgaaagtgtctttaaatttttattttatataaatataaactagtactatatcttgatgatgttgggttttgttataggctttttttttctttttgttaaaagttaccctttagaatagtaatttttggaaaactagcccttgatgctatatgtgtatgtttttttgaaaaatacccttaggtgaacttgcttttctaggccgccattcttttatttatagaattgaaagtttggttgcatgattgttacaatcttcccaggtctccaaatgcatatttacctctgtctcagtgctatctaggaaggaaacctcttcctggaatagtgggtagagattcacaaaatagtgtgaataattgtggtagtagatctctagttgtttggaactggccacaaagagttgtatttgttgagtaggttagaaacatgtcagataatagctacaggcacacagcagcagcagcgatatttaaaagatatcagatatgtaaattagtctgttattcttgtgttctagaaaatgaaagacactcatatggaagattttcccaaagacaaagaaacaaaccgggatttcctaccaagtggaagaattgaaagtacaagaactagggagtctccactagataccacaaatttttctaaagaaaaagacattaatgaattcccactctgttcacttcctgaaggtgttgaccaagaagtcttcaagcagcttccagtagatattcaagaagaaatcctttctggaaaatctagggaaaaatttcaagggaaaggaagtgtgagttgtccattacatgcctctagaggagtattatctttcttttctaaaaaacaaatgcaagatattcccataaatcctagagatcatttatccagtagcaaacaggtatcctctgtatctccttgtgaaccgggaacatcaggctttaatagcagtagttcttcttacatgtctagccaaaaggattattcatattatttagataatagattaaaagatgaacgaataagtcaaggacctaaagaacctcaaggattccactttacaaattcaaaccctgctgtgtctgcttttcattcatttccaaacttgcagagtgagcaacttttctccagaaaccacactacagatagccataagcaaacagtagcaacagactctcatgaaggacttacagaaaatagagagccagattctgttgatgagaaaattactttcccttctgacattgatcctcaagttttctatgaactaccagaagcagtacaaaaggaactgctggcagagtggaagagaacaggatcagatttccacattggacataaataagcatattcagcaaaaaggtctgaaaagcaagggaataccattattttcggattagcggtttattaagctcttctatattaaacactaatagatattcaataacggagtaaactgttccagataaagcaagaatagttgcaagaagtaaattctggcacaaagcgtaaaaatataacagaagaaataatgtaaaatactatcttttatgtctaaagccattttatattacttttcaataaaaagaatatcatggtcaacatagaatatttttcatgaattggtggggagatgtatatgtttatatataaaaaatagccaaatcgttgcaatgatatggtaaaggacacattttttttttttttttcctgtgaaatgtggaatatctcaaattcagcctcttaggctgaatagcaaatcctactgccaactaacctattaaaaatatagatagttttgactaaagtactacattacatttagtatgttgacttttaaaataccaaagcaatttatattcaattaatgcttcttcatacaccaagaatctaccacaatacacagcacacaaaggccgttcaataaacattgaatgaatgaatggtttggctagggccagggtggggagttaaagtgagaggagggtatatgttatagagaacagtggtagaaggaactctccgtgcaagtaaattaagggaaagatggacaccagaaaggcaaggtgatgggcctataagcatactggataatggaagaagtccatttctttctagctagtttgaagggcctaaaagcactgagatgtttttgtatcttccctacatttggagatgatattaggttgtcataacaaccacaaatatagaccattactaaattggtggatgtcctctttctcccattgttattgccttcctcttttgcctgctaaactaaaaattggatataagattgagaatgtattatataatttgcaagacatagaggatgtttatagaatatactaaagtatccctcagcaccaatatgggagtatcctggtctcaagtttataatttttgcacatataatctaaagaagagactttaaaaataaagtacacaaatatgaaccaaagagtagcttaaaaatactttcttctaggtctgaaattttcttttctttctttttttgttttggagacagagtctcactctgtcgcccagggtggagtacagtggcgcaatcccagctcactacaacctccgcctcccaggttcaagcaattctcctgcctcagcctcctgagtagctgggattacacgcatgccctaccacacccagcaaatttttgtatttttagtagagatgacatttcaccatattggccaggctggtctcgaactcctggtctcaggtgatcctccaccttggcctcccaaagtgctgggattacaggtgtgagccattgctcctggccccagctctgaaattttaacttagttttggattccttggaatttgaaaatatgctaacacgaaggattgtaaataggtagtttgaggttatcaggaacagtaacttgaagcaagaacatcagaaattgttcaccatgcaaatatttagtactctgaatcaaggaacatagtattttttacatgagtattccagtaaggtaattaaacttatgaaaagggtatataactttttgtaaatcattaaaacattttatagtccttgtaatgatttcaggaccttggacagctagaaggggcttaagaaaaaatggctaagaaaacaaagtaaatggttttggccagcttaaaaagagaaagcaaaatagttaaaaatacatttcatagattgagaatgtacgggctatgtcacagttacgctacttattttgtggttttaagttagtctcaacatctttgggcctcagaatcaacttttttatgggatcttttttctctgtttttaagattatctcttttttctttggtgctttgcaggtttactgtattatttggaagtgcgaatttatttttattcttagtatatactggcttcttcctgtatcttttaattcatgttctgtaaaattctcaaccactagctcttcaaatatttcttctctattctaggactgtatacaaatgatagactttcttactgtatccttcatgtctcttaatttctcatatttttcatcctcttgtttctctttactgcattttgggtaatttcatcagctctatctttctgtttactagttcatttttcagtagcatctcacctgctatttaaaacaatgatggttttaatttcaataaatatatttttcatttgattctttttaacttcccgtttactcattacagtcccttgtaagtctatttctaatttttaaaagtcaaatatatgatatttttgataatttcaatattttaagtctttataagtctacatttaaggttattattgcatatcattgtgacttatttccttgagtatgtgttaatctgcgagaagacagagggcctaaattgtgtatgttttccttcagtatgatttgagttcgttgcttctctgggtgaggtggtacaaactccttggcatactctattcacctttgtggatcctgattgaatgccttgtcttaagtgtaagctccctgacccttactactagccgaaggttttgtctctgcaggtcaattccaaactaacaggcagatgctgttagctatctgcctccagggataaaccccatctttcaagcttgcttcttgcttgatgctttctgctgctttcttgcttttgtttcagctcgagtttgttgttgttttttttttttcctgtttctgtcttgaatgtagagggtatttttatttttattttttctgtttctctcttgagtgtatagtgtagagggggtttctgtcttgagtgtaggcctggagatttcccttatatggtacaaaccagcaatgaattaagaggtctcttttctccaagatctagtgttttgtactaggagaactctaaaaagtatctattccactgtagtgccaaagtacaaatttatttggatttattttttgccatcttattttttaatatatttctttttctatgttgtgcttctttcccacctttactctcctcctatcttttgggatcagttgggttttctatttaatcatatattttccctttactgatttggaatgtgaatgttacaagtccttttgattatccttaaacatctaaaaatgctaccctctttccaaacaacacaaaggtattgaaataacattaattctaattaaattccacaagttctttattaaatctccaaattggatattattagtattttatatagtcaatgtttatttttttgatgggacatggtgggggcttaccttttttcttgtgtgtcagatgttccttctaggtagaattctttataccttctgaaattatgtccttagagctgtagatttagaactgacatctcttgagctgttctaagataatatcttttactttggagatacgcagtttttattatatgtctagctatagatttatcatggatttaggttcattatgaatctgcagatttgtgtcttccatcaaatctggattgttttcaatattaaaaaaacttctattttaaaatctgtatatagaaaggtacataaacataaatgaacatgttaatgagtaattgtaacaactatgtaactgtccaagtcaagaaataaaacatatcaagtaatcaagaagtccagagttttctttggggtttcattacgtaggcatgatttattaaaacctttactgtgtgcttgaacttaatctccagtttccctcctctgtctggacatcaggctggctcaaagtctcaacaccctaatcatggttgtttttttgaagtgagctacctccatcctaaatcatctttttagcattagctgtctagggcccactgtgggtcacatcattagcatacagtgtcagggcttaccatgaataatgaaggcacttctgttgtttaggaaattccatgggttttaggagcttggtgtccaggaaccctgaacgaagaccagaccaattatactacagaatcttttttttttttttttttttgagatggggtctcgctctgtcgcccaggttggagtgcaaaggtgtgatcttgactcactgcaacctccatctcctgggttcaagtgattctcctgcctcagcctcgagtagctgggattacaggcacctaccaccacacccagctaatttttgtatttttagtagagatggcatttcaccatgttggtcaggctgatcttgaactcctgacctcgtgatctgcccgcctcagcctcccaaagtgctgagatacaggtgtgagtcaccacccctggccctactacagaatcttttaaaataagttttgagatgtattatggccccaaagtgatctactttagtaaatataggtatgacttgactgacaatgtggttatgctcagataagcccattgtaaattgaaaatatcatgagtgaaatacatttaatacatctatgaaacatcatagcttagccaggcctacctcagacatactcagagcaactcacgttggcctacagttgggcaaagtagtgtaacacaaagcctgttgacagagcctgggccgggcgtggtggctcatgcttgtaatcctagcactttgggaggccgaggctggtggattgcctaagctcaggagttcgagaccaacctgggcaacatggtgaaaccctgtctctaccaaaatacaaaaagttgactgggcgtggtggtgcacgcctgtagtcccacctactggggaggctgagacaggagactcgcttgaacctgggaggtggaggttgcagtgaaccaagatcccaccattgcactccagcctgagtgacagagcaagactccatctcaaaacaaaacaaaaaaagcctgttttataataaaatgttgaatatctcatgtaagtatcatactgcatatcagtcaccgaatggaattaacagcagatactgctggagaaaaaattagtgcactagaagtcagagcaataaattattcagaaagaaacagagaaaaaataataaacacagcatctgtgagctatgagacaacttcaggcaggctaatacatgtcttattcaagtccccaaagaagagaagagggtgggagatgtaaaaaatatgtgaagaaacaatggagaaatttttccaaatttgaggttaactataaacccacaggtccaaagagcttggcaaatcccaggtacaataaacgtgaagaaaactataccaaggagtaacctaatcagagctcttaaaaccagtgataaacaccatcccttgaaaaagacatactattgcagaaaaacaagcaaagccaacaattttgaaaatattggaagccagaagacagtggtctgacatcctcaaataaagtaaagaagtgggggaaaagttggttaacttagatatcttaaaaaaaaaaggaaaataagaacataaggcatacatatgaaagaactcatgcccggtagacctacattacccataaaattagaggaagtccaacaggcaggaagagcacaccagatggaaatacagatctacacacagaaatgaggagcaccagaaatatgagtatatttaaaagctttttttgtttcttatttctaagtgtctttttaaaagttggctatataaaacaaaaataaaaattattaaaaatatattgtaggattacaatatatgtgggagtaaaatgtaacagtacaaaggccaggaggggaagtatataattttaagtatagaaatggtagtatattattgtaaggcccttaaactaaacatgaagtggtgggttacatcttgaagacagactgtgataagttagagatgtataatataaaccctaaaataaccactgaaatagcaaaataagttttaattaataagccagtaaagaagataagaaatagaataataaaaagccacaaaattcaatccccaaaaaaagcttaaaaggagagaaaagaggaataggacacatggggaaaatagaaaacaaatagtaggttggtacatttaagtcatatcaaaatcatgttaaatataaatgatctaaaaacctcaattaaagggcagagattatcagattgcatgaaaaagtaggacccaactgtctgctgtgtatataaaattttttaaaaaataaagacaaatatgttaaaagtaaaaattggataaaagacacgagtctaacattaatcaaaagaaagatgtaatagctttcaacaggaaaactgcttgttagagcaaaggaatttaatcagaaaatcatttcaaaatgataaacgagtcagttcatcaggagaatgcaatagtcctaaatgttaatgcatcctcaaaatacataaagcaaaagctgataaaactgcaaggggaaaaatatccacaattgtagttaagagatttgaggctgggtgtggtggctcacacctgtaatcccaacactttgggaggccagggtgggcagatcacaaggtcaggagttcgagaccagcctggccaatatactgaaaccccgtctctactaaaaataccaaaaagtagctgggcgtggtggcgggcacctgtaatcttagctactcgggaggctgacgcaggagaatcacttgaacctgggagatggaggttgcagtgagctgagattgtgccattgcactccagcccaggcaacagtgtgaaactcccatcacacacacacacacacaaagatttgaatacttttttctcaataattgctaaaatgaacatacaaaaaaaaatcagtaaggatacagaagacctgaacaattgacatttatacaaaagtccacacaacagcaaaacattttgttaaagtgcacacagaatacagatgttccctgacttacaatagttcaacttaaaaattttcaacttcataatggtgcaaaaacaatgtacattcaggagaaaccatacattggattttacattgtgatgctccttctgcttctttcaggtgctttctttctcagagttcatatgcatataataatcaatactcaactgaggacttaaggggtattttctgcagatttctgcagctatctgaattctgaactctagctgttcgtgcctccagactcccaggtccttaattcacagagactgctgggctctctctggcttctctcctccagggctgcaccctggaaacttcaggcagtaagctaaggcaattgtagggctcacctcatttgctgacttttcatttctgctattttgtttttattttacttttttaaaaagttcttccttattctctaaatgtttatttccatagcaccctgttcttgttcattttttctcagatacagtatcttctcatctctaaagatgtggtaaaacttccaaagatttccttatactgtatagtctctcttgaagttgcttttatttgtttaagaatgtgggactaaaaatatgactggaagctctgatagcttgggtaggacttgtcagctttgagttacatacaggatgatctggctaggccattgttgggggaactcctgatgtccgtatcattagatctttcctttggggctggttatgtttatcaaatatgatgattaaaatatcttacttagattatgaatgtctgtctgtctggctggctgtgttataggaacaatgtggggaaagggactagaaatctcagcattcaatatgtatactcatttaatcttcctgttcttagtatacttcctagattctcaactaaaccaaacattctctagttcagagaccatttgttttactgtcctctagaggagagtaaaaaaagagttttactcttttacaattctctagaaaaaaactccaaccttttgttggatttgaggagataatttctcaatgtttttagtctttaatttttgttggtacatagtaggtatgtatatttataggggtacatgagattctttgatacaggcatgcaatgcataataatcacatcatggtaaatggggtatccatcccctcaagcatttatcttttgtgtttacaaacaatcaacttataatcttttagtcatttaaaaatatacaattaaattattattaactataatcaccctgttgtgctatcaaatactaggtcttattcattctaattattttttgtacccattaactatccccacttctcccaacccacctccactacccttcccagcctctggtaaccatccttctactctatcttcacaagttcaattgttttaatttttagctcccacaaataagtgagaacatggaaagtttgtctttctgtgcctggctaatttcacttaacataacaacctccagttccatccatgttgttgcaaatgtttctcaattagttttcacccacttctccttaccaagtcccattagcatcacatcattgatgtggaattagccctgtgggttatcagcttgtggatgtccagtatttgtgaaagcaaaagtaatgatgtattgctatttgaattacagctgtgatatatagtcttgcatttaatggttccaatgtagacttaaaggtagaagctctcatggtaggacacctacatagtatacttggaggcatccccaagagcctagaatctgcccttcccacttttccaacaatgccctaagtacctaattagctgtaataaattcacccctttctgcctaaactacctagattgttctgcattattcctagaatgacagaatgatagaaaactcaattcttttaaaaatctgcttgcactttttcttacactgtctgtgttaaaactgtcatgttttattttaattactattttcaacaaagtcatttttattctatatgaggtaatacaaatatttgaattatttggtgggggactataattctttgtcttatttattatttctgctgactactcacatgctggcatttttcctcatgtgctctgtgattttggagtgtgtgttcatgtttgctagcctttatttgtggaactcctgcaaggtctggatgaggatgtgtcactccaggaaatatttgcacttgcttctgctggcacttggactattttgttaatttcttatcttgcaaattaaacctcaaatcttggcagactgcaggcatgcattctcagatgatacttccacctctctcccagttcatttttcttttttttttttttaattatactttaagttctagggtacatgtgcacaacatgcaggtttgttacatgtgtatacatgtgctgtgttgctttgctgcacccattaactagtcatttacattaggtatttctcctaatgctatccctcccccatccccccaccctacaatggccctggtgtgtgatgttccctgccctgtgtccaagtgttctcattgttcagttcccacctatgagtgacaacatgtggtgtttggttttctgtccttgcgacagtttgctgagaatgatggtttccagcttcatccacgtccctacaaaggacatgaactcatcctttttatggctgcatagtattccatggtatatatgtgacacattttcttaatccagtctatcattgatggacatttgggttggttccaagtttttgctatagtgagtagtgacacaataaacatacatgtgcgtgtgtctttatagtagcatgatgtataatcctttggatatatacccagtaatgggattgctgggtcaaatggtatttctagttctagatccttgaggaatcaccacactgtcatccacaatggttgaactaatttacactcccaccaacagtgtaaaagcgttcctatttctccacatcctctccagcatctgttgtttcctgactttttaatgatcgccattctaactggcgtgagatggtatctcattgtggttttgatttgcatttctctgatgaccagtgatgatgagcattttttcatatgtctgttgactgcataaatgtcttacttttgaaaagtgtctgttcatatcctttgcccactttttgatggggttgtttgcttttttcttgtaaatttgtttaacttctttgtagattctggatattagccctttgacagatgggtagattgcaaaaattttctcccattctgtaggttgcctgttc

SEQ ID NO: 1997 - DNA, 2464 bp, Homo sapiens
gctgggggtggagccggaggaggaaggcggcggcgacgacgaggaagacgccgaggcctgggccatggaactggcggacgtgggggcggcagccagctcgcagggagttcatgatcaagtgttgcccacaccaaatgcttcatccagagtcatagtacatgtggatctggattgcttttatgcacaagtagaaatgatctcaaatccagagctaaaagacaaacctttaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtctataaacctgcttgacgtcttgcacatcagactacttgttggatctcagattgcagcagagatgcgggaagccatgtataatcagttggggctcactggctgtgctggagtggcttctaataaactgttggcaaaattagtttctggtgtctttaaaccaaatcaacaaacagtcttattacctgaaagttgtcaacatcttattcatagtttgaatcacataaaggaaatacctggtattggctataaaactgccaaatgtcttgaagcactgggtatcaatagtgtgcgtgatctccaaaccttttcacccaaaattttagaaaaagaattaggaatttcagttgctcagcgtatccaaaagctcagttttggagaggataactcccctgtgatactctcaggaccacctcagtcctttagtgaagaagattcatttaaaaaatgttcatctgaagttgaagctaaaaataagattgaagaactacttgctagtcttttaaacagagtatgccaagatggaaggaagcctcatacagtgagattaataatccgtcggtattcctctgagaagcactatggtcgtgagagtcgtcagtgccctattccttcacatgtaattcagaaattagggacaggaaattatgatgtgatgaccccaatggttgatatacttatgaaactttttcgaaatatggtgaatgtgaagatgccatttcaccttacccttctaagtgtgtgcttctgcaaccttaaagcactaaatactgctaagaaagggcttattgattattatttaatgccatcattatcaactacttcacgctctggcaagcacagttttaaaatgaaagacactcatatggaagattttcccaaagacaaagaaacaaaccgggatttcctaccaagtggaagaattgaaagtacaagaactagggagtctccactagataccacaaatttttctaaagaaaaagacattaatgaattcccactctgttcacttcctgaaggtgttgaccaagaagtcttcaagcagcttccagtagatattcaagaagaaatcctttctggaaaatctagggaaaaatttcaagggaaaggaagtgtgagttgtccattacatgcctctagaggagtattatctttcttttctaaaaaacaaatgcaagatattcccataaatcctagagatcatttatccagtagcaaacaggtatcctctgtatctccttgtgaaccgggaacatcaggctttaatagcagtagttcttcttacatgtctagccaaaaggattattcatattatttagataatagattaaaagatgaacgaataagtcaaggacctaaagaacctcaaggattccactttacaaattcaaaccctgctgtgtctgcttttcattcatttccaaacttgcagagtgagcaacttttctccagaaaccacactacagatagccataagcaaacagtagcaacagactctcatgaaggacttacagaaaatagagagccagattctgttgatgagaaaattactttcccttctgacattgatcctcaagttttctatgaactaccagaagcagtacaaaaggaactgctggcagagtggaagagaacaggatcagatttccacattggacataaataagcatattcagcaaaaaggtctgaaaagcaagggaataccattattttcggattagcggtttattaagctcttctatattaaacactaatagatattcaataacggagtaaactgttccagataaagcaagaatagttgcaagaagtaaattctggcacaaagcgtaaaaatataacagaagaaataatgtaaaatactatcttttatgtctaaagccattttatattacttttcaataaaaagaatatcatg

SEQ ID NO: 1998 - protein, 715 aa, Homo sapiens
MELADVGAAASSQGVHDQVLPTPNASSRVIVHVDLDCFYAQVEMISNPELKDKPLGVQQKYLVVTCNYEARKLGVKKLMNVRDAKEKCPQLVLVNGEDLTRYREMSYKVTELLEEFSPVVERLGFDENFVDLTEMVEKRLQQLQSDELSAVTVSGHVYNNQSINLLDVLHIRLLVGSQIAAEMREAMYNQLGLTGCAGVASNKLLAKLVSGVFKPNQQTVLLPESCQHLIHSLNHIKEIPGIGYKTAKCLEALGINSVRDLQTFSPKILEKELGISVAQRIQKLSFGEDNSPVILSGPPQSFSEEDSFKKCSSEVEAKNKIEELLASLLNRVCQDGRKPHTVRLIIRRYSSEKHYGRESRQCPIPSHVIQKLGTGNYDVMTPMVDILMKLFRNMVNVKMPFHLTLLSVCFCNLKALNTAKKGLIDYYLMPSLSTTSRSGKHSFKMKDTHMEDFPKDKETNRDFLPSGRIESTRTRESPLDTTNFSKEKDINEFPLCSLPEGVDQEVFKQLPVDIQEEILSGKSREKFQGKGSVSCPLHASRGVLSFFSKKQMQDIPINPRDHLSSSKQVSSVSPCEPGTSGFNSSSSSYMSSQKDYSYYLDNRLKDERISQGPKEPQGFHFTNSNPAVSAFHSFPNLQSEQLFSRNHTTDSHKQTVATDSHEGLTENREPDSVDEKITFPSDIDPQVFYELPEAVQKELLAEWKRTGSDFHIGHK

SEQ ID NO: 1999 - DNA, 185555 bp, Mus musculus
  misc_feature (1)...(185555): n = A,T,C or G
tccggctgatgtcctggtcccccaggtgccccccagctctgtccttcagcctgccacccagtggatactccatgtgtcttgggtgatggcattaggtccttcaaccctagatatagtccaagttctgcctcaaatcctcattgcactactattctataagattctcgctgtaagagaatcaatcacagggagagagtgtgtgtgagcagagagagtgcttgactgattttgcaaagcatccctacgaggctcccagaccttaccttggcagttttcctatttcttggtagcctgaccaagcagatagaataatgtggtccattccatggggggaaggctgcatcttctgacatgacttattctaaccgacagcttatttcaatgagcaaatgtagttaacacaccccaaactgattttgttggtaaacatcacccaactgttttcttattaatttaccttggcaacacctctccatcatgcaattatgtgggattttagacccatatttacacccatcccacacacaccttatgctacctcatcttctactactgtgtggagggaaaggacactctcttaggtttctgcaggacttcgtataatgttattgggagatgtcaaagacacttgatcccaggagtgtggtggcaataaaagttaggggctgcccagggcttggggagaggccacctggaggagaggtgtcctttggaatctgaggggaggagaagagtctctaggccaggtgttttctggatttccattcagttgctgtaagactagactttggaattttaaaatgcctccccttgaactataagtactgggagacaggaagggctgagaaactcgggcgtcctcaccaggagcccagatcagcagcagcagcccctgggaagttgttaaaatgcaaattctcaggtctcagcctagacccactgagtctgaagctctgctgaatggcccagatattattgtgcaggggagtcccgtgagatcaagttgaaggaccagtgcactagagactaggagcttcagatactccccttaaaaataactgtcctcggggtcgaggagatgactcagtgggcagagcgcttgctgaacaagcccaacaacctgagtttgaagcctcagaacttgggtaaaactggacccagttgtgcgtacacccagaatccccacacttctgtggaagatgggagatagaaccgggagaaccctgggaggttgaaccctgtctcaacaaacaagcatctacacccagggttgtcccggaacctccatgagcttgctggctaacacactgacacatatgaacgtgtgctgtgcacacagagccatgtcggacccctctgcccaccaaacagaaaagcgaatggccttcatcttctccatgtccctcagaagtctcatccttggttcttgcttgtagccccagagccttgaggtcttcccctcagggcagtgcgtcctcaggtagggtggggcttaactccacagccttcggctgggagcagagtaggccggacagtttttcagtggataagaagttacaagtcccatggagcctaggaagggccatcttttcctactgtgacaagtagttctgtgttcttgtcatgtacagtgttctcttctatccaacagcccaggcttctcccggggcacactgttttggtcttcagcctctccagttctatttgaggaacattccagagcatgcccaagatggctgtcatacattgtctcccttgtgtggcctcagccctgtttatgaaactacagctgtgtgggtctcctgtctgtgagtctctctctacagcccctaggtatttagtatgtgtcctccctcctattctaccttctttcacacatgtgcttgaacacatgcatacctgcctgctcacacatgcacacacacatgcaggcctgcaagaatcttaaccacaagtctggcaccttcaggataaagtccaggcttcttagcctggtatctagaggcctccatctgctggcaccgccccgagtctagccttatctctcattagctttctttgtgaaccctgcctccagtcagaagggtctacttgggaacccttgataagataagcaagcagaactagagacagtgagtccagacagccatgggcagcttctagtgcttgagttaagtagtgcaacctagagaatgttctgtggagagaggtctagtggctccacaacaccatggtactgtctttccttctggaagttcaccatcatagctttcttggacacctagttttgagtagtcacttgatggctattgtctagaaaatgttcccgctggttgggtaatgggaacacactgcaatttgctggagtgctaccacctaccctcataacccaaagagcactactgccacctggtggcagctacctaaaacacaggcaagagttcatttcatttattccttcactcattcagcattctgtgaactgagagacaagcaggcacctcctggccactggaggcacaacactgggccagatatagtcttcattagaagcctaacttatgcttggagtgtaagtatatagaggtaacctcggtggtataggtttgaggtgctatggtagggaaaaaaatggtcagaccctgctttctgggatgtcctgggggcctttcctgagggggcatctactcttgagtaatgaagatgtttaggaaagaacctagcctatgaaggaagggtgaggtgtaggtgacccagggcctgccataagttcatgagctaggactctctctctctctctctctctctctctctctctctctgtctgatagtactgaggattaagcctagggcctatgcttgcaagcgctcgctctgtcactgagttccagccatggtcatagagcaaatctttttttcagttcacagtgttctcagggtagaggaaactgagccttggtttaggcagcaccagatcctagagggtctttgagtgggctaagatgaatgtcacatgcagacagacccagagtccctgtgagactgggagcaggctcctgggagttggataaagcagaccccagatctcagctgagcctctaggtagttgggaagttgaaggttgacacgccatccccttaggagctaatacctctccatgcctgtctcctgatctgttggtccagatgtagccttggttactagcctgttctagtgccttgtcccacagaagagtctcatgggctccctaccaggggcaggaatgttctatatcccctaacctaatggtttttcctcttaggtctgactccacctcccagcctcctctacagttaggtgtggcctcatatctgaatccaggccaaggcaaaaagtagtagagatctctacttcttccaggcctgacttgcaaagcaccacctcccagaatcccctcctcttctttcccataggctagttagctatggctgatcctgcagggatgtctgaaggtctgttgagtgacaagcttatgggatgaagggagcctggatcttcaaacactgtgtgggagctgctcacaggatgccttgctttggaccattatgtgaatggcaactttatatctatttccttacaaggattggcagatctttgttacaacattattcttcctagcttcccccctagacccaattctaatctccatgcaattctttggggatagcagggtcctgctttgcactaatgattttcttggaggcagctgctgcctacactcctgactgatagcccatcttctgctgtatgagcactggccctgtgtagatgttatggtgccctcttcaccctgtggtgggatgttcccgtgctgacaacataaggaaggccactatggtcttgctgtcaagctctgtagagtctgaattctgcgttctagccatgcagtctctttcctcagtgcctggcttgcccagtgactgggaggtgacaaatgactgttccgggctctaacttgctgaaagctctctgacttgccgcaaggcagtcgagccatctgctgactctgcatgttcgtaggcaaagcgtgtctcattgtcaacatgtggccacactcagccatgagacatgccaagagagagtctctgacaatttaggacgtgccaacagctcacaggctgagatcgtgggtgacatatattgatggaaaaatggagaagtgagggaggcaggcttggccatatctggagagcaacatcaagagcagcccgtggtagctctgtctagtagcactgtctactgccttctgatgacatacccagtcaaaatctaaatgatcgtgtcacttctgcctccctgagatgggaagacctgtgtgatgttgacacgtgggtgttagatgctcatctgatgagccaaatttcattttaagtaatgaagtcagaaggaatgtaattggtctaactagcatctcctcactgccctgcttgaagctctttaatggtttccccactcctcagagggaaagtaccgactgtcccacatttctcctacagcatccagtccaatataaggccttgttcagggccccagcattctctacatttttcaggcacacaaagcaacggcagtcagtcccttgtgcaaatccaatgagtcacggttgtgagaatgaatgagaaggaggagatttgcagacgagtaagagacacgagcatggagcacagactcggcggtggaggaatggatgtctgtatgtctttctaaatacaagcccagtgggatcagttcctgttcagttatcatatcagggttctcgtggcctaggctgctgtctgacagagcagctgccaaggaaccaatggaatgagctgtagtggatgaacaaggggagccgtgggcatactgagggaggcttggcaggcagaacctgcagggattggtgcttcactcatggcaagaaatggtgggtaggaagaggtaaagtcacgggtaagcccaaattttcgacttggagccacagagacagaatgtgggagaggtgaggcgagatggaagctgcagtcacgaatctagttttagatatttccaatcggcagcatctgtgagatagttgtcagggagggggacccagtgggcagctggaaatattggtctgaaacttgggaatgagaatggagctggagaggacagactggggaggggtgggccccgaggatgctaatgacgggcaggaaggagagacggcagagcgacaggcggcatgcttgcacaatgagatcgaaaatatggtccctgccctcacaaaccaatacaaaatcaagatttgacatagaccttaaagctgtttatgcacctgtccgtatttccatagcaaccccgaagcaaagagagagctctgcccttatcacaggcagggaacacacacagatggctgctgtctttcacaagtctgcaaatgcatgctacatcctcttaccacatcatgcacagacagtgagtggcacctggtccagccctttctaagcctgcttttctctagccccgactctctacacacgccgctcccaaagccatcatgagggtaaccatagggaccccaataccaaatccaaaaacatgttgggagccactgcactcaagcagtcaatgtccttggccatgccctgtgactgcttgcatcaagtgcttgctgggttgaagttttgctaagccaggtacacagagcacatccctgtccccacaactatgagagttggggggaaaattgagatttggagcaatagtgtaagttcctaagaccacaggaactacagtgtgaggacatttaggaacaaaagggtttgagtccctcagcactgaatatggcttctctgtgatttttttgctctctggaatccaccctcctctctcccagacttctctctgcccttccttgcagcatgtgttctctctctctctctctctctctctctctctctctctctgtatgtgtgtgcatgtgtctgtgtgcaggctttgtgtgtgtgtatgcacacaagtgtgcatgcatgagagaaggtcagaggtcaacgttggatgttgtttcttgggataccatctaccttggtttttgagacagtgtctttcattggcctggggctttctcagtagggtgtgctggctgctcagcagaccaaagggattcaactgactctgccattccagtattgggattttatttaagcttgtgctaccacagctgactcctttgtgtgtgctctgggtattaaaattggattctgttgtttacacagcaagcttcttaccaactggggtgggaggggtgggggtgggggtggagtttttgttttttagtggctcaccatccatcctatccacatgcaaatgtctctgaagatggaagccattctctcacttcaggtccttctcctcattgttgcaggtcagccttgttacctgtgaggtcctttatgtgcttgtgctcagcatgcaaacactggagccactgtcctttccctacctaggctctttcctggactcctccccctccccccatgtcctcactgtgctgcaggacaccatcaaggggagaagttagaaggtcaggcattaccgttgacatccttcatcccctaacccagctcccagaatacaactatccattatgcctttccagagcctcaaagataactctcctaaccagtttccatgcctcctgattcactcagagcatcgtctcctactgtgatgacccacagcctcttggctggactcttcctcaaaggtataaaccatcctatctacctgctaataggtatttctagaagcattgctcacctcttcccagggttcctctgaggtgatctagagaggcgcttgcagagtgctaaggaggtaccacacactttctttgctcggggctagtctggccttgagtgttccctgaggacgcctctttttgcctctgtcttgcttttctgtcagagacagccaagcttagcactgagcagctgggaaccttccactgagaagcaaggcacctcttctccacacatgcagtttttaaacacaggaatatggaggaaataccacggaatttatggaggaaaagctttaaaaagaaacacaagacttaagtcaaaacagttgactcaactttggggagatgtctgcctcagggtaggaggggaaggagacggagtgtggagacaagagaaaagctctgtggggtgcctactatgtggtctcagtgcccctgacccccacccccagctctcagaatcaggggccaggaagccacgctgctcagaggtaacaggggccaggaagccacgctgctcagagaggtaacacttgccttttcatccagctatcccacttctaagagatcctgtaaagtcaagaaactggaaatgtgaatgacactctacagagggttggctagttgactcccccagtaaccatggaatagatccataagtagctacggataccttgctctggatgtagaagtgacacacatcacagaagtgcagacttgaatacatcacagtaggtaaaatggcatggatataagaattttttcccacatggaaaaaaatattgatatattaggggcagtactttaatatgacaacagaatgtccctacattgcttcatgaacttcaaaagtctaataaatccttgtttatgttactttcctgctgaaaatcctttaggtcacttatttctgaccctaccgcttcatcttggctagcttgcttctcttagtccttggttattatctctgtcccgcagcagatagagaaagggtgtggctgtctgtctcagttttctattgctgtgataaagtaccatggccaaaagaaacttggggaggaaaggtttatttcatcttggagtgcgcagtccatcatccagggacgtcaagccaggaaccagaggcaggaactgatgcagagatcatggaagagtgttgcatactggtttgttctccatggcttgcttgttcagcctgctttcttatagaacccaagagtgtctggccagcatcacccacagtgagctgggcccttccacatcaatctccaatcaagaccagttttcctataggccagtccttcggagacattttttttttaaattaagaattcctcttccccaatatgttttggtttgtgtcaagctgaaagaaacctaccaggacaccatctctccatagcatttgcagtttctacagatcgcacgtcacctagggatacctccacacttattgttatccttcgggtgtgagcagcccctcagaaaactgggtatctctggctgaccacttgcattccataacaatggcaatgagcatctggggtcacatcaggggtgagcgtacgtcatccatagggtgatataacagacacattcaggacggaatggatgacctggcttataccacgacaaaactatgtgaccttattctagtccctctccctttctggggttctgtttccctctctataaataacactttgccacgatcaacatttctcagagcaagttccttagagtactccatccgagctgtgttaataaatgcccctgaaggaggattctgtggtcaaaggcacttgggctatgctgctggccacatcccactcaacattcccagggcatatcagcaacttcatagctctgaatggagctgcagtaaataaacttactgattaatgtttagaccagcctttctcacacttatctcaccttggacgccttagggagcactgtgtgtgtgtgtgtgtatacacaagtatatatgttgttttttccacagtgttgctctggcatgtgcactgaattcagtcacatctgaggttgttccttccctgagcatggccataaacctgccgttgctccagtagcactagctgtcactctgcatggtagctccttaatttgagcagactatctgaccctgtggaggagaagcctactctgagagaggagaaagaaagatgggggggggtagttgaggaaaagaacaaggctcgtgggtcttaccgtagtacttaaagcgcagaaaggttttcccacctccaggcctccacccatgctctctttctgcttctcctgcagctctctacaggacaaactgctttctcacaggcaaatctcagtgatggctttcctccctagagtcttccccactatacctcctagcaggccatcccacaggctgtccccgaagctccgttttgagaaccttcacagcactgttctgcactggtaattattccttcgtttgtagactgtatatccatctgcaaagaatcttctccagggttgggggccagcatcatttgtgagtatggcggatgctgaccccatatacactctatgaatggccgaataacgtcatggtgggtgttttcctgctcacccaacctttttatctgtcttcaggatgaaacacgctgatgaataagcaaataaaatcatccagtgtctttcatcaaattagaccagaagctagaacagtcaacccacacacgactacgagtgagcttttacacaaccaacaactcatgctgagagcgctcacccgaggtaagatctgtggtctgcaccaatactgtgagcatgcctctcctctcagtcaggagcttgcatcctataaccaatgcactgggaggtggttggctacaaagcagatgatgctgtccacctggcccccagaatccatggaacattcagagtgccctggcctgtgtcaccactgaagtacagatcgacaaaggtgtagagaggcaaatcttgcaggaggtctttctctgaggacggcgtatttgagaagcagtcaatggttaacaaccattttgcttcatgatgaccatgaggcccgcctgtctgctcctgtttctggggaagctaacataaatgtttattgacaacacagtcatcaagaaaataaagttgctgattcattgccctgaagccctttgtttctccctctgcttccttcctctttataaagaaaggcacactctaagaaagagcacttttgggggactcacttgatgggatgttcagctgactacctacttctttctccaccacctatatacagatcaggactcctataagggcaggagagcagcaccctctttcctcctgaggaccacccctccggggtctccgaggaaaaatggaagtgttggggcttctcaagtttgaagtcagtggtaccatagtgactgtgactctgctcgtggctctcttggccctcctgaaatggtaagtgtggccaaccacagggactgcgacactacaaatgtcagcccaggagcctgtggtgccaggtggggtatgcgggcgtgtgtttttcttcttgtctaatctagagggagttgagtattaacacggcttcggaattaaaagcaaacagccaggttaattttttgctaaaatgcatgagattcaagtgtcaggaaatgctggagactctgtgactgggaacgctacacacaattaagtctgaaagaaatggaaaaagaagcggattggaaaggcatcggggatggctagaagggctttctccaaccctgacgtacctgctcaccttgttttttgaaatcatttcatgttgagtttgcaacgaattcagcctcttggctcacatcaagttaaagacatggaagctcttcggcaaacaaactttactggggacagagatgcctgcagggttaaggacaaagtggtagaataaatttcccaattttctaatatgtggtagaaggggatgggtgccaaattaagagccaggtgtggtgacaatgaagctggggacccagaaggaatcttaaacttgtgctacatacactgttgctctttgtgtgtttgttagttcaacaacagaccttgtgttttaaaagctggccccaatggtgactgtgaaggacagacctcacaatgagctatatttgtgtttacccagcggggtccttacctttcctggagatacccatggattcccaaacacttggatttaggttgtctctgggttttgaggggaaagtggaaaaaaaaaagaagagctggaagagagtttcaatttatgtttctagtggtaataaagccacccgtagattaatagctgggaaggcactttgaaaaacatcaagcattatgcaaatgtgaggtattattcttttggaatttgcatagctgaaagtggaatgtgcgtttgatgttctctgatgatgatatgacttattggaaattggctctgaagcccagcatcgggcccagtgctcttttggtttttaactggtttggttatttttttgaacttttctgtctcagcatagctgatctggcattgaaaccagccacgtgtgaaaacaagagcaaagggtagtcccttgcccccgtccctaacaacccacttcaatgtgttctcagtctctgtggaatccaaaacaaagtatgtggcatgcagtaggtgcataatagatgtctaccactataattttctcctactaaaagcagaggaaagcgtgattgtgggtggggagggataagacgaacacatgggtagtgtgtgcaaaggcctaggtttaaacccccacactgaaaacgagccatcttcagtggtttgctttatgtgtcttctcactttttattaatgttctggttatgggctagggctatagctcaggtggtagagaacttgcctgcatgcacgaagccctggggtggatccctagtaccatacacactgggtttagtgacattaatctgtatgtaatcccagaactggggcggggaggaggagggaatgcgtggtaagggcaggaagatgagaagttcaagatcactcttaaccaacccagactatataagatcttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccaagagtgtttgtagagagtctctgcggaaagctgattgggaacacccggctacgcagcttatcaggcaagacgcgggccctctccatgatcagagtgtcctactgggctgtcttccgggggtggcttgccttttggtatctggcacaaaatgtcgtcatctataaagttcacagttgagaactatgcaattctgttacaaaagaaaaccacacacacacacacacacacacacacacacacacacacaaaaccctcgtgttttaagtgagtttaatgtttttctgttgggctgaagtcacagatatccttgaccataggtggtccatgggatacgcctaactggcctgctttaggtgttccagggagactgcaactgagagtctaactgctgagtagaagaaagcaccagggaccctggatcttgtcacctcaagtccgtgaattcttcaaggccctgtgcagaatctctctcattgtgattccagaagcttgagctatggcgtgcaaacactgctaatgtttggctgcatgacgtcaatttgacaagtccttatttatcagctccagactcccagtttggcctctccactccatctcctcagtgtctcccaacaccctgtgcattggtcacaccaaacctcgaagtgctgggtgtcccatgctgcacagggccaatctccttgcttagaaaacctgtccctctgctcctcccttcaacactaagcttgggggtgtgatcttgctggagtgtttcctttcttcctccaaagccaccgagaagccccccccccaagcttttagcagcctcttcattcccattccttttgctcacaatgcctgccacatagatgtctaatgaatgctggcagaaggccccgagtctctgccagtcctttctcccttggccttctgttagacttcatggctgtgaaatccacaccttttgccatgagcctctcttgcttcctgaagacctcacatgtgccaggtgaggcagtgtggtgcctacctctataatgatatcagctgcatgcctttcactgccccacttaccttatagagcagagaccgtagtaataacaagcaaatgactattaagtatatgagtggatttggaggaaagacaaaaataaatccactttatccaagagagactgctataagccaggtgtgatatttttgatcatttcccccaaactgagttggtacaatttttcaataatgttcatttaaatgatacttgattgagtggagtcatctggggcataggtagagtcggggctgcttcaacttaggactggggatggagttggggacaaccattatattagtggcaaggatatgaagcctatgtcatggtaattggcacactgtataaattgtgtgtgtgtatgtgtgtgtgtgtgtgtgtacattggcaacttcttatattgctctctaccatatgtattgggacagggtcttttactcagcctggtcggcctccataccagttttcttatgttcagtgctagagatccaaactcagctctttatatgtcccagtttgctcttggcccactaagccatcgccttacccccattagattaaaatgcacatttcttctggtgatacagcttagcgataaaggggcttgtgtagcacaaacaaaaccctgggttttacacccatcaccgagaaggcaggggctgggggaagaacatcatttcatgaaatttttactccgagaagtaagttgagttgaatagtgcttaagtactgctagtgtgtttcaactttcaagcaatacctcaggtctggcagctgggtagataaagatttatcccgttagaaagagtgtgaagaaatagcccaactattaataagaggcttcttttagcaatatgtttaagggagattatttttcttcttcttttagtctttctatggctttcttatttcttaaaggagtgtgaatacttagccaaaaataaataaataaaaataaaaataaagagtgggaactcgctcctttcacggagtacagggtgacacagcaagcagactcatactttgggcatggtggggtagaaaatgaggtgtcacagttttatgtcgggggattggaagggtggtgtactcagcacagaaggcggtatgaaggtggctcacatatgaagactgtgtgggaggggtctaaagtggaaggctttgatgccaggctgtgcttaaagctctggctccaaggttcagaggtctgagccagtccaacatttacacatggatctgagtggggtggtgtgctgataaatgccgctaagactagtttaaattaaaacttgtttgaggactgttaggacttgagactatggtggaaaaccccacccctgtgctcagaagtttcttagaagagagcttgcttgctgtacgggagaatgagttccaattctagagtcttatctatagccaggacatatttaagataagccactggggtagaatgtgggtaccagataagaaacctggagcaaagcagagcaagaaagtattacagtccgcggtccacatgtgcagcaggtctgtgctcatggatttgaccaacctcagattaaaatattaaaacaaaatgaaacaaagatggtggaaaccccaggaagcaaatctgacttggccacacgcagacactatactagatccaccagcactaagtgatgatgctctggtacttccttctgaaccttcctgccatgtcacggctcctcagcctccgcccaccactggactgagcatacttgcctggtatatcatttgcacaggacggagccttgcccctgatgcgcgcacctgtactgcgcatgtgcagattatgccttgcggtctttccctaacgataaagcatagcatctatttagccggtcctcctatcctatgggctagtatacgtcatctagagtgatttaagcacaagtatggtgtatacagattatatacaaagcctggatttttttggtaaggaactagagaatcttgtgttttgatgtcagttgggggttcttgaaaatcaggttaggtgaataccgagggacacctgtgatttctgattcattcaaaggaaggaggaaaatatgtctaggctcatgatgtcatatttacagactggagattggtcacttcccagtggttttgttcctaacgatatttggaatgttgggtttaaggtagatccacccttctttgagattcatagaagatcaagggccctggaaaattctacaggaaaaaaagcctatccaattttatgtactatggcattcccacattcatttgatgaagtaatgctgtgtgcggccatggtgggagggaaagtcaagtctttcccctgacaaagatgactaggtgtgtttgtgggctggtagaaagtgaagactactacagagaggctgaaagattataatgacccgttttagaccccgaggttctaagagttggtgtattgttccccacaggatgagaaacctatggagtttagtggtaaaattagggtccacaatgagctctggctccaagtttgacatcagagtcgccgcaagcacactattttcgcagtaaggtggcagaagtgttacccgagagtgtgtgagtgcccctgccatccatcagggatgctaacaaagcacttggtgtagccagcagcaaagaaacgcgctgagctttctggatctggactccatggcttcggtgtcgcttggtgtatgtctatgtggacctagctactgctcctgcaaaattagctaaacccctccctcatgacccacaaatgatgattctttcttttgtccggttttcctactcatcccaagtggcagctcctgagccttacaaagtgccgtggaagcttggaaatacaccccagaagcagtgggggccttctctggatctttgtgaatgactatcgtctctctcccaggcccaggcccaagccctcagcttttgcttaaaaaaaaaaaaaaaaaaaaaaaaaaaactctttgtttatgagtgttttacacatgtatgtctgtgtacacctgcatgcaacaccagaggaagccagtagagggcgtcagactccccggaactggagtcacggaacattgtgagtggtttgtgggtgccgaggattggaccccagtcctttagaatagcagccagtgcacttaacagctgttccatctctccagacccctagccttttgctgttactgttgcttgcgctctctctctctctctctctctctctctctctctctctctctctctctctctctctctctctctctctctctctctctctctctctctctctctctttctctttcttttcttgagacagggtctcacatgtagccttggctggcctggaacttggactgggaacgctcgtaaagcaagtactttagtgtgtcctgggtagacgctggcggattgcggctgtcgcgcatgcgtgtgagcgatgcctgtgagcgagcgctcatgaggctatggagtgggaaataccaagctcacagatcccactgcctgtcacctgagtgctgggattagcagcttgtactatgatgcctggcctgctttgtttgttggttggttgtttcttgagacagggtctcatatagctcaaacgcaccatgtagttaaggatgatcttaaacttccgattttcccgcctctctcttctaagtgctgccgccatgacaaccttgtaccactctccctgactttacacggtcttggggaatcaaacctagagcctttcagctgagctgtatctccagccctgtcagtctttctgagtcaccagtcagacatgatgttggcggcagacagacctttagctgacgcagggaaggacagagtgggcagtggagtggagggagagcctggcaggcggggcaggatcccagcaagggcccatcagaggcgacgagtcagtggaaagcacattaggactgtgcatagtggatagtttaggaacgcgcgtttcaaaagccgtggataattcccggtgccttggagcacacagagacagacgaaccctgctccttcgccctgattttttttgcatctgttcctgggtacttcagtttaataaggcactgatgagtgtggagataaaaatgaagcctgcttatgagaactaggtccctccttcaggactatttccacagaatattatgggccatttgttttgttttctcttctcaatagtcgtgcacggtggctctgtccttcttctcactttattgattttccagaacgggagtacgaggtgtgactgtaaagcaacgtgactgattattttagcatacgcaccagaacgtacccagccagatgcattttatgaccttcagaggcatttccctcacaggctgggacctcgctgcagagctgccacgatcagaaactgtgtccttaggactctgctgcggggaggcacgaggtgtttaggtgtgggctctaggaatccctcgggcaaagcatctttgtcgagtggattggtccttaaaaatagctcccaatctggcaaataggtaattaaactggctaatagtatttgcaatccaaataaaaggtgattatcaataataaagctctgggcactatttgctcatggaccagtcatagaagacagaatttcaggggacagccatattcactgggcagatgaggtttgtttttgattttgtttagaaaactatggagacattctcattgtttgtgctctctctctctctttctctctctctctctctctctctctctctctctctctctctctctcatcccttcctccctccgtgtgtgtgtgtgtgtgtgtgtgtgtgtgtgtgtgtgtgtatttgtacacacacgtgagttcaaaggcaaaaggccaacattaggtatctaccttcattttaaaaaaattacatgtatgtacctgggtggtattgacagatgcccttggaggttagaagaggacattgaattccttggagctagagttacaggcagccgtgagactctagattgaaccggggtcctctacaagagcaatacatgcttttaactgctgaaccatttctccagccactctacatcaccatcacaattaccagtcagttcctgaacaaagacccagaagggggctagcctcctatttttttcaaaatgggaaaatggtgtcagaggtgatccaaaaagccaatccaacctcctagtggcttcccctccactaacaccctacctcccaagcattgcacataaacacccaggggaaagaggcagagacagccagcacctgtgatgaggggtgacaccacatccgaggtggcctccacattctgatcagagaatatcctaaaatcttctcctgttgtcctctcctgcccatcacacaacaccctcctctcccacaagccccgttgtttcattacaccctgcccacccttcaaaagctggcttagtgttctccttccataaaggactcttcaaccaggccagtctgcaataagccttgtctttctgccctgttctctctggatgctacaacatcattttgttgcacgtacctatcctgtcttcctgacctgaccatatcccgagggcagcatctgagtgaaggccacaagtacctcagctgctcagtaaatgtcagtcatcaatgcaattcccaactaactgggacagcacccttgcttcatgggatactgtcatacttatggccgaatgtgcacatgtgtgcacttgcatatgcaggggagggtagagcaagtttctctcccaagtgctcactaaagccattgtattttcggcacctggcagactgccttgcttatgtcttctacttgaaagagtaaataaattctctgttccttcaagcattgaattccaaaggtttcctggactgtgcactggtctgccttgtggatgtgtatgctgtggctagcagtcccacgaatttagggagataaaccatgagaaaggagagaacaagagtaggaaagatgggctggagggaatgcagatgaagtcagttagtggtggaggtggtgggagtgtaggacaccctggtcccctgggaggggagaataggtatctaagtacccatagagaggcatcaaagggcaggcatggctctacattgtcctattgatcaccagtcccagccatttagagcaacagcatctgaacgcttcaccaacatccactgttgatatgactgtccccacaggcccagtgctctgttgtccccaccacaatgtgtatttatgctgagactgattgatctttcccatcgtaattattcagatgcaagccaatcacaggctctgccaaggagcagagctgatcaatgagaaagccagcatcagtggaccaaactatcatttggctcctgagccaaaaagacttgacattttagctaacctgtacccttgaactgtcaataaatgcacaatttacattaggctccctgaaatgtggaaaatacctcacataccatccccccaccttcactaatcaataagcagtgggccacaggctgcaaagcaccgagagggaggtataatcagttataccctttaaccctttctgagcacacacacgaggcactgtagtgactgcatcccctgaatgatggaggctgagggtggaaagttctcaggaaaatcgttgtgctctgggaagcagccagccctttcacttagggaccaataatctcctgcagagtgatgctgggcaggtcacacttcctttctcatttccctgtgggttagagaagattcaatagccctcacttctctgcatactcacacttcctacctggccacccactggttctctgggactctgtcttgtcccccacctctgcttccatctctgactcctacaaccaaatagtcatagatccagccaggctagattcctaggtggccctggacccagctcttctctctctgctctcctacggctgaggacttctcaagcatctgagattgggggagccccctatcctgtttgccctgtctccagttcctcaacttcactctgcacctgcagtgaagagaccccacaggcagctaactatacctcagtgtggaaaaaacctgccctgggccatcttctctcatctcaactctccatggctcctgagggctcctagagacttgtccttgctggggcatctcccgacacatcttggctgttctcactcctactctcagttacttcgtgcaccatggcttcctgcctgtttcccttccattggtgggaagttcagctcttcactccgtggacagcttcatcatttgcattcccaggctcttgtctcctcgcacacacgttatcacctctctccctgattacccaacagcttcaccatctgcaggtgggtcccccaggcagggtcaggcgttacttactgtattggaatacatagtattggggccaagcatgtgtgctcctattgtgcagaaggcatctgatctagttggctgtgttgaatggaaagacacaatttatagggctttgtggggacataagtgaacacccagtacatggtcactgttcttggactccccagctgtcatcctaaagaatcacccttagtctggctgtgcacaactgggacaagccgccacctccatttgatgagatttcttctggatccgaagagacttttccattgtaactcaggctacattatggtgtggattgacattcatctctgctctacttactagagaaaagatgtgaggtaccgtcaggggacaaagtgggcagttgagtccatttaggagaacggtacactctcaagtgaactagcagcttgccagttcacagacaccacacttatacctgctttccccgctttctatcatggctcagagctagggctttgtggatgacctgggttcaaattctgactgaccttatgaccttcagaccttagcaatctaggtaagatactgtgactcagtttacctaagtgtgtgcatgttctctctctctctctctctctctctctctctctctctctctctctctcttctctctctctccctctctctctctctctggaagaaaggcagtccagagaatcacagccagctttgaacctttcatttcccagatggtgaagaggaggtggttgtaagtccccatctcttcgaaagcgatgctttttgaacagtatgctttatatcaacagcatgtgctgttattaacccactggtgactatgcttaatccccatcagctctcagttagttcaaaatccatgtcttgaaaaaccactctgcaaagcaattccccaactcaatatgagtcccagaaaatgttcaagtttcccccgtgtcaagtttacattcatcacctgactggaagggaggggcaccttcacctttcatgacatcgtcctttcgttggttgctggttgccttgcctttggggttgagaagagtaaatggtgtgtggccaattggcacataaaccagacaaccagccagctaaccaaacaaacccacagccaactacttacccatctctttctgactgtatactctacccactaccactccattcttccttgccttgccagccaagtggcttgagaggaccccacccgacctccaacttgccaacttccctttcagatccttttgtgatttggatcctattgctgtgataaaacactgaccaaaaaaacaacctggggggaggaaaggggttgtttggcttgcaggttacagtccatcatggtgggaaatcaagcaggaactcaagcaaggcaggaacctggaggcaggaaccgaagtagagccctcagagtgctgcttattggtttgcttttgatggcttgctcagcctgatttcttatattacccaggcccacctgcctagggctgacactgcccacagtgggctggaccttacacaatcattgatcatgaaaaggctccagacttcagtggtgctagtctcttgttaacaggtgactcttcagctgcagcccaccagaagtcactaattattaattaaaatatatcacacaaatggccctaatagagtcctttaaagactcacaaactttcctctgccaaatttcacaagccagggcttcactatctgcatcacttgccgcattcttttacaagctcctaccaaaaggtctagtaaactctaagctctcaatagcttttcctgtccaaagttccaaactccttccacaatcttgcccaaaagaatgtggtcatgactgtgttagccatacctcacagtcctggcaccaatttctgtattagttactttctgctgctatgataaaacaccatgactaaaaaaaactacttctgggatggagtttgttttggcctacggttcctgagagggagtccatcatggttgggagacaagcatggcagctgaagcaggaaattgagagctcaaatcttcaaccataagcagtaagtggtgaaagccaaaaggaggtggggtaaaacaataagccccccctgtccctgtgttgtacttccaccttctacgggttccacagcctccccaaacagcatcaccaagggtcaagtttcccaagcctattcaggccacatcagctttacagggggacttcatttcccactgtaataacccgctccaagaacaccaatatgtcccaagtttataacctcagttaaaatcttcctgtccctctctatcattaatgttgtcagtcttagtctctggtgtgtttagtgtcatgtgtcatagccactatttagcatagccattatttgtgcatcatgagtaaaaaaagttgagtttactgattatgatccagtggtcccatgatatagatgcagaaacgtatatagtgaatgtagctgtatcagtcagctagtgctgtgtaacaagcaaccccgaactcagtcacaatcacatttagcttttccatggtgtgtgtcttggttagagtagctctgttctgcactgagagtggggtgtgtttactttatgttgttgtaatggggctgaggtttgaggagacagcaacacggtggaggctgtgattcagaactgccttatgagctgaggaaaaagactccaccctgtaatgggaggcactggctctacttgagccaagaatgctgctgtataatttgatacagaaaacgcttgaagaattgacagcattcaaacaccccttgttccaagtcacaagattacatgttttaagtcttatctctggcaaaagacaaaacagcaacaaaacacaacacaacaaaaaagtctacttaagactaatggacatttggattttgattataagtgaaaatagtgagtctcagtaaaccagactctgaagaggaatctgccagctgagacacgggcagggtgggccatggcaggccttgactgtggagagacgagctggcatcaagaggtcctgaagcagtccagaattcagtataggactcagattggacctgggcctaggaatttccagccaaacaaatgataaagggcagggccttggctgatggaggatggggcacactttaagggttcatgagctctcaactccaggctaggacagccagaagagaagaggcacgtctgaaggtggcgggcccgaggaacctgggtgcagcgtgctagccgtgtctgacacacagcagccagtgcacatccttgctgacctgtgagctgtggtggaggatgtcattctgcaccaggcagaaaatgcatgggtgtagttatgccaagaactgttctgaggtgcaaacagtgccagagaggctctcatagtnnnnnnnnnnnnnnnnnnnnatggctttggagtggggcttttttctgcctcccaccagcacatacacaccacacctgccacacacacacctgccatacacacctgccacacacacacagagtaaccactcctccatccccccacagtgacactacatatacatgtaacatacacatcacatacatgcatatagcatacattccatatacattacacatgtaatatgctcacatgtcacacataccacaaacatactacatgcaagctatacacatataacacacataatatacataccctacacatatacattatacactttatatgtaacacatagtattgcgtcccactcgaccggcaagaaagacgcaacaaactggaatcttctgcggcaaaagctttattgcttacttcttcaggaagaccccaaaccgggaaaatggcgccgcttatatagtctgcagcgtgacgtttcaacacctgatatggcgtgacagctcctgattcgttgctcgcccatcaccccactattacgccccgagaatgggagtgactaggagtgagttcactctcgcacctgcgtacaaggcttgtttactagttaggcacagcggaggccagcgccatcttataatggcgattgctagcagcacggctctcctcagcgattgctggcggcacgcatgcgattgctcgcggcacggctcttcacaacatagcacacatcatatgcatatacaccgtatacacaatacacaccacatatgaacacacattgtgcagagactgcacaaataacatacccccacacactagacacatacactatgtacacatgtgaactaactgcaagttttgatggcccttggagtaggttaaatagcatctctcctaaaactcatgtcttctggaacctcctaatgcaacaatattaggaaatgggtctctgtaaatataatccagcgcagatggattagagaggctccaaccccaggactgctgtccttacaggacagacattctgatacagagtcagagatggcatggagacaggatggaggcagagagaagtctgagtgacacatgtacaagccagagaaagccaacaactggcaacttccagaaactgcaagcagaggtgaaggccgctcccagactcctcagcggcactcagcccttgctcccagactcctcagtggcactgggccctgccagctctcagttttactttcagcctccagaatggacagtcggtctttgttgctttaagttacccagggtgtgtgattacttgcatccctaagaagaatgctggtttcctcaccccaggaggcctgctgaggcaggggcttggcttgaacaccctgctccctgctccctgcagcctgcccataggccaaggggtcggtcagtcctgtggctggattctaagtctcagctttcctctctgtaaccggcatagtggatattacagggcatgatgttattaggagtggtggctcaaacctgtgatcctagcacttggctaaggcaggaggattgccttaagttttagaccattatgggctacatggtatacttcaagccagcctggtctacagagtgagatctgatctcactctaaaacaagacaacacaacagaatataaaacacgggacacaattttctcaccttttatcatttcctcttacaggtcagcattatgccggacctataaagtttgttactgttagctattattaccctatctttattacctctgacatcttcaaatccacagccataccctccactttgaagttcccttgatgttatttttctagaaaaagctgagcagattgggctggtcctgtggtgacatgcaatggttctcggggctgcacctgggacagaacaagcagcaaatgtggcaagtgtcctgtaacacctctgagggaggggatggccagagacatgacagcgttaatgggcagtctaaagaagctcatctgaggcgttggaagaggatacccttgctttgcatctgtggctgctgggatgcagatggtagcccctcatgaccaacccttgcctgccctgggattcccagccttgcatagtctcctccccttatatacaagggggagtgagtgggttcaagaaactggagcctatcacatccaagagcaggttatgaaagtttcagactttcaccttgggctcttactctctaggactgtttaatcaggggaagcagccaaaatgactagcaacccccaccaacagtgtgtaagtgatcgcagcaacagaatctctgctcaagtgggaaattttggagagaccctgattccaaactaccctgctactctgtatcagattcaggaccctcccagaactgatgggctatggatgtgtgttggcttaagtcacttaagtctgtggggaagtagtcaacaatagtttagtgatacaggtgggacgataaaggctggatggggagcggggagtaggataaaagctgtaaccgtggggaggatttcaaggtgcaaggcagagaactagaccatctgcatggacaagcaataggcagtgaggtttggtaaagtcaggctgtaggtgttgcctttaatcttgcattatccacttgccaatggatacatagttaatgactgtagcaaagagatgatcaaaaaaaaaaaaaaaacccaatgcacgatgtatgtagtagccctagatgtcctggaactcactatgtagaccaggctggtcatgaactcacataatggagatgtgcctgcctctgtcttcaaagtgctgggattaaaggctttttcgatgcctactaggttggatacaaaggaacttggagtcattttgtgcaactatgacaacgtccagtgcctccttataccaaccttggatggctggagatgcctcgctcaactggtcaaaggactttcctttaactcttttgcacaggctgcatgtttgtggcctgatttcaagtgtctgggctccactggtactgtgggtgatctgacctattgggggggaggtgataatcttgtgataatagctttctttccacagggttttaaactagagaagaaacagtgtgactttctgtagtcttatcactggagatgcctgaggttccatttattacttatgtaaagcaggagacaatagtgtcctagagagcagtgtagattccacagccagacagtctgggtttgaattttagttctgcttcttgctagctgtgtgtccttgggctacttacttcatgtctctgagactcagatgtttcctctcctaacaggacatgatgggagcacatcccactcatgggggagagcaggatatgagcacttgtctaggaagaactccaaggtgctccctacccaaagaagactcagcgtgggttctcttatcagtagaacataggaggcttggcccctgttgctttctgtggggtctcccttaagtctggagacttaagggagatattggatgacctgaggcagatatccctcctgcctgacatcatcttagggttctttaaggatttcatgaaaataaaggattagtttcagatgactaacccaccaggctggagacagagcagatccaataagccatgaacgctggcaggattgcactctgattaaaccacatcccatattttcccagtttctccagaaagcctctccactggggaggccacgaagccctttgagtggtcaggaaagagcaaaaaggagcagaagccaaagagtaagtgagacttgtcgagtggagggagaggatggacacaccaggaaagggcaggcaggggtggcagctagggtgtggaccccaagagcagggttggtatggtcacaaccccaagagggagggtctccctcagatgtgttctagtctctcttgatttcctttcgtcctggccttggagaaaggtataggtctcagtgcagagcaggacacaggtcagtataactagagatgtgcaagatagccccaatctaaaagggatgcggctggaagacatttgtcatggcttccttaagaccaaagggacccttgggtcctccatttgttgttcatagaaaaggctctttcctgtctcttctgtgtggcagacatgctttgtaagcaccgttgacttgaattctgtggctttcagagccccaccccatcccgactcccagtggcctttggatgtctctgatcttttcaaggtggcctgtgctgtgaggcctgaccaacaccgcagcgagaaacccaccatctcctgggcatttgttgttgtcccttggtactgacttggcctccaggaacctgagttggcatttgaggtatgacaagatgtcagaggacacttgagctgcctgaggccccggaaggtggaaagagggacaatgttaaatatcatgaagcctttcaggaggctggacgaggttttatctgagcatgaacaggaccttgggagagatggcctggaatcggacagtcagaaaacacttgtcaggaggctggcttctggggtgctggctgggaaggctgactcggcagcacaagggaaggaagtttgccgtgctggtattgcagagtcgagttcagggcaggaggaaatgttgaagctaccagagctactctctgtgactaacttcctcaaactcagacaaagccactctgaccttgtggcccactaaagtctctagatctctttccgtgaaagtcaggggagtcagggaaccattttccttgtacttggagaagcttggaaaatacctgctctatctgcacttcccactgttctcatgaaaacgaagcgtgtggaaatgtgtgcctgagcctcttgatacattcattaagagccccatagcttccttatttaactgagggctgctacctcatccatctgggattattagcgaagcgagagggcctttgttgagcttgacaatgtgattaataaagactctaggtgaattttggcttctcaacagcttttgatgtgctaagattccccagtgaggacaacatcatcaattacctaaacaagccactaccttcaggctttggttatctgtgaggctagcctgctaattggcagacttcgagaaatggcctctgaggccgtggtctcagccctgaccattttttggaggaaaaaggtcttttaagtggctcctcggtgatgtcacttctgatctgaggtgacagcattcttcttcacttctgcaaagctctgcatcctgtcttctgtcccttgacccctttgcttgtccaaggttctgttaccttggcattttctaagtgaggttgcataactcagtgttggaggctggagggaggtttgagttcttagacactacccttactcaagactttggctcctagaatcagccaggtgcagtcagggctgcatacaggctgttgtggatacctcgtctgactactgtctgctgatccatcagctgcccaggtgcaagaggtagcttttaaaaagctaatcataggggctggagagatggctcagcagttaagaacctgaggacttaagttcattcccagcatccacatggtggctcatagctatctgtaattcccgttgcaggatgtcccatgcactcttctgagttctgcatgcacgtggtgcacatggcctcatgcaagatcatacacgcacatacacataaaacacttaaatacaattataatgtattcatacaatgaagcatgtgtgtgcatatgtctgtgtgtattcatgtgtgtgtgcatgtgtctgtgtgtgtgcatgtgtctgtgtgtgcatgtgtctgtgtgtgcatgtggacacaagggtgaacgtttgtaggtgcacatatgcatgtgcatgtggcagtcaaaggacagataacttgtgtcatttctcattccgcaagtgatatccaacctcttgacgttgcaaaatgatgttgtcatctacaaagttcccacttgagtaccgcatggttgagttaagaaaaaaatcacagaaaaccttataatgctttaagtaacaattctgtgttgggttgtgctcaattaatagctatcatctaccaatctatcacttgtctgtcaacctatcatctgcccatctatttatgtaacatctatcatcaccggtttttctggtcgatggagtagcttagtctagataaagttagataaataaacactactttaaaaagccgtgccatccaccccaggagtctttcacgattaaaaccacttaactggcatactgacatcattgatcgctttgttctgcttttacactagaaacaaagtactcacaccgtggctcctctatttggctgggtcttcaattctcactgcacagaaaggcggtgcagtgccccaggatcctttaatggctatatgtgtaatgtcagagagctgggaccccagacaagatggctgcctcaggcctcccttgccagtccctcctaagccacccagcccaccccaacctgccccataccttctgtcctagtgggttttggctgaatcttttcctgtggggctggggtttaacgggggtttaatggttgctggtcaggctctgttcccaaagtttttctgacagtatcttgtggctcctgcatcccatccctcctcaggcacctctatgttgtgtctctaggatatggtgtaatgctcacatctcttggtttatgatgccctagagagagagcctccttataggaaccctgagttttgtttcagtttgtttccaaaatagcttttgtaggaaacagcttagcactattaaccatactttctgattcataattacaagttagtagtcagcagaataactgaaacagaaatgatagatttcaatcgggatgcaccctctgataggggccacttcttcccaatgcaaatgcttaactcacttttgctctctgctgttgaacttgtctaggctgtgagtgcctgggctcaggatgtggtagtgatggtggtctctatggtggcctggcacccagcatctgggtacacagagagccacagagggagcacttaccagcctggcagctctttccattcctaatgtactgggcgtataagccctgagggtcacacaggccttccttcctgcatttcttccctctctaaggacaaaccatgaccacaacttggactaaaaccaaggttcagtgcagagtagctcagctctttggggaagtgacactaggacaggacacagtggctcatcctgcccatgctaccacatgagctttgagaaaggactgaggtctcattagccagtctctggtcatcaggtcaaaccatcagccagggcatgggcagctccataaatagaccacattttacactgtgctttgagagtcctgtcttctcaaaacggtggctgtggaccatagctgtgaggtgagattctaatgcatgcctcttaagtctgtcactgtatggaacttatcatcctttggttttgcttatggaagcagtcctggctttcacttaaggaacatcctaacaacataaatctttctttggcaataaaataaaataaaataaaaggcacaaaaagggaattgggaggtgaaggtactggtgagatagggatatggcaaaatttgctcactctctctctctctctctctctctctctctctcacacacacacacacacacacacacacacgcgcgcgcgcatttatttggaagagtaagatgactaaacttgtgggtgagaattgattctattggctttcctggcctgaagacttaggattaagctggaaaactaagtcacctctctggactcgataccattagctggtgacttctcttcgaattatgattgtttctggaaagctgttatctacttggctgtgttagtggtcaccaaagtcggtttttttttttttttttttttgagacagggtttctctgtgtagctgtggctgtcctggaactggatctgtagatcaggctggcctcgaactcatagagatccgcctgcctctgcctcctgagtgttgggattaaaggtgtgtgccaccgctgtgggaaaatgccacctttcccccaattttcaacaatagggggagcttcaaatatggcatcagaagttattcttcacatgttgtgaagatgatgccatgtgagttcattctgaactcatgaatgtgaatatatttgatgttttgagtcactgcaattattactgaattgctcaaattgctcatctttggcttagttatgccttgttggtctaaagtctaggtatcagcggagctggcagctcttggaggctgggcagagggttggggggaggctttggtccttgctgagctgggggtcagcactcctgtcttggatgccaatcaccattttgcctgaaccaaatgggatgggggtgtctaatttccagttagaagggggactcatagttatgacaattgttcaacctaccaggtctctgaggtgtctggcttgtgccatgggtctgcatgttcatggactgcagacacaagggctggggagcagttgttttagagggaaatggaaattgcttagttattttatttaacatttaagtattgttgctttagttacccctgcccctatcttaccactatcctatagttacccttatcttctgcccagctataggtgataggcatttcaccaatcagggataacttggggggcaaggttatatagcttcagtctatgtgaagagtctctcattcctgggggcaaccaggccttgggggccagtattcaacattacggtacatagcaacagaccaaatctcaagagagactctttccttctcagctaatctctctagaattcctcactagcacaccacagctgtgcctcaccaatgtttgggtatttcgtaatctaatcaagttgaccatataaatagttacatttgataattgtatcgcaaacatttctgttgctatgataagtcaccaagaccaaaagcaactgagagaaggaaggatttgtttgggcttctactcctcagggaataagagtccatcatgccttggaggcatggctacaagttcaggcatggtggcaggaactggagactgagagctcatactacaaccacagcatggagcagcagacagaatgaactagaagtgaccttaatctcaaaacctactcctagtgacatacttcctccagcaagtcttcatcacccaaagtcccctaaacagcaccactaactggtgaccaagtgttgaaatgtcaggactatgggggacatttctcaattcaaacaactacgatagttactgtttaagttgctgagtagacatttaaaatgtgcatttatgttgggagtcggataaagagggtgggagctcaacggaaagagcagagctagagtcagaaaggcaggggtgttgatttgtcaatggtcttaaccgtggcaggccaacagaaggaaaggggccagcagcccgtaaggagagcgggtgacatcgtggaaataaagagtgtccccaaagaagtgcttagctacaagcaattaccattgagaatttaataatgagactatcaggggatctcggggttgagaaagataaactcgtcagcgaccttgacaagagcagtcctctcccatcctgtaaatgtagcagccacgctggaacaggccgagacagtattgaaggggcagaggggcacagtacttctccattacaagaaactctgctgacaggagggaagaaaagcgaagctgtgagtggaatcctgggcatttgctcccaggctttaagatggggaacacaaggacttatttgcattgtagcaggagtggtccagagggaaagagccacatctgaaaggaaggagagtgaggataacaagctgcgtaagacacacagtgagggaacccgcaggccagactggcttctgactggcttctgccattctaaccctcaatctattgaatgtaaacccatcaagcatcctccaaggcctggggacagagcccagtttgcccagcacacacaaagcttgatccttggggctgcacaatcagatgtggtggtggcacacacctgcactcccagccatcaggaggtggagaccagaggatgcaaagttgtaagtctttctcagctaaataacaagtttgaggccaggctgggctatgtgagatcttgtctcagacgacaacaacttcacccccacccccctctccgtttaccctaagcgacttctttgtctaaacaatgggcatactcctacataaaatccatcaggagagtgccttggttttgagggaaatgaaagaccgggcagcttgtaacctttcaaatttagccttattgtaaaaacaatgcatatgattcgggttattttgagaagggacgccctaagcgtcaccagcagcactgtgagatttgtgttcggtagcgtgtgatgattgccttagatgtgaaaattaaaccaaaggatttaatgtggggcaatatgtatgtctactgtcattttctgacttaagtatccttactataaacaatgacagatgtccggaatggtagtggtgggcatatttccatgaatccctgtcaaaggagagctgttctaaatatcacaacacagtgattgcacaacggctgcgtggtacctgctcctcacagcaccatcccaggccacctggacttttgttggatggcacagaacttaatgacacaaaaagacagatttctttcacaatgacaatgttgaaaatgacaagaagaaaaaagaaatttaaaatattttcattgactgcctggaatgtctctgtgagtagttcacaattcccacagccatgctatcagaggactgactgaaacagtctgggtctagaagccggaagtctgaaatcaaggtgttggcaggctccctctgaaccctgtagaatgaacccttccttgtctttccttctattggaagtttcctgacgacctttgacctcccttggctagctgcagcatcactctggtctctgccctcacagtcatctggcttcctttctgggtgtctgtcttcacatggccattttgtggttgtttgaatgtggaacgtccctcatcggctcgtgtgcttgaccaaccattgcccactggaggtgttgtctgttctggaagtttctggaaccttaggaggcggagccttgccggaggaagtgagttatgggggcgggccttgagatttcaaagccctgacactcctcctgctcacactctgcttcctcctcacaaaggattggatcccgttgaacttcgaggctagcgtagccattcctcctcaagttgcttcttgtcacagcggtgagggagatgaacaacatgtacatcttctgacaaagatcccagttcttttggataggaggtcccatctacttcagtatgaccttatcagaacgaaagacattcacaccaaccctatttccagacagagtcaacttgtcttttggaacttatcaccctatccctcaaggaatccacagacttggatatccgaggagatatttggaggtcagcctatgcacccaggaaccagagcacatgagaacaggttacagggaaggaactgagatgggcacacattgcgcctgtgttgtcattctgccccacccccatccccctccgctggtagtggtaatctcctactgcagatctgggctcaggggctctggctgatgaaggccttacctggttacctcctggctgaagcctcccatgttctgcaccagagtccaggctgtaaggggaagttgtgattgtgcacagtgcacactctgctggtgccatatgcttgcaaatgcctgaattttgtgcagagacacacaggcagtgttctaagtgcagttacataatgagggcacggacttgcatagtaattagcatgtgtaattaggtacagacttcttgtcctttaattagacaatcaagacatctaattactaaattaagatgtaattacgtggcccaagatcttcatatttcttcctacccatcagagattatatttagaaaataatttgcaaaaactgatggaaaaaaagtgaagataatctccgatttgagagtgttaaaggaagctttcagcagctctgaatctgctttgatctctccctttgaggataaagggagccatttaaaataccatcaccttcttgaaaggctaccttttccacacctgacctttgtcacacatgctaatgagcaggaatgtgggtgtggctaatctacataattcacaccaggctctagtgtatgctttttttccttattaaaaagtagatgcaatttattatagataattttaaaataaaaatttaaatatcttacaagtgcatcattgcactaagaacagagataaatgatctaacatttttgctcattatgtacaatatcagacttttgtattcacatgtgtttactttttattagatattttctttatttacatttcaaatattatcccctttcctggtttcccctctgaaaaccccctgtccccccgcctccccgctcaccaatccatccacttctgcttcctggccctgacatttcccctacattggggcatagaaccttcacagtaccaatagactctcctcccattgatgactgactaggccatcctctgctacatatgcagctagagccacgagtccctctgtgtgttttctttgattggtggtttagtcccaagggagttctgggggtactggttagttcatattattgtttctcctaggggctgcaaactccttcagctccttgggtactttctctagctccttcattggggaccctgtgcttcgtccagtggatgactgtgagcatccacttctgtatttgtcaggcactggcagagcctctcaggagacagccatatcaggttcctatcagcaagctcttgttggtatccacagtagtgtctgggtttggtggttgtatatgggatggatccccaggtggggcagtctctggatgctacacttcatgattccactcaaaggtggacttgatggtgatagtctgggaagtcattcaaaccagcagtactttcagatggtgggaggacttgctgtttcccattctgccttgcttggttctccctcatggctattttagccataggcacattgctgtgtctatgtaaactgtacttaggtggtgtctccatcgacacagatactggagggtatgctgaactgttctcaggtcagagaataaaaccaacactccatctttctccctgcagagtgttttgagcgttagcattcatcaatcaccagaccggagagctattttgctatttttccttgttcctaaattgggatttggctgatctctgcatgatgctaaacacccagtttgactcattaatttttctgaaccaactgaacttttgacctaattgtctggctgggtggggatggggccagatggcaggtttgcccaagccaactctgactcaaactatgtcacctctctgttcccacaaactgaaaaacccataatcccagtgtttggacagccttaccgagaagtagtgcagaccctgttggaccacatttcctggttcgggatgcagagaatctacctcccttatgggtttaggcaagaaacatagcctgacaaggactctaagtggagggtaaggcggtctccttgccatgaggtgcctccatccccactttgttttctcaataaggccatggccatggaatgtgatgagcatcatgttataaatatgaagagggggttggccttaacctaaaaaaaatataccagtgtggtggtttgtatatgcttggcccaggaagtgtggccttgtggaagtaggtgtgaccttgttggaggaggtgtgtcattgtagctgtggacataagaccctcatcctagctgtctggaagtcagtcttctcctaggagcctttcagatgaagatgtagaactctcagctccccctgcactatgcctgcctggatgctgccatactcccaccttgatgataatggactgaacctctgaacctgtaagccagccccaattaaatgttttccttctaagagttgccttggtcatggtgtactgttcacatcagtaaacctaactaagannnnnnnnnnnnnnnnnnnntttttgctgggtcttctgattatggctcgtgaagtatttggaagctgaggcactgaggtgcatgtgtagagatgatcgagttctagtggaggaggctgttagacttgctttttctgaggcatctcagacttcaaaggcctcagagatcccatcggcccctgtggaggtgcccctgagttcttccccttctcttgtcttgctagttccctgccgctggaaacttctctcagcctcgctaagagaacttaatagttctccttcataatagacccaattacaagactaccagcatcagtttcttggttttaaacatttgcttctctgtctacccaggtactccatgtcagctttctcaagactggagaagttgggcatcaggcaccccaagccttctccttttgttggaaacttgatgtttttccgccaggtaagacatgggctttctggatgttcacaagatttccacttttgtttatgttttgggtgtcagggtgatcttcacatgaagaatccatgtaacagaagaactcttctccattggaatggttttttttcttccttcttccctctttctctccctctcgccctcccttttgaggaagggctgccaaggctgactttatactttctatgtgatgactctgaactcttggtcctcttacctccacctcctgagtgctgggattacaggggtagagcaccacacccagcttatgcagtgctggggattgaacctagggctttgtgcatgctaggcaagcactctaccatccaagctacatatccagcttatgttatgatgatgattcatctcttatgactcattactatgtattcattcattcattcattcattcattcattcatccacccaccccaaacccaatttattgagtatttaaatacactctttagaatgcaaaagtagaagttacttaccctctcaaggtcactgtgcaacaatgatatataccaccagttgggttgtgtcacgagctagaatgggaagtgcagatagcaactttgatcttgcttcagagagaaccattgttggggggagtttctggagaaggggatcctgcagtagctgaagacaaaggcagacacaccagggagagggcaccatacacaagagggcacccatgtgggtatggtggcactggtcagcaggcagccttcagggaccaagagctaacaacaaagggatgcaggagaacaaagctgtgtgtgactcatgggctagcatgcttccagatttgaaggcccaaccaggaaccaatctagacaaccattgttgagtagaggatcgatcctgaaaggcaggattgcaagagtcaagagctgagaaatcggggctgcagaatccatgctgaggtggacatcaaggctgagggggtgagcgcttcgtgcagggaggcaatgacagtcctgagaaaagagcaacagtggctaagtaaggactccagtgacactgagactcagaggactcagggaattgagggaggcagcagccaaaggttggagcaaagacaatggccttggcgtgacaggaggaagtggctggggagggaagctggttcagggagaagatattttattttaagcctctggtcttcagctctccagagtgacatggcagtggagatgaccaggcgtttgtagatagggacgcagtatctgcctttgaaggttgttttttactgccattggtttttctctgaagcctgattaacttgtggggaaactgcacccagaccaacagcaggcgccaccaccagatcctgcctgtgaatcgccatacaagggcaggaagggctaatttgggcatacagatgagacagtaactctgggaggatgctggaacttcccccaccccatggcctctgctccactccctaggcagagaatgacccacatctgactttttgcctgacactttccagttttctttccgttttttctctgggttcaccatttgttgccagcatttctattttcccagcttttcaaacaccctcttctctcatctctccctctagggtgccccgttcacaacttttaagcccacaatcaccccaacagacctcttataccctcctgaaacaagtgtaaagagatttaaaagtgtcaaaatagaacaaacaaatcatataggaaattggaggaaaataaattccaaacattgcagggtagggggggatgtgatcagtcatagccagttaagtaagattaatttgctaataacatttggaggcagacaaaataactgtcatgtaaggagaactccggatggctgactcaaagaatgtctacatcagttcctctcagcttatcgtccctgtatatataaattctgtcgtgctttttttagaacacagctaagtttgctttacagatgttgcaacaccatgcctctttctaagagggaggtcaagtcattagaagggtttattaaaaacttagacgcagtaatcttttgggcagccacctgaggtacttttttttttaaattaaaatataattacatcattttctgcctttcttccatatcttccgcatacctctcctgttccctctcaagatcatgacctcttctttagtttataaataagaatgtatagatacaacttgcttagtctgcttagtattacttatgagtgtgtgtcttcaggctgaccacttagtcctggataaccaatcaggggttaatgtctagggaggactatttctcctgtctctgtattccttagttgtatgtagctctttgtttatgggtggggccctgaatttacagtctattgtgttcatctgggctttccttgctacagcttaggcttgtattgtgaagtacggagttactgggaacgaatggggcatggttcccttcagaacacgtgcttcctttaaccatcagctctctgaccctccacccctatgacttaaatctagcattctccacccaacccctcccaacacattcatgtttatatatacctacacatatgtgtgtgtccttcccaccacatttcacgtatcagttctcagtgcttgcccacacgatatcccatcatacctgcttatgtcctctgtctacatccacagctccatctccacagcacaaggggtctagcattttctcacctccacccatttggcctcatgcacatcttctggcaccctagagtttctgcctatgagaagtcctgctgagagccttacgtttgaacctttaactcagatcccgagactttaggaggtgtgataatttgggtagatacggaagtttacacatatgtgggtcatgaaaggagacttggcaaatacaaaccctacccgaggggaacactgtggatgtgaaagcaaatagttttcagatgtgtgagcagcaattatacgcggataacttaagtgcccatggtctcttctgtccattaaatagagctgctgagagttttactcagcaatattttaaaaagccatttctttactcaatattctacagcacttcaatgcaatatagcagtgattcttcttttattgtttatgtaattgtgttcttgctgttctagcctttttttttttttctgagtaagttggaatcattgaaattttactcagtcttattcttaccatggttctgtgtgtgtgttttttttttttttcctccagggtttttgggagagccaattggaactccgagagcgatacgggcctctgtgtgggtaagagaaagactcacattctttgatacatgctttgacttctcatgttaaactaatgtggaagttatgatggcaataggactatcatgcgctgtactattgtgatttgatttttttttgaagatgccttcaaaggacaagtaccctacagttcacacatacagagaggtggctctcgtttggacctgtcatgttccatcccttgggtaaggtgtgcctgctaacagtaatattattgtcagctaccctggcacacttctgacactggaaataagttctgtgaataatgacatatggcaatagtgagactaatcctgtccaggatacactggggcacatggtcacccttgttcgtcacccttggattatttttaatgctgtcttttttaatgatgtatttatttttaatttatgtgcatgtgtgtgagccttatgagtgtatgtgtaccacatgcatgcaggagctgactgaggccagaagagcgcattggctcctctagaactggagttacaggtggttataagccaaatgtgggtgctgaggactacgtccaggtcctctgcaagaacagcaaatgctctcaggtgctgagccatctctccagcccctctttagtgctttttatgatctagaatgttagtgctggatctttgcttaggtgattttctatattcaaatttggaatgacttaatcttcttcctcttctgcatgggtctgtgtttatgaggttcccatactctcagtgcattccgatgaggctcctcctcagccactgggtgacctttaataacttctggatctccaggctggcagtcatttttctaggtgcgctaaatttctgtcgtactgtttgcccgttctgatgagttccgttgtttggaaacctttgtgttccgaaggtctcaacctgtattctctcggtgctgctttggaaaggtattggcttgagatatgcatggacctggctctacccaggaaaacaagtggtctatctactttctactgtcttatatgtccttgaaaaattaaaaagttaagctgctatcgatgttctatgtatatgtctgttcctgctgtgtgtaacacactcccccgatccccaaactcagtgacagagacgacttatcattcagcatgtgtctgagagttggctaaggccggctggctgggagggttttctgggcttccagtggcattgggaggggctcctctgtgcagctctgtctctcatgcttcctagcctttgtggaagatcagcagcattaaggcagggtcttctcatgaagaggcagagatctaagagagcaaggaatgctgctgagcatgctcactggcacccttcctgtcaagccaaaactcagagctggaagagggagattgctgtggcctctgtgaggcagcagagttccttggtcaagcccagtgttggtcataccaagagggtcacccatggggtggtgggcagttgacaattgtctttaaataataagctccccctccctttctgtgatctctgacttcactcagaatttcacttttcacaggtagcttcccgctggaagcatgagactcactggagcatcgaggggctgacttgtttgccccagtgctgtcttgctacccttcaaacctcattctgcaatggcctgcccctgactgtggtgaccacctatgtttctaggatgcagagctggttcaaagggctgctgtctccaacagagttaggcaaggttctcccatgttctaaattctagaaattactttcttggagaattctttttttttcccttgtatacagttttagtgtggaagctttgagtaccttagagttatccttaaatgtcagatgaagaatataaaggacatgaacacatacacacaaagacacacacacacagaggagagagagagagagagagagagagagagaattggtttccttgacaacaggctatccactcaacttttctttccaactttaactaagttcacacaatttatccttttcatttccagaaaacttaaatcacagagaatgatttcaaatgaggttgtagagatcaaaattgcagtatcatctctatcctttgttcccttctctggtgaaaaggggggcaggaatgatggtataatttcttcacacaaagccatcaaccttttctcctgtagaaagaatgatgggtcataagacgcttcctgctgtgtctatggtctctcccggtctccatcactgtgcgggtgggtagaaatggcatctatctaagctcctatctcaccttaactttggcgtaatggtctctctgattcagagtgtcaaagagggccatggtccatgaacaacaaaggcccccacccttccccccaggaaacaattttgtttaaattacgttgattttcaggctgctttcatgactaggaaataggctatcatgattttcttcaaacttgaaaaatcaaataggtttgactgctcatgggacaagggaaactccaccccatggatgcctagcagagcagcactttgccgtactggaacagcacagcccgcttgtggagaggagtgtgcgcagcgaggatctctcgactgctctcaaagttcagaagatgactgtgattgggtgttaggacccttacctgcttgtagcttggtcagatcagagtttgggactcctaattggaagaggctcctaagccctttccccttcctacttctgtttctgggaaagcattgttggtgaaggattctgcctagagggacagagagtgttatcatttattctcactgctgtagccatcacattcactatcactatcacattcactaccacattcactacccctctcacattcacaatcactctcacattcactttcacatttaccatcacattcactattatagtcactctcactattacattcattatcactgttatattcactatcactatcacattcactatcactgatatcaagtgtctaataatgtatgtaggtggctttgccaggtctgtgtaaactgcatccttccttgaatctgagtataaagcaggtagtccagtgtccacactgcttagcttctaccactgatgctaggttgattctgacctgcccagcagtaccattggccacaacagatgaagatgacaggggcctgtggttttggataaccttaaagcaattgataattacccataatttctttcagtctggggatcagctccaagctatgttatcatattccattctaatatccttaaggctgatatcagcatcatcactgatggttaaatataagcaggatagaaactgtgccccatcggtttgtgacagactctaaaatgcagtaaatcaggaccctttagcatgctgcgactattacttacagatacacagggtctccgttcagcctgttagcaacaaccgcaggcctgcatcaggatccactttcccttgccgcatctatcttccagccactcactccacagccctgcattttaacctcgctttcactacctcttgtctccacgtcactttaattttgatccccagtacaaacattgctcccccttgttggaacgtgaggcacctggcacctatgtacctatgtccctctgtgaagccagctttgtggcacaacctcctgcgttcccattaagacattaaagttgtaaataagtaaacatgaccaccacataattcataagcactaagggtgtgtgaatacatgcttagcctgcactgacttcataccctgagccatgaaggcagcctttgtctcctgctcttcctcgtgtggataatgtgtgatgggtaaggcttgctctcccttcctgctgtgttcattaatggtcttcggggcaacgttctccttcaatacactccttattaaatgctacattattttttaaaggctttaattgtatggaaatacactgactttaaaaataagttctcagttgatcaatgccttttgctttcacaaacaacactgcagtgaatattctcaaatatacaatattactctcttgcctgagtatgtccgtagaataaatccctaggaaaggaattttctcctctatacattttttattttgatattactaaattgctctctctagggcatatatcaacttatgttcccacaaatagaacatgagaaaatttgatttttttcacatatttgctatcaaaataagtggtcagaaatgtattaccatttgatggcatattactgctactttaattagtatttatttatcttaaacatctttgaacacttttatgcttttaaaattcactgtgttttgttttctggagaatcttttgccattttgtgctgagttcatattttcctaatttattcataagaaatctttacatattaaagtaagtagccctttatatttaatatatgtacaaggtgttgctcccagagtggtgatattgggaggttgtggaatctttagtaggtgaggcctgctgggaaacccttgaagtcattctgggcccaccctcacaggggactgtgggattctagcccttccctcttctctttcttcctggccacaaatgaacagttcactttgccatgcgctttccctgctcctattgggcacctcactagacatctgtgagcagtgagttacctggtcatagattggaactctaaagccgtgagcaagagaagcctttctcttcgtaagttaattacctcgggtgctttgttaccatgtcagaaagctgactcataggagatacacacttaattttttccagatggttctactcagaaattcacccttttccaaatggcttaaagtatcacattttcacacatcattactcaggaatttttatatcataagtacttctgactcctctgttctattgaactatctactggtctggattccttactgggtactcggatttgaatggtttgtgtgaaactccttatatctagcagcagctgatgttccaagagtgcctttgcaacttgtgtttctttctttgtgtatgagaacctgaagcaatcaatctctaggaaactatgagtccttgtgctggaaaacaaaaatgtcaaagtgctgagcaaatatgccttccaggacgagggactgacagggagcttcacaggtcacaccacgggacgggcaggtgtcgcctacgcttctaatgtggagggttagcaccatgagttaattagttagcatgagtgatctgacagcaccttgtcaggaggcagggagatagtggagagctttggaattcgtatgggagacagtgtggcatttgtggtggcgctaataaggttgctttcagcttggataccacggtgctgtttcccaggagtatttatgctttgaaagttactgacgtgtagacttctgaaaaaagagcccttaagcactgtgtccatttactaaggtgaaggccgggagtgccagagagagaaaggttagctctatgtagtcaaagggcggtatcacccacatgagggagagttcccggaactctgccatggaacaagaacattggatattgaagggattggaagggtgtgacctgctagactgtgctgatgtggatgatggttttcaaacaaacagatacacacacacacacacacacacacacagacacatacacacacagagacacatacacaggcacactcatacacaaatacacagacacacatggtgcaagacatccaaatacattggatttgaaaacatgagtctgtatggggtgtgaggtaagtggagtctatggctcatagagatgtaagtctttacacagcagtctagctgctggggcccagagaccagcctcactgttagactatcctgagctctgctgaattgtgctgaagagcaggccaactgagcttggaacaaagagagcgagacctggtggccttgaggccatagtcatggagtgttgttttataaagtacactttaatattctcatgggtcacaaatgctaggcctggtcacaatgtttaagttcctggaaatttataactgttattgcatacatgctggctatttttatgttaacttaacacaagctagtgttacccaagaagagggagccacaactgagacaatgcctataagactggcctgtaggcaaacctatggagtattgtctgaactaatgattggtgtgggaggacccatcccacagggagcggtatcacggctgggcagctggtccttgggtgtatataaaacacatcaagctagccatatcgaacaagccagtaagtagcactcctctatggcctctgcatcagctcctggctccagactcctccctgtttgagttcctgccctgcctcccctctgtgatggactctgatctggaagtataagctgaaataaaccttttcctgctcaggttgccttgtgtttcatcctatcactagaaatcctaattaagacagaatgttaagggaacattatttatcaagggcctaccctgacaacaggcagatgtaggaaacggtagagaacaggagagtagtggctaacaagacaaccgtctcccagccaagtgcagggcttgataagtagacaattatcctcaggtacatttgttagagccatgctttcgtgacttctgaactgattccccgcttaccctctagggtcatagcctctggacacccctggtggggcatctccccaaacttccattcttcttatggggcagagcatcttgtctcctggtctccatccacgggtgtctctggagctggcttagatccctgtgtttccgactctctcaccacatgtatctcctgccacgtgttactcccctgtcctcttcctgtaacaaagtagaagtaagtgatggatgctgcagatatttttttagtataaatatttggttagcatacaaaataatgaattttattatgacattttcatgtaggtgtataattgtaccttgtacatacttgactctcaccctcctacccacttccccctcttctcagtatttctcttcttcccttcatagttctctctctccctctctctgtctctctctgtctctctgttgctctctgtctctttgtcacgcacacacacatccctagatgctgcagatatgtgtgatacatctgcctccctcccacagcaactaccctgtcttgttccttttctctcatcatagccctcccaatatttaaatttaagtctaaattcaataaatgagaggtttgaaatacttgtctttctgagtctggcctattttgcttaacatgatgatctccagctctatcagattcatagcatcattatggcttagcaaactccagtgtgtgtgtgtgtgtgtgtgtgtgtgtgtgtgtgtgtgtgtatgagagagagagagagagagagagagagagagagagagtgagtatatatgtgtgtgtgtgtaacattacattttatttatccgttcagctcttgctgggcatctatgctggttccatgtagcaatagccataaaacatgatgtgtttttttgacaactactgtattttgtgactcatactcaaaaggaacagaagtgtatcgattcagcctccgaagcgctcaacagaatgtggcagaagaggagggtgaggaaaatctcccgttccactctctctagccgtcactggttagcttaatggattatggccaaccattcacttcccctctgtttgcttagaggtaaatgggagatttgaactggatcagtgaccttgacactctgtttaatgatgaacctcagtaaacagatgattgaccacactgtgatctaggactgtgcatgggcgcacaagagctcacacaaagagagagctcccactcacacacgcaggaaacggaagttttgtaaaacgactgccttattctctccaagagtcactgagactaggtctggagaaggaaggcaaatgcaagctgctcaggtctcagtaaacaactttgtaatcactgtactagtctgcttaaggctgctgtgatcaataccagaatggaagcaacttggggagcaaagggtttatttctgtttatagtttccagtacgtcgtaaatggaagtcagagcaggaactcaaggcaggaacacggagccagactatacaggaacgctgcttactgccttgctcaaactgcattctggtactacccagaacctcttgcccagcagtggctccgccatagtggactccaccctctcacatcagtgttaagaaaatgttccacagatattacctactggcactctgatggaggcaatcccacaactaagtttccctcttagttgactctagctaagttgagaaaatttaaccagcataaccactagtgtgtcaaaagcaaagaccaagtgctatctgatagtctcttccaggtagtgggaactatgcaacctcccgcaggtgatgacccatctcttcttagtctatgttagaagaaacatcagagagagagagagagagagcgagagagagagagagagagagagagagagagagagagagagagagagagagagcttagataaagtcagcaagagtccactgtggatagctgcagcagatcccagtggcagagctggacttctggagacagggctcacacacctggctccatgcccagtgttagcacctcctgcctgagagcatcattcttcttcatcttcaaaagcccacattcagctattactgaaattactttcagccctacctgaatctagctaagacactcacagaaaataatgtattaattggcaatttacgacatctaagctattttgcgttagatagaggtatctaaggaatttgtgtggctttcctgcctcagagtgtagctaaaatcccaaggaaacggggcagaaaagagagtgacctagaaactgtccccctttcggtggggggtggattagggacagagagcagatggggctgtggataatgaaatcactccagctgatggggagtgtgcagggttccacgtgtgcgcgcccttttgacatgacagtatgtcgaatgtgcccagttttgttcctagttgtcataggacacatgcagcctgcgggctacaggctggactcacgtgaagggtgagaaatggcagctccctgttttagcaagcactggccaaggtggaatgggcaggagaaggctgcccctagagagggaggtcacctgatagtagtcacgtgaccagccaagcagctgccatagaagtctttcttggacattaggactcaagtgagaggcctctgggtcctgaaaagggagctggtgggaacataagataggctctgagcccagggatgagtcacacgtgcagcctcagttctgagagccagagcatagcattgcccaaactgagaatccagctctgttcctagtacctcctgtgaggaaaatgcccgtcctgtctgcagcacacccagaccagggaaactgctctcctaatgcgatcctgggaaggtgtagcttccggtccatggggggtgggaggggctaaggtaaggatggagcaccttggagggatgaggagcaccacagagccaggctgacagctacagatcttcccatttgtcttccttgatgtctgtagccggatctactgcagagaagcgcatacgaggctcaagtgggagggagggagttcctccgcggtgacagtcagaggtagcatcaataactcctttatccccacatgacaacctgcacagatgtattcccaaacaaaagactggctcacattagagttttgtaaaaagctctgtctctacctaatcagttcaaataaaaaaattccacatttaattgaattgtacctgcaacaaatccaagttgttcaacccaaaatgcataatagagttacataacactgtcatgaatcactgtgacatttgtcaaggcagactctcttctggaaatacgtcctggtaacacagagcttatgcaaatgtttcctgtcaagaaccccagcgcacagtctcaagaactgcacatacttaaccaattccagtggctttttaaccttaattagttgagaagttaaacagcatttatattctgtccaaaaagatggacagaccatctttgctttcatgatttaaaaaaaaaatcatttgtaaattcaaataagcaataaacagccaatcatatagaacttaaagtctctttctcatcaaaaatcggtgagccaagaatccccttcaacttctcaaaaactcttgaacaacccagacatgttagcatatgacttgtaattctagccctcaagaggtggaggcagggaaatcacgagttcaaggcccatctaggctgcagatatacagattcagttctgagtcagtagcatcccttggccctggagtactttttatgacaagtctcaaagcacaaaaccagcaaaacaaaataaaacccttaaagacaagggtgatgaaggaggggggagggagaggaggaggaggggaccattgaatgatttaaatatagtccaaaaccttattgttcactggagaaaatgaactgtggaatctaaatgtctaaaaccaaacattggcctaaatgctcaaacacacaaggtcacatgccatccatcagacgtgagtgaaattctactaaattctgaatgattggagttcttcattaaaatggactgagttctcttgtttttcctctaggacccttaaatcttggagagtttgagttgtttaccatgcattccaattattcctgatcagtcttatgtgtaacatttccacagctatgcgcacaaagcaattccctggcaaggcaccaccaagttttatgatgcttccatgcctagggcagataatagaaacttaactactaaaataacttccttgattattcctggcgtctcaaggccccattcctaacaacatctcctctatcttgtcctccaactgcaaggattttgtaacccacaagtgtgggtttttttcatcctgggatcagttgtcagttgatgggactatctataaaggtggctctctggcattctccagaccccacattaaccactagggaggtgctattagttggtgatcctatttttgccttttctaaagaagaacctaataactttttgctctgaaccaatggctggtgggcagcctgccattgcatgcaagctggatgtgggcattgtggtctttccgggctgtaacatctgtcagcacctctaggtgccacccagttgcaagggaattagacagtttgatactgagtaaaaactgcctttcttaacaagatggtggagacaagggtctcctgccctccccctcagcattttgctttggtaatacaatgcctggtgcatatgagccaccaaagaggtagctatgagtgaatctacttttctttaaaggttctaactctccaagttcccatctctgccttactgtcagtccacagctatgtccaatggtcaatatcactctcatattcttccccaggcaaaaagatgctcccttcccttaaatctttgcattctctgctagagttggtttccccaaatcactgaaggagataatagcctttagtctggagcccaataagatgtttcatctcctcctcagcatcctgaatcttgcccttctccaaccctgttgatgactgccaaggctttggtgcccatgaagccataaggaacgttcacagaacaatggtttgatctaatttggaagagggtgaatttccttgtacctacaatctaccgggaaggatgcctgttggattgatggattaatggctcctgcttctcagacaaaggcagatactttaatagcatgaaggctgtatacctaaagggcatttcttattgtgataaaatatacacgagaaaatttaccatcttggccatttctcattgtaccactcagtgctgctaaacacgttcacggagctatactgtcaccacggtcattcatgctcacaggtgctttcatctggcaaacagaaatgtcatccacagcaaacacagtcctctctgtgcccctctcctgccccgtctctgtgacagaactgcacagcacttgttcattcaggaagatgtcctcagggctcatgtaccttgccccatgtgtcagaattttcttcctcttcaaggaaaagaaaactttgtacactgggtatatcccccatgctgtgttgtttgctgttggtggacactgccgagcttctaccatgtggctccagtaaacaacaaagccatatctgtggacgtgcaagtataaacccaagaccctgcttctcagttcaatgatgcagccatgatcacccgcatgcaaatgcttcttcaagtccctactttccatttgtagagcattcgtcctagaaggagaagtacagcatcagatagcaattctgcttttattgggggtgggggctggggagctctcggcgctgtttcctatagtagcccccatcattttgccttttggaagatagtctgtagctgtgtgtagccatccctttccatcatgccgaggtggtaactgttgttgtcaaaccttgagaatgaactccagaggaaaaaaaatatactttcttccttggagaaactcctggaactcaactggccagtgccaaccctgcatttctgattggtatgtaggacgcactgactcccattcccttccaacgttctgctggctgtaaaccaaccagctagcatttgacaaaacaaagacaaaaaggaagccagccttattatcaattgatgtttgcgcgcggtcccgtggctcattttagtaaccctccggcagtctccaccctgagctgcttctcctcttacgtcctctctgctgagtcctttacaacctatgtgtcttccattctgtcttcaccccttgaagtttcctctttcccaggtgttcactgtggcctttgggtctctcttctggttcttgtttgtgtgctatgtacaacatctctccacagagctgacccttcattctcaatctgtcaagaccaggtttggtagctcgctgatacagtctctgagctcctccataggtgcctattctagctttgagaccatttgctgaagggggcaagctgatgttccctttgtgttctaaagtccctgcaaaaacatagtcactgagagaaagtgactagtccacatgtcttcaaatgcaacggggcccacagagaagtatgtacccaggcacacaagctttggaaggagcatagaggttttggctaggacagaacagagaagagcaggcgataaggttatgctggggaaacagtgatttggatcatcagaaatggggaagaaaacagacagaaaatgttacaggagaaacgtcctataggaaaaacaacagcattgagggagattttgggccgtaaaaatgaaggcgaaccaacctgagtcactgatactggctaggagttccgtggtggtgaatactgattgtttctaggcatgtcaaatgaggcggtttctagaatgggataattgaggcagggagatttaatccaccctaaatacgggtgaaatcacccccatggcttgggatcctggagtaaataagcaaaaagccagccgagcaccagcatttatcagtgcttgcttcctgatggtgggtgcagcaatgcgagcgtctgcctcaagcttctgcttccattcctttcctgctaggctggcctgtagatgactcaaactgagagccagagcaaaccttccttccttaagtcattcttcgtctagtatgttgtcacaaccacaaggaaagtaatgactgctcagagaataaatggtggcccgtaatagtgaagagactgcacatggcaatggagaaaagggtctcacgcttgccgtaatcagctggaatgtgccatagtccagccagttgccatagcaaaataacagatgctgggtaacttacaaacaatggaagtttattctcacagttctgggggctgggagctcaatatcaaggcaccagcagcttggtggtctagtgggtgttagttttctggttcatgggtgtccttgcgtcatggaagatgtaaaggaacaattttggagtccttttataagggtactaatccatttaaaagggctctgcccttatgacataatcacccccagagggctcacctctgaatataattaccttgggggattagaatgtcaacatacaaatttggagggtgcaagcgttcagacagtacaagggctgttaatgacttcgggttcaatgtgacttagggacgcaagactctaaggatcacattctgccagaggaaaggaaagggataatgggagctccggggtgtatctggactctggaatcttctgtctctaatcccttgatagtctaatgggcttattccctaaagtgtgtcctttggaccacttccacgaacaatcacatggtggctacatggaaaataaaaggggagggtctctctttagtcaaacggtggagacagagtccaagggacacacacctctttactgttctatctcagtgagcttcgtgtggagtaacacacttggaaagtctgcaagcgagaactcaagctagggtgtttatttgaatacaggactcctttgttttccataatatcttttagaagtagaatatggaaaacaggctccctttgacctttatacgtttctccttctcttcccaacctccagtagccagtcaccccatggcatcatggtatatttgatgtgcgtgtttgcacggctttatggactgagtattatcatttcatgcagagcatctgtggcctctgtcactcagaggccttgtactgggcctagggttttgtccacactttcatgttccatcaaggtgttgtgttctcatcaaatcagctgcatttccctgctgcccaaaacccaagtctcctgcctatccactgtgctactgcttccagaaaactcttccctggatgtccttttctgaggctcttcatggccccgtgagataacactcctggctacctcccttgcttttatgactgtaagaaatacttatcatcatccccagggcccgtctccatatcaaatgttgtaatttaagagtgggatacacccttccaatatagtctcttgtgtaaccacccaacaggactcaaccttggctgagctgatcttatcgttcagtaacgcgggtgactttaagatgaagaggccatacctaagcagtgtgcactgggtttaatggtgtatctgtttgttgtgagagaatgtcaggtgaagcaacctagctcatggcttcagggttgtggtggtttggatgagaaatgtcccccataggctcatgtatttaaacacttggctggtggctctgtttggggagcttataaaactttaaggacatggaactttgctgaaggaagtacgtcactggagggggaggtgggctttaagaatgtgtatccccaccccacttccagttcgctctctcttttttcctgtcagcagttaagatacaatctctcagcttcctgctcccgctgccgagcctcccacaccattatggcctctccccctggaaccataaagcaaaagaagctcctccctctagaacctgtatcacagcatcaggaaagtaactaatgcaaggccttcgtggacaactctgtgctgaagcagcttagcatggggctgggaggaggatgctgaccccttggtggccaagaaatgaagcgaagataggaaggttccaaggcaagatatgccttcaaagacatagtttgacactccccttgatgaggccccaccttctgcagtttccaccacctctccctagcctgtttaaactttgaatctgtgaatagatgaatgcatcatgaaggcagaacccttgtggtccaatggcaactcccaaacagacacccccaaagccgtgccttattaatatcctaggcatttctcaatgcaatcaagttgataatcaggctcaaccactgtaaaattctctcatgatattttcagaaaaacaggtatatctagaaatcatgacagtaagtgaatcagccagacaatcagaacgacgattgcagaatgctctctctctctggtggaacgcagactttaaagcatgtaagtgtgcaagtgtgtgtgtgtgtgtgtgtgtgtgtgtgtgtgtctatgtgtgtgtgtagatcatgaaactagaaagaggatctcaagacgggaagaaaagaatctaaagagaagtgggagctaaagagggtgatggagcacatgtgattggaaactgaaagaggattaataaagaagtgaaggaccagctagagagagggaggggtctgagcagggcagtcaaggagggaaatgaatgagaacaaactgtaacggcacatatatgtatgaaaatgccaacaagaagccatcactttctatgctaatctaaacattaaaaaaaaaaaagactagccaccatatatgaatctctgaagctctcctactccacttctcctcaagatactggacagaatctctaagccttaggatatttgcctctacaacatgcaacataattaattgtctgttcactgtcaagctgtcctgacaggatgtaaactccacaacaagaagttctctcttgcccaccctgttattccaagcacctagagcggtgtctggcacataacaggtgcttgttaaatatttgttaagtgactaaatgaattgcctcttggtacatatttcttcacaacaaatgtatccccaaggaaacctcaaaccttaggaagatcttatttcactaatttgggtaattgatattttctagaaaacaaaaagaacagggggaaatttctcttaaaatcaaaccttagagaaagaggaatcataactgtccttatcaggggctggcccactgaagtataaaactgtgaaaggtctactacagaaggtcatcttgggatctgaagggtgaataaaggaaaagtgtattggtgggaccagtggtgctctattagcaaaggaattagttaggtcctccctggtctgccagatcacatcctgctcccaaagtgttatagttgcctggagcccacctctctggggtcatcttagggcaccagaaagaacacaggattagaagccatcatccggtcttgacccagctattcttagccaggaagtcccatgaatctttcagccatttggtcacctttaaaacatacttgagcacctgcctggatcatagatccattgatgtgggattcagaggtcactaaggtcacccagatccctgagacagagccatcagggatccagcagaccaatggtgatttctgtacttctctggcctgagtttcaaagacctcttatagtccactggcatcttgtgggagaccctagacattaggagtctcttctataactgctcaaggctagctgagcctgcatgtgggtatgtaaggcctctcatttttatgtaaccagagtccttgccctggtgcatcctcctgagtgagggttgttcttgggagacggtgtctcctgtccagttgtctcttctctttgcgctcatttacttaggtatgaaatgtgtgtgtgtgtgtgtgtgtgtgtgtgtgtgtgtgtgtgtgtgtgtgtgcgcgcgcacttatgtgtatgatcatcttgaagcatccttctgtttctaaattactattatgtatgctttaaaatactccctgctgaggctggagagatggctcagcaattaaaagcaccaactgctcttccagaagctctgagttcaattcccagcaaccacatggtggctcacaaccatctgtaatggggtccaatgccctcttctgatgtgtgtctgaagagaatgacagtgtactcacatatataaaataaataaatcttttaaaaaatactccctgccctagtttctccccaggtatgtctggatctcttattaaaatttccctttcttgttgtcacacaaccagctcagaacagcacgtccctccctggcactgggttcttctggtttcattgtctttgcagaactaacaatgctctttaccaaattctctatttgtattctgagcctgtggggtagatgattttgccatacacttccaggtatatgtatattctatatatctatataataggaggggtggaacacacacacacacacacacacactccctccagtacccaagaatatatatatgcctgggcataacgtgtaggcaaaaatattcagggacagccaaatgactattttaatgtttctttgtccctgtggaaccattcaactatttatttagtggcttgatgctgttggcatcaacaactttgccttataggctgtttttcatgtttatgattcttactgtgaaaaaaatagcttgcctaacatctgttctgaatttgttttgggtttttttctttatttttatttatctattcccgattgaattaaatttgcgccaaggacactcacttgaattggaatcttctgtgtccttcaggatttctacacacttcaatacatctcttaattactcttttttttttttattgttatgagatacacatacataccccgctcacacaggcagattggcttgcagcttacctctgcctgtccccctctggggaatacgttttattaactgaataaattaagtgggcggatagactcaatagaggagggaggtttatcattataggttttgtttcagatattttttcccttgctgcccaattctctcctgtagccatctctctgtttttggagaaagatttactataacttaatatagtcataactcaccaggacgggggttggggggaggggatacttcatctttcagatgaagattctgagggctggagccgggaggctatcttcctgcttacatccggaaacgatggagaagaggggcctctgagccacagactcagaagtagatcgttgcctggacctgtgactcctggcagacaagcttagggccttttgggaaacacaggaagcccccacccccaccccggggaacccagacactataccattgcagtggtccctttctcatagagcaagccccacccatgttgctgtgggtgtggttggggtgggggtggctaggaaagcatgtagaaggcggcatgagcttgagaaagaacagggcaaaccataatgaggtttcctcttcttgaggcctaccctggtggatccatgattctctgaccttttctgggatggcttcgtatgagactccagaccccattagcctccctgttgtcactaatgcttagaaacctacctagcgaccaacatgcatattcctagcagtcagcaggactgttctcaagaagggtgaaaacctgctttaatctaacacttgggatgttgaccagacatagagacagtggcctagattctgaagggtttacccagtgtctccaaacagatccaaaagcaatgccccctgccaccaaccctctgctcaccatccttgctcaaagtgggacgggcacccactttgtgtccttgactcttcaggcttgtgcactgatcttccagtgataaaagatagcagggatggctgtcctatctccacaatgctccccattggcccttctttagaattgtctgctcaatagtgatgtccctgtctgtgtgtagcactgagatgacagtggtggcagaggccaccattcctcccctcaacagagtttcactgctgtctctgctcaaagaaagttatcatctggtttggaagggaaacacagacactgcctgtgttctgaatagaattgcaccccccccacacacacacacacactcatgtgtttaaatatttggccatagggagtgacatgtccttctggaggaagtatgtcactgtgggagtaggctttaaggtctcatatgtccaagccactcccagtgtggcttgcagtcttcttctgctgcctgcagatcaagatgtagaactctcagttccttccccagcaccatgtctgcctgtgtgttgccgtgcttcccaccaggatgagggtggtctaaacttctgaaactgtaagccagccccagtggaatgttttcctttacaagagttaccttggtcgtggtgtctcttcagagcaatagaaccctaactaagacactgtccaaggtgcatgagagatcttggtaggaaatgatagtactcccaaaacagagcaggaatggaacatggggttcaggctgcgagcactaaagcttttggggggagttggcacttgactgtggccttgtgggaagcataaggaacaaaagggaaggtgaactctacttggtaagaaccatcagggaaagtcttgaagacaggagcggtggggaaggatgcagaaagctgctgttaaaggagacagagatggtccacagctcatcacacaatagagtcctggcttctaggctcaggatgctggtgattgtctttactcaaagctatggagttgtttaaagcaggtcttgcaggctgtactcctgactgacgatgagacgggcttgggggatggcatgtctgcgaggatacctacctgtctgcgatgggaggaagacaggagctgtcagggtcctctccagacaggacaaaatggtcagacacatctactgtcagtggatgctggctttcaggtgtcaatgcttcctatagctgaaggaatagcactagctgtctctgcagtagatggcagaccattccctgaggagacctctgggaaacccatctcaggatctccacagcatggaaactggttgagatgatattttggcagaagccttggcttgaggtcaaaggtggtttgaggattctatgcatccaactccccacagtgacactttgtccctctcgatctaagactgtatgctagccccagagaggagttacacaagctaggaagacagtcagggggtcagtagaaagggtgtccctttaactgacaactatgttgttagaacatgagtcttattgttggacctagcaactcagagaacaagagtggtaagtaattcttttggctcaccagatgctgtaaaggaatccatgaactttggtaggaaaacagaagggctctggttaaaggccaaggaactggcacttgtttcaaataatggaaacccatcagagcttacagagagtgcagtgacatactcaccttctgtcccctgaaggtaggtttggccttcgtgggaattggccttgtagaaacagatgcccacccccacccaaccacccaccaccctgctgagagccactgcaagtaaaagcagcaaagctcaaatacagttggcatgagggttagaaagtgattccagtaccttccacttgtaatatggaaattatagcttctctctagcactgaggggctgccataccaagaggagcagctagcccaggggccattaacccaggggaagctgctaacccagggtagctgtgagtccaggagtcgctgcttaagccaaatgtccaagagcagctaactctcattaactttctctggacttcttggaatttgtgagtcgcattcattgccagagcacacggccaccttttcccgtggggcttcctgatatttctgtatctggccaaggtgaggtggaggccctgacagcgactgccgtgtagcatcttttactgctaggaagtaaggcggctgttgccaaggcatggatttgttagatacctggtgtctagtggtgcatggcaggtcctgtcaatcatgcacatgttcagatcccttctgctgatgtgggggtgtcaggcctttatcgggaacctgctcatcccctcatgggcacccataagttcatttctcatagtcaggggccatcaccgttcactgtccacactaatagcagcttcattgctgaccaacttcctgctgaccttcaccatgacctcaaagtagacatgatttgttcaaggtagcagagctattaattacaaacaaggcctggatctgagtccccaaggctccagtgcccaaagacacagcactgtcacctcagccctgacccctgacagcctcagtaggccaacccagcaacaccccacttcctacttcttccaaaaagtcacgaacacacttcaaaatcctgagacattaaagaaacaacgactgagaaaaggggaagtggccacaattctctgcttcagatacacacccagtatatttttctccagacttgcaagaatttgtcagctgggtgcctggcagagtatgtgctcaataaacacttcttgaatgtactaattaatgctggagttgactgttatttattaacaggcccacagtgctatttttacaaggcacacttccatctagttgtggagcctgggcctttccatatgactttgagtgacatgtccccactgctatcccgtgaacagccccatagtttggtcacctctaccagaggtaggccttctggaacaaggccaggcagcccccaggctaatgctaacagtcttgcttgtcatgattcccagaaagaaggcaccagtgctattttggttagactggtcagtggtggttttgtgtgtgtgtgtgtgttttaagagaaaaataaaagaaaaccaccaattaagcaagtcaaataagtgttatttttaactgcacaatacttcattggttcgcctacattttctcttcaaccaggtgctttggggttgaataagcacattattatgtgcataaataaatataaatgaataattggttatgaatttcttgcccctatagtagtcaacgtgcaacttggattagcggggagtgagccctcacctccttcattaggctggaaaggagtttctggtccattaagcaagaatctgttctccaactgcacctttaaaagacacagttagctgaggggggggaacgatacagacaatatggctggaatctgcctggcccctttgcacacctgcttgctctggatttcacagaccaggctagtctggggagaaagggaaggttggccatcttggagagacggacacctctgaggcagggtcagacggtccttgtcttgggcaagtcttagtttcctgttctagaagtgagtaggatggcttcctcttccattttcttcaaaacttaatgtggtggtggaactagtgtaggaggctcagagccaggcaggaagcaagcaccagtgctaatgactgtgaccacaaaggttctgaggaagacccacaacctagccacacatcactgaccagtttcatggtttgggacgtttctttgcaccctattggcttcactttcaagaatcgtatttccttctaaattaataggattgataggattaaatcaatagggaattataataatcacctagattttactcccaggtttcagctgcaacatagtctgaagagtttgtgtctaaaactgtcccccacaacaggtgacaggtgagcatggctcccacctgctgagcacaccacctcagggagcaggaaacagggggcaggaaaatacataccattcattctgtttccttttgctatcaccaaacacttcagactgaatgagttataaagaagaaaggtttctccaactcacaatactggaggcagagaggctctgaccagatgcacatggacattccacgcagagtcctaagatgatacaaaacaccacatggtgaaaagagttcaccctggagatggtgtaccaaagtggcctttataacggatctgctctcagtgtcacccattaacccatctattcttagcctttgtggtctaattagcccctgaagggcctgcctgtatacacctctgaaggcatccctcccgatgaagattaaatacagggaaggtttttgtggagacatttaaaccaaagtgcatactaaaaaaaacacagagagcagatttctgaactccgtagggtgggagggcggcttccccaggagaagtggtaagcagactcatgtggtagagccattccagactccagaaaggaaggccgcaactctggaagtaaaatacatttttctctatttaagatcttgccaggagctcctcaaactacagatgagcatttttataagcataaattcacaagattacacaatttacatgtaaaatggggccagtttcctcccgaggttcataaagcagctctgaggcaattctaaaggaattgttgcaaaattggttttagcattagtaatattactagaaaaatatggaaagactcccgtggcggctccttccaccagaatatacaagtattattttgctttttaaaaaaaaattcaaagggtgtacaaaattattttgatcataagaaactcaatacaaatatcttgccaaaatatgagtgtctcccagagtctaactagttttcttttacatctaaggatttggggaaatacaaatgggcattgtcctctgttcatagatcagggcggggtcccagtctgttcattgtccatggcatcagaatccccagggagcttgttaaaataagaggtgactggtcccactcctgcccaagactagggcctggtaggcctgggtggggcccatctttctttgaatgctccgttcttggttttagccagctgctaaggttctcagtgctgttgtgggagggtggccccatgttcttgcatcagaatctgagagcaagtatttattgtaggtttctggggcccacccaagcttggtagaacaggcttggctgggaacagggcaatgtctttaaacttcatcaagctcctgaatgacttgtaagaaattatcttaagtttgaaagaattatagatgcatgggaatttgcaaataaataaacaagaaaaatgcacagggaggtccagtgtctttttttcctagtttacaccttggcgatctacaacacatgcaggtaaaactataactagctatcaaaaccagcaggtggaactcagttcatgcacagggattattcagattttatgcaattatattgcacatatgggtgtgtatgcatagaatatgtatgtatgtgtgtgtgtctctctctctgccaatactgtagtttcaactgctatagtcaagttgctggtatactcatttctcttgcttctttcttcaaaaaaaaatcagttattcttaatcttttgtctttccatacaaatttgagagtaagtttgtctttgcttacattaattcgtgtaaggaaattacattaattcgggaggaaaggcatcacatctgcaggtggtttaaggaggattggacctttatagtgttttccaacccatgaacatcgtttgtctctgcatttacacatgggttcttagatttctttcatcaacagtgtgtgtgtgtgtgtgtgtgtgtgtgtgtgtgtgtgtgtgtgtgttgttttgcttgttttattttgataggaactagatctaggacctcatgagctaggaaaacattcttccactaggttccatggtaggttggttctgtgtggattttctctaaatgtccaaaaaagtcatccatactatagtcgcttggatgggatttcctgtaggcttaggtggtggtgctgtttggtgaggcttagaagatggggtcttgctggaggcaatacatcactggttggggacaggaatttaaaagtttaaatctttccaccacttctggttagctcgccctgctttgtgctctcaggtgaggatgtgagctctcagcctcctgctctggctttcatgccatgatgaactcttatccatctggagccataagccaaactaggttccttcttgtatgacttgccttggtcataatgtttcatcacagcagtagaaacataactaatacatgtgtgcgtgtgagtgtgtgtgcatgtgtgtgtgcatgcctgcatatgtgtgtgtatgcccgtgtccttgtgtgtgtacatgcatgcatacatgtgctgaactatgtgtgcaaacctgtagaggtcaattatgagagacgattctctcctttcattatgtaaatcctgtggattgaactcaggtcatcagacttgctgagccattttgctggcccagttttctttctttcttctttaatgagacgaaattgggatttattaagaaggaattttggtaaaggaaagtggatgttgattaagaacaaagatgacagctgctgtggtgtatgagtatttttacacattgctggatttgatttgttgaagatttttgtgtctaagacacacaagatgcgaggccatgcagctctcctttgctgtcttcatctgggtatcaagataatacctatcacctttggaagtgacgctgagccatgtttcaagcttttactttctagaagaaattgccaagaggcattgttacttgtttgtaaatgttcagaagagttctctactaaaaccatctgggcctggagattcaggaaatttaaaaatatgaattccatttttgaggtcataggaccattcagactgttttcccatacttttattttattagtagtgcttttaatcaacatggaaagcaatggatccaagacagcattttcatgcacactttttcagtcagctgccactccctttcctatccttctgtccccttatgcagttcttcttttgtctagtatgtgggcatttgaacgagggtccatacaggtgggcatcagactacaggtgggtgtgagctgccatgtgggtgctgggaaccaaacccaggtcctccacaagagcagcaagtacacccaaaggctgagctaccacactccctacttttgatttattaaatatttttatcattttgtgtcttatttttagtagttgcataactatgcatacataattgatcttggtctatgggtgtggctgccttgccactttgggtgccatgtgaaaaccttccctctttacttcagaatgtcactgtctctagctttccctccaagtactctgaccaaagttgacacttcagctcttgctttagccatcaaacatactttaagaagtgtgtgggcagagggacagcctgtctgtcaccttttacccgttctgtggtctttgttttgggaagtttattctgttatcatttcacttctcactggataaccttcttcagccttcctttgagagtagatctgctagtgataaattcttagttgctgttcttaaaatgctttttaaaatctgtttcctgaaatccaccaaagagataatggaaaattctttgcttgtaccacttgacaatgtaccaattccttctgacctccatgattttgacctgtgtaaatgtccatgtttgtgcatgtgtatatacatgtctgcacacatgcactcgtgtgctcatgtgtgtggcagtcagagatcaatgctgcatggcctcctctatctctctcaactttgtactttgagactgtctttcactgaaactggagctcactgattgacaagattgacaagcgttctcctgtcccctcttcagtgttagattacaagtatgaaccatcatgcccagatgtttttctgcatggaagctgggaatctgaacttaatttcagtattgagcaagtccactccagtcctctagtttccggggtctttctgtctgtttctctcttcctctccctccctcccctccctgctccttctctcccctgctttgtgtattgttcatgcgtgtgtatgtgcatgcacctgtgtatgcagaaactgtaggagggcctcaactatcttgctgtcactcccccatcttattctcttatgacagggtctctcacagaacctagaactaagccacccagccatcctcctgtctccacatactagggttatagaaacactgatgtatccagcttcatgatgggttctgggagctgaactcagacctcacgtttgcacaagctctcttacctagccaactatcttgtgagggtcagtctccatgattcctgctgagaaatttgctgtcctttgatttaatatccccacaaggggcccttttaaagatgtttcttctttctttttagcacctttctcccagaagctcagttgtgacatgccttggtgtgtgtttatgtgtgcttaccgtatttgaggtccatttggctccttatttattttcttcttgaatttttataatcttttttcaaattgggacttttttcagctaaaatttcttcagatgaaggtgattttatgcacactttaagtctgagaagccctgctttgggtagaggtgaagggtctggaccctccttaatgtctacagcgtccctgtaagtgtttgttcttctcagctgggcatctgtagcttgctctagttcccagaagactctgcgacacctgccacagagtttagaaaagtgtaggtttatggctaggctgggttattctcagtgttcttggttaaaaacagtacaactagttggtggtctccccttctgtgcaccgcatctgttgaattcctgtggtccgcagacttccctaacaattttgtaaaataggattgcgtggttgcatattttctgagtacctaatagaaaacagataaatctttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctctcttctatttttcccctatttggtggtggggaaaatgattttaaaatgaacaccattttggctcacgaaagctgagtcagaatactagagcaaactcagctgctttttttttttttaatgttacatctcttctaaagtctgacccatggtgctcagccagttacacccaggaacatgccatctcacacactgaaagcatgcttggtgtccccgtaattactcaacttcactgttaacagttggtttctagttactaaccgtggtacttaagcaagcagaagggggcctgacccagtgctaacgctgactcctttgcccaacccattcacacatctactccatccaactacttggaccaactcgggctcatcttcagaaactcagtttgggaaccatctctgggaattcttcatgtcaccccccacccacccacccagacactgacctaggagtcccctctgatctcacaccagccagaacatcctgctgtgtgctaactgccattctgttacccccatcagatgaagtcttctccccccccctcccccggaggcagggactgggtcttggtgggttgggtccttctatgtccatagagataaaccgcatctgtaaagcccttcctctgaccagagctcgccagcatcaggtgactggctgaggcttctcagatgctctatctgctgaacttcctgtacaaagttcaggcttcctgaagcaggattaattatccccacagtctcacagaataagtctgcttcttcttctagtgtagaattagtataaatgtcttcgttctaaaatgcagatctctcacgtttggaaaactcggccatttcccctccactttactgctggatctcgggagccctcgttagggtgttgacatttattgacctgtctttcctaagctgcctgagtcagggactgtgtttcatctaactttccagttctgggacaaggtggcagtccgcaagtgttgatgggaagagctttggtggcactttaccacagatctacaattgcttaccatgggagcctgtgctctccaatctctatgtattaattcccctcttagcatccacccttcaatctctatccactctccaatctctatgtattaattcccctcttagcatccacccttcatcctcaacctccgtgaattcttttgggaggtgggaggagtgggtaatatcgatgttacattttaaagcagttttgtttgtcccctcctaggtactatcttggccgtcggatgcacgttgtcatttcagagccagacatgatcaagcaggtgttggttgagaacttcagtaacttttccaacagaatggtatgtggtttcctctctgtgtcatccttatgaatatgagtatggaggggtggcttgtgacagttaacctcggttgacagtctgacacacttaggaaaagggaacctcggtagaaaaattgccgctatcagattgacccgtgggcatgtctgtgggggcattttcttgattgttagttgatgttagatgtccctacctgctgtgggcagtttcatccctagacaggtagccctggattatataagaaaggtaggtagacataagcttggaagcaagccagcaagcaatgtccctccacggtctctctctgcctcagctcctgcttccacattcctgccttgaggtcctgccctgactctcattgataggggcagctgtaaattgaaagaaaccctttcctccctaaagtgcttttggtcagggtgcttagcacaccaacaaggatattagttatttttctgttgttgctgctactgtgataaaacaccatgttcagaagcaatttatagaagaaagagcttgtttcagcttacagttccagagagattagagtccatcttggcggggaagcatggcagcaagcagcaaacacagtggccagatagggaaatcgagaactgacatcctcaaacagaagcaggaagcagagagaaagcaggaagtgaggtgatcctacaaacaatggaagccctttcccggtgacatacttctcttaggaagatttcacaaaggggaccaagtgttcaaatatctgagcctctggtgtgtgtgtgtgtggggggggtgattctcattcaaaccaccacaaacaagaagcaaaataagtaacttctacgggccgaggtctgcttccctcaaaacttctaaaagagttcctgagaaatgcccacaacggctgcaaagttggcatttatacctaggaaacactccaagaaaactagagcagaagagaaattggcgctggtagaaatgctacagccaggggagttggctaaagctgtgttcaaagctagaggagccacggggcacgggccatgtgactgagaaataccaagcaaggttaataaatagcagcgggagagcaagctttgagggtctgtgcttacatctttcttaggaatcctgtaagctacagaagaaagataaacaatatcagtagggaaattagcccccacggattaacagcaggagtctacagaggaccccggtgccagttcaagtctccagccttcttctcctgccttttacctctgatgaacaaattccaaatagaagaagcggtggtgcttagtagtgcccacatttcctcacagtgagaagacagaaactcgaacaaagaaggttagtgaccttcatgttgattcttagagagagtctcaggtgagttaataaacagatgcttgtgcaaatttcaacaaccacagtatcagccatctctttcctagtcaaattaaaaactctgtgtgtgtgtgtgtgtgtgtgtgtgtgtgtgtgtgtaagagagggagagacagagagagacagagagacagcagacagcgcatgcttaagtgtatgagtgtgggtgcctgcaggctacagagtgtgtagagagatgtagagatcagaggacaaccccaggcatctgtctattcttgccttccaccttatttgaaacggaagcgcttgtcatttgctgctgcatacaccacactagctggcagtgaacttgtaggaattctgccttcaccttccgtcttgtagaaacgctgggacagaagacatgtgctgctgaatctgactttacagggcctgtggatccaaacacaggttctcacacatacacagcaagcgcgttagccaccgagtcatcgccacagccccaagtttcactcgcatctcttgcagagatggtaaataatgcatgcattcgcttgatgaccgtggaaacctttgcagcacacatgcaaagctcgcacagtggcacaccagggccatccagggttcaggtgggaaaacttacttaagattgcgccatgcttgagatgaagccataaaacaataggcagcctccgctttctctactgggtgagcaatccagggtgggtttttgatcatcctaagaagatgtgagaggcggacagactcagctcttcaaggcacttgctgcttgcagaggaactgggcgtggctttcagcacccacaggtcagtgtgcatttccctgtgagtccagttctaggggctctaacgccaacttctggcctctgccggcacgctacccatgtggtgccggacaagcatgcaggcaaacactcatacacataacatgaaaattataagattgatacagtgagcctgtccatttcacagacaaggaaactgggacccacaaaggttatgtggtcagcctagtcacaaactaccttgaggatgggcagaggaatgaaggccacctcccatttcaaggccagtcctctccgtacttcactaccacaataggagtctctggtaacatttctacacatcaaagctaaacagagtaactaaccactcactctcaaccccaaatgagctcatcttctagccccaaaacagtgtccagctccacaccctacatggcactagagaaaggtgaccacttggcaccctgcctctgtgtccttggagtggctaaaggagtcacagtagtttagctgctccctgctgctctgagaatgatcgttcttccacccaaagacccttggcaagctctggcctgctgggatctgaaagactgagcctgatgcttcagccaggcttgcaagttaagaggatatctgtccaagagcacaaaccaccaagtcacacccaaacagacaacaagggtctccaggctcctgtagtgcttcctgagcccacctgagcccctgaaggtgacacgggcaccagagtcctgagtctctatgtgacttcccaccacacctgagacagtctctgggcaggagagctggccccaaagaaggctgctctctgatgggcatgtgtggtgcaaacagatccagtaaactgttgtagcagagaccactaaataaagttgcccttggcctctgtcagcttctctcccacactatttttttttttggtcctctttaatttccttcccccaaactaagtcatgggccccaaattccaggctaaggcccagcatccccttgcatccagcaagggaggaagagctcaggttttaggtcgtcctgcaaaatggacaagcatctgtaactcagacaattcccatgtaccaacccaatagctccgaaataaaatgtccttccagtcatcccggcctctctggtctttccctagtctcccagcctgcccccagatctttgcacatgctgataattcctacaataagaggtaacataataacaggggttgtgcttagtagcaaggtgagctccaaactccttaaagcctcttgttcctcctttggaaactggggatatacaagctaccttactaggctgttgttaagttagatggtacggctcaaacaagctgtggccctgcacggtgtgtggcaggtccaacaattgctcggtacccattgcctgttttcagtgcttcacctcctcagcacctgtgcaaaacccagctgctcttcaaggctatcagattctacctcctccagaaagccttcccagcctccccccactttttcctttccagaaacagactcttggtcacctgcatcatttatctttattactgagcccatctgggacttctggcttttgtcctgactcggtgatttatttttcaaacctaaggtctgtttttttctacaccccctttatggtccaaacacctagtggccgttatggtttgcctgggaaacgcctcccagtgtgcccacgtgtttgatgacttgctccccagttgatgctactgctttagaaggctgtagaattttgggggagagcagtcctggatggaggcagggggtccctggagaatgctgtctgtctcagcttctggtctaccaacgtatgaaccagtagcttcacgctcctgccacagcacggtgagctgctatcactaccacagcttcctcaccatgatatagtttacattaaaccatgaggaagaaccggtcagtaagagtaagttatctcgggtcaggtatttggcaatggcaatgagaaagataagtaatacagcatctcttctgaatccaagtggaatagtcaactgttcacaggccggatcatctctgcagtaggaggggtgcctgaacctggggagtccccatctcctccccagcaaggtcatttacaaagacccattgtagattaaatctctaggaaaccctgaagttaattttccatctgggatgactctgcttatcttcagctttgtttatggtctttaaagcaattccatattcatgataaaaacaaccctggtgactcactttaaaaacaaaaaaacacacagtcattcgagtgggattttctcacaggtttctgaaagtcaaattaaaccgggttctgtggttccctcttttccatatgcttatttatctgctcaaagaactcaaggagattagtgaggcgtgctttccccgaccgacaccatgcctccttccctttaataagccatgtttacttaagtgttcagcttcattatacattcactcggtaaacattaaacgcttactccatgcaagcgtctaccaagaggtcccttgtgatacagaaacacttcggcatattagtttgatgcattaaatgaaaaggaacttaaataacacatagcttcattttccaccgttgagagcccactgctgctcacacatcccatttttgagtcatgtagcttcaaggacaagctggtagaacgtggttgtgtgaagagctgggagggacccatggagctgaggtgacatgacaggggactctaacacacatcagttctgagtaaatattgaataaaaaaaaaatcattgagtgaagtattatatttcagctgggcatggaggtgcaggcttagaattcctatactcaggagattgaagttcaaagcctggctgagccatatgtagagagtctctcttgtaagaagaagttggggccataactttttttttcccaaactctaaaatcctgggctgaatagattacaaatgtccagactcaaaagtgacaactctcaggtcacagtttccctcagctttttttgtgaggcatgtcttggctccatcctgtccttatccctccacctctgttggcactcctggtacttcctgagatggctccactaacccttgaacccagagatgatcattaagcccaatgatgaccaatcttcttaggatctgtagaccctccatcatcccagcagcttgaatctttggaatttttgtttaaatatttttaactccttcttcttggctatcttgaacttgagggcggcttgttttgttttgaatatcaatggaaactggagctggcagaaatgtccacaactagtgatggaattatttcttgggagggtgatgaggtccactggtctttagcctatgtttggttggtccagttggacagggacatgaaggagatgggttcgatcaactaccatgataccctggtgccatgagttctcacccaaaatggtagcatggagagctagagctatagacacattggttcctgtcttggcagcttggatatagagcagaggagggaagtaaggccattgcatgtttggatgggtgagtaccagtccttggaccttatgaacagctcagagaccacctctctagggacaggttgaatcacacccatctcatctaaagccatgtgattgatttggtgagaggttttatcttggaccataagccctgagagccctggcggccctagatttagcctctcaatagaccccatcatccacttatcctgtggttgtcacactcccaaggcccaatcaccatgagaccacaatgtgccgcagagatggctaaaggcaggaggcaaattagtccctggtgattttatccttttatatcaaagttccacagtgttcagagaaacgcagagggcagcagttccttgaagtgctaactgtccagaaagctccattcacagccaccagcaggtcagacccacccgtgctggagccttggggatcccgtgctagtccatttaccataacattgctctctttaacctgtctttacccgcaaaactggtatctttcctcccacagttttgacaaatccatccatttgctcctggtccctgtctgtcccttaaaggaagcggctaggaaacagactctcagattcctgtggtgagaacagttgccacatatgccctaaggaagctcttgtctctttggctaagcctgaaattttgtttgtttgtttgttttttcccctttccttctttctttttcctccctccactcaactctccttggacatttcttaggaaagttcaacccagccaggcgtggtgatgcatacctctggtctctcaggaggcagatgcaggtagatctctgagtttgaagccattctggtctttagagtgagtaagaaagaaatcaataataattattattattaattaataataataaataaaggtaaacccacatgataggcccagagcaaggcagttcttcctgacagctcaaacatccagtgagaccagtgagcaccccaaaatgtgcaggagcaaccttgtctgtttagctcacactcttttttttacagcaagcctttttgtttttatgtgacgcacttggcaaagcacaccacactgggcatcctgggtgaaatcacaccgggtggccctgcctgtggcctgtgagcttcccaactcattgctttagcagagacacagctggtcctggagatggccattgcacgggttttcacagcatgatgggttggttcgcacttggacatcatctttctagggcctgagagtctgtgaggccccaggatgccggaacggccagggatccatgccattgatttggatgttcaaggtttttctttgactcacagcacatctttgtaaatttcaaaatgttgttgaaaggactttatatctttggtcttcaaacgttcttcctatttacatgtatctgtctgtgggaggaggcatgggggaggttcccatggtgcacctgtgaagggcagaggacagtttgcaggagttagtcctttccttccaacatgtgagtttcagggattgacttgggacatcagacttggcaaccagtgcccttcccactgacccatctcacctgtcttgtatcttgagtgctactagactcttggcatagcaggaaatcaagttcattttaaaaaataatgagtaaaaccttatttgtgtaattatgctttctttccctgagctttatggtggtggaaatagataccaatgtgtcaaacaggaggcgaatgtctagagtttgggggatggattgtaaatgagccccagaagcaagtgtgcatgagggaagagggggagagaactgggagttgggggggggagtgggggcacgaatgaaagagcttgaggaagccagccacatcgaatctgatggcaatccactcactttcctttttatgcagtgtaagacctcgtttcatagaatggcgcctcctgcatttagggtgggtcttccacttcagtcaacccagtctagaaactccctcccaaccatgctcagaggtttgcctcctatatgaccctagcccctgtcaggttgacagctgatgttaaccgtcggataagtcattgtacaggcgagagctgaccctcattctctcccacccttgtttctattttctaccattcccattcttccgacattccccctcttcttaacagttgcctatcagtgaggtggaagccttcgaataaactgtaaactgatttttagctgtgtgacctgtctatcttttgacttctctgaatctagatgggtgacattaggccagctgattagcaaagacatagctgattagctgtttgacatagacagatcaccttggaatcctaccacatcccacacaacctttcaaaacttcaaatgctgggacaagtcctctctcaggtccctaaggaaaatgttgtcccagccaagcacaacagacgctgtgtcggggacacccttgtccatctcaagtgctatcttactcaggggccctgcaaagagctgttgagaaagtcacacaggagagaggatttgaccagtcccaggacccatctcaactcgggaagggcccttgctgtgaggtacagggctaatagaaggtctaagtgtatggttttctacccccaaagtataagccatgactggcacaaatctttgcacagatcacagtgatcatatatgtaaaataaccacaagcagagacattggaataactgaagtgacaaaattctcaagcctacttgactagaatctaacaagtgaacatgtcaaaggtttctcataacgaggagcaaaacagacaggaccatggagagcttcttcatggccttgagatgatgtgggaatgagaagtgttggtggcagaggcaaccactgtacgttatagattggtggtattctgcaacccacttggcaggcttaacagtaaaccagttggcagtgctcaaatagtgacctcccacgtgacatggcatccctgaaagtcttaacctccctcactctgcttgcccacattcctcttccacttcctgcctcttttaggctgagaagacaaacagtggccacaccttgagagagcctgttgggaatccatgttagataagaggagttacctggcctccaaggaaataggtgggagagacaaggaagtagtgtgagccaagtttggggagaccagcaggacacaatgcaggtgacaacgatgtagtcattgaaagatggcaacctcagtcatgttcagaagatagaaaatctgattcaatagtatttcagtggtagagtgcttaggtcgaatctatagcacaatggaataaaaaggagaaaaaaaaaaacccattaaattagccaagggaattaacttagctcttaaattgttatccatgtttgaaaaccatcaccaaagtgacagatgtgtaattctatcgcacatgacagtggacacttcctgagtctgagcaggagctctatcaggaaagtgggccaagcttctgctcctgccagggatggcccagcacagcccaacaagctcactgttggttaaggcctcttcattgagaactgctggaggttatcccagctctgaacactacattttagatctcaacttgaagccttccacttagacatgttgattctcgtttggggtttcctcatctcactccagactacacaaattaaagatatctggcacgctgtttatttattgattttaagttagcataactttaatatagaaatcttgattataaaactcaatgtgcacactgccagtcaacaaaaggttcagagccaattctatgctgggcggtaggggggtgggttgtcacttatgtgctgggcaggggggtccctatacgcttcttcccagtgttctcatctttgcccctcaagatgaccactcttttggcatctattacgacagacttagatatcccattcttgcctcttatgtaaatgaaaacttacaggatgtgctattctgtcctggctaatttttttcccctcaatgtgtttgtaagatttatctctaaccaggtactaaaataaatgccatccatcttgtttattgctatatagttctctgatatatacaagatcatttgtccctctgttgataggcttgtaggtagttgctgagttttcaatgttctaagtcaaactgttaagattatattgaggaaatgcacttaggaatcagtcctgggaccagaactgctgagtcacagagcagggccgcccttggcttgcttgtttaccatgaatcagttttcgatgtggttgtgtctgctgttgccttggcaatctgaggcggagctctccactttacctgtccttcacgtgctgctgcttcccttgctttctggttgggtaatgacacacccttgccattttaatgtgcatttctctaatgagcaatgatatttcatgctgtttcataggctctcctgacatttgaatatccccttttgtgctggccaggtctttgcccattttttttttttaagtgtttgacttttttttttccctcctaccaattaattggtgtcctaatatgatctgactcttttgtgggcatagcttctccttgtctgaagttttcttgtttcttgattcgtttgtgcacgcgcacccatgcccacacatagctgtttatgtggaagccagagagcagccttagtgctgtcctccagaaccaccctccttgtttcctgaaacaagatctctcactagtgattagtgtaggctgcctagccagcaagccccctgtctccactctccactgctgagattacaagtgcacatcactaggctcagccatatggacatcacaccagtcctaggctttgaactcaggtcctcacaactgtgcagcaagcactttgccagctcagctacttgcccccatccccccatccccacccccttgatcgttttcttagtgtaaccatttgctagtaaagtccagattgccaaactctctgacagcattacttttgttactctgttgaagaaatcttgccggcctccaagcctttgaaactattctgtacgtttcatttgctttgcctttcacaccatctccagatgactttcagggggaagtaagggatggatcattttgaaatccaaataccccaggatcatttgtgaggaagaccatccaatcccggagttaggaaatatctttgtcataaatcaagacatcgtgtgtgtgtgtgtgtgtgtgtgtgtgtgtgtgtgtgtgtgtgtgtatttctgtatttcacacatgtatttctggatcctgttttgtgccatcgattaatgtgtttgccccagtacctttgtatacccacagataagtatcctatcgttacaataaatagatggaagcaccatttctcctgaccttcaggtgctttggtccttcctttgcttatagttctgagtcaacttgtcctcttctgaagaattgacttagaatttccagatctgtgagtgtatcatgtgagtcctcttcctcttagcaacactttgtatttttagtttagaggttttgcacatcttttgttaacaattgttccttaaccattcaacaatttaaagctgggcttcgtggcacatgcctttcatcccagcacgtgggaggtagaagcagacagatctctaagactttgagaccagactggtgcatttttaaaaagtgacagtttgctgctgctgctgctgctgttgttgttttagttcgtacccaacagttttacactcagtattaattcagaaagtatgttggcagacactccgtgacctttctgcaatttctccatctataataaataccgcattgtttcttctattcaaagctttacgtatttcatatcactttagtcatagtccactaaggttttgtctcatgatggctattgaaatttattaagtatttcttacctgttgagattgcacgcattcttctcctttattgtgctaacaagtcatatttgattgcttttcgaggcctgcactcctggactaagccccttggatcttgataaatagctaggatttttacattggtgttcatgagaaagtttttctttcttacaagtttctgacagatttggaatcagcgtttgttggctcgggcattggtcggcttaatgtccaattgtgctcctcagagcattaatctcagctttgattactgcaaatcagtagtttattatgccaataacaaataacatatgcagctggattagcctcagtgtagaaacctatggttttccgtttgactgcagattggtagagtttatctgtttttgttctatcagccataaaaacaccccaaagaattattgacccacccatcatttctctttcttctccataagaatgtcttggaagtaaatcataaatgctctgtttgccacatctacagatctgtctctaggaaggaagagaggataaagttactttggcaccatttgctgttcctgaacttgggctgactcctaaaagcccttccttaaaaattcctttaacaattattctagcttatacatataaaatgtggggatgagatgtagtatttgtatgaggatatgggaacaaggtccaggcaatggagtttccctcagaaggagtttgcagctgtgttttagcagacaaataagaaaaggacagggggcaggggacaggggacagggagcagggggaggaccaagagctccaggtaaagagatgagctggtaagaagactcagactcttaagagaagatgaagtggtcatggtattggctgaatgacatgaagttgtctcaagtactgcatgccagcctggcagtgagggcgcacacctttaatcccagcacttgggaggcagaggcaggcagatttctgagtttgaggccagcctggtctacagagtgacagccagggctacacagagaaaccctgtctcaaaaaacaaaaaccaaccaaccaaacaaacaaacaaaaatactgcatacccaggatgttctaagtattttaaatgtatcaatacaaccctcccagtggctcagttcaaaactcttggtgttatccttgattctggtctccatattagttactgtcttgtagacctaagccatgacaaaaagaaacgtagggaggaagtgcgagttttgcttcagaagttgaagaaagagtctaccatggtgagaaagcacatgttgaaagcatgaggcagctggtaatcagaaaacacagaaagcaagcagatataaatacacaaacatacagagagagagagagagagagagagagagagagagagagagagagaacgaacaaagcaaaccaaaccaagcaaaagcagttggagatctccgtccctgtgctgtgtctgggaggagtagggggctagtgagaacattacttggcttacaaacaagtgagaagtctcacagggaggagttagctagctgaggttaggtttctgcttttgttgtctttttctttaaactaatgctaacaagcgtgataagggctggtgggatggtgctggagagtaaaagtgctccctgtgcaagcctcacagcctgagttcaatccccggaccccacataacgctggacagagagaactgacgctgaaattgccatgctcacattatcataatacagctttaaatgtaatgattttgcataaatgaggcacccttacactgtgtaatgtccaaggttacttcactattatttatctccgtcatggtagaataacacaatatcctttcttttagtgttttgccacacaccccatcattgtcatctaaggttggcatacagcagcacaccagagcgtcttgcttccccctaaccgcagctcagaacaccttgatcacccaccacacacacacacacacacacacacacacacacacacacagacagacagacagacacacccctccactccattgtagccttcagcttaccctccagtcgcagagatcaactttaaagctttaggaagatcctgcagtgtggaaaatggatggccgtgataaggctgtccacagggcagtcagttagggcagagataatggtgacctcagccagggtggtggccctaaggatggagtaggctggccttggttgatcaaagagatttcagacttgtgattgataagctttaagtggggagagatgacccaaaggtcagtggtttggattaaaataggcttttcaagccaggcagtggtggtgcacgcctttaatcccagcacttgggaggcagaggcaggcggatttctgagttcaaggccagcctggtttagagtgagttccaggacagccagggctatacagagaaacctgtctcaaaagcaaacaaacacaacaaacaaacaaaaacaacaaacaaacaaaaaggcttttcaaattttgtattgactaatagtaagaaactagccatgtgcaacagtctaaaaaaatagatttttgatgttgccacatacacatagacacacaaagacacacatgcacacacttatggcaaatgagtttgacaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttccttcctctctgtcttttctttgtttctgtattttctttgtttggagtgtttgttctgatcttggttctgacagggtcccactgtgtagctcagcccagcttcacactcacactccacatgcttcagtctcccgtgttctagggtaacaggcatgagacatcacagctgcctctttttcctatgtgttggttgccattccctacagtaatattctatgggctctgtatgctatacacacctagcctgaaagaacttggacgtatcttggctaaaggtttgaacatgagcctgtcctagaggctcatgtgtctgaacacccagcctccagccagtggtctattttggaaggtggggaggaagcctttaggcttcactggaagaagtggatctctgaggggcatgcctactttctgcactctttgctttctgatctactgaaatgttggcaagcagctggaacgcactccccacgcccagtgaccacagagcctgctgcaggcctctgccaccattgaagaactatatcccttcaaagcataagcccaaataaacctctcctccctaagctgcttcttgtagggtattttgtcactgccacaagaacagtagctagtacacttgaccttaaaaccttctcgccatcttttgaaatgatggaagactgttcattttattctaatacatgtttagacatgaaacactcctggaaatgttacctctgactttgactatcaaaaaagagagagagagaaagggaaagagaaaaaagaaagaaagagagagggagggaaggaaggaaggaaggaaggaaagaaggaaggaaggaaggaaggaaggaaggaaggaaggaaggaaggaaggaaggaaggaaggaaggaaggaaggaagggaaaaagaagaacaaacacaaaaacaaaaccatggatggcaccaaaatacagcttctaaacagaggacatgagaggttacagggctgggttgagagtctaacaacatattgcatggagagtggtatatttgtcctttaaatataagattaaaagcagcagagacccaattcttaggtcttttgtgtcgccctcaggtatcatcgctcaggtaccatccttttggtctttgttttttatttagagacagacactcctattgtcttagagcttgcttgccaagtaggctcagctgatggccatagatctgcctgtctctgcatccccagcgctaagattacaagtgcatatgccacattcaaccttttttttagcatgggttctgtgggttgaacccaaggcctcgacgtgcagcaagcattctgctgattgagctagctcctcagccctgcactgcttacatcttaagggtggatcaaatctgtcttgatcctgattcgacaattgagtctgtcttagcagaactgtataaacctgtgtctcacttttttttttcccaagcaaaaaggcttagcagtgtggcacaggctggggctttgccactctataaatatccataatgtatgatttcctcctttgactctggaacctaaataaacagattatgttccaaaaattccataaaaccataattcagtggccacggcactcctaaagaatctcattctaaatatagagaggtattcctttgcagaaaaatatcccagcaacttggttctaatatataattaaatcctctagatgctttgcagttatgttttatggcttattttgagtgttcatattttatcagaaaattataattttcctctaaataggagtttttacaaggcgtttgagttatgatggctggcgtcatgcttcagctataattaaagctgtgaaaggaaatggtggagccctatggcacacaaggttccacagagtgcttggtcctgtaatccccctgcatccgcagggccgggcccacatggccaacagtgagggcaccatctgcaaccatccctgggatagctgctttgaggacagaaaagcatgttctgggggaaggacgggaaggagagggtggctagggactcctttatatatttcttggttcagtctctacatggctggtccttagagacctcctgaccatgtcacccgatagcatgcccccacacccaaccttcccccagagaagactctcttcctcatcatctgcaatccatttctctctgcttcttcactcagttgtcagcctcgcaaaggctatgctggttagtcttttgtcagtttgacacaagctagaatcatctgggaagaaggaacctcaactaagaaaatgcccctaccagatttgtctgtaagcaagtctttgaagcattttttttaaaaaattagtattagggactgatgtgggaggcccagcccactgtgggaagtgccacctctgggcaggtcaccttgggttgtataagaaagcaagcagagtaaaccattaggagccaatcagtaagcaatgttcctctgtctaggttcctgccctgattcccctcaataatggactatggcctgtaaggcaaaataaaccctttcctctccaagctgcttttggtcatggtctttgtcatatcaatagaaagcaaaccaatacaagggccaaagcaaaggttttcctattcaatattctctataaccagcttgtgaacattatctgagcttcctgaggagaccatagtagagcatcttacattgggggactcacagaaagaaatacattttatctcagttctggaaaggctggaagtatgagtgaagtcagggttgaccatctgggacctatgtctctggcttaaatgtctgtcttctatgtcccccatggtcctctgtttgtgtcctaatcttaaaagaacttgttggttctgtatagattccaaacactctggattcaggctcactataaaggctttctttaatttcattacctttttaaaatctctatggttgaatatggggttctaggagttaggatttcaatatgtaacattttaggagatacaattcaggccataatgcttatatcagacatttaacaaatctatgttgattaagaagaacacaatgacactcacaggccttctccagacacagggctgtgcatcctctgtgcctgctgagttcctggactcccatctaccctgccttgtatacacactcacaggcctccctctggacacatgactggcatttatatgagtgcaggtctcaccatttgcttgataaccgtagatctcattcttcatttaagaggcttctttctgcagccaacagagaccattactgaaagctacaattagtcaaaatgcaaagaacaagtgaccatggggtacctatccccatttaacacatctcaacacaaactcttataccttgggcccagagaacatctaagaggaaacagaaagacttgaacagaggaccagaacaagttaccatgtcttctacatgacacagaagctgcacacaggagctctcaataatgctgttgcctaaacaaggcttgaaaaataaacggcaagaccttgggagaacgggggggggggggagcaaaaactataatcaaaatatatcgtatgaagaaatagatattttcaataaaagaaaaaaggtgacaaagcctaatagatgataatactagttgacagaccaacatatatagggaggtcttgcaatattgcagccctagatgaagagcaacagacaattactggctgctgagagagggagaattggtcttctccaaggacaagcccccagtaggttatccagtcccaaaggccagctctaaactcatatgagtagtattaaaggaactcagcatattgtacttataagtttatatgtgtgtgtatctataattaaagaataagagatcatgaatttgagaagtcagcaggagtgggtacgagaggagaaggagggggtgatgtcaatacagtactcacatatgaaaatttcaaaattaaagtcaaaaggaaaacccaatgaatactagaacacagaaccagcagagtggacaagccctttaaaacagcaatcctgaggttgctcggagggcctcacaggggcctcagggtgcacggaggctactgagttgttttggtgatgtttgcactgtgacaaggctaacagatctgtctatctgtccctggtggcctcagctgtgggtcttagatcctcgtccatggacgctataattctttcctctgtccttgcaagagaaacctaggttcgggtcattggtggactttaacaggagtattttctatgtccttcaattgtcatctgctgctgtcataaagcactctgaccgaagccgctttggggggaagagtttatttcgcttgtccttccagacagatcacaatacataactgaaggaagtcagggccagaactcaagcaagatcttgaagccgaaaccatgggagaatgttgattgctggctccctcataggctcatgcttagctagccagcttcttatacagcccaggaccactggcctagggaatagtgctacccacagtggtctgggccatcctccatcaactaacaagcaagataacctccacaaacttgcctacagcccagtctgatctgttcagtccctcaattgagactcccttctcagagggcttgattgacagttaaagctaactaggagagccgagaaggtggcattggctaacactctgcttgttgcttttcatcaggcctcaggtctggaacccaagatggtagcagacagtgtcctgttgttacgtgacagaagatgggaggaagtcaggggtgccctgatgtcttcattcagtcctgaaaagttggatgaggtaagagacaggaaacacggagtctgttccttaaggacccagcctctccctcaaagtatggcaaagagctagaccaggcttgaggcttgcccaggtggcacatcaaagtgtctcacctgcgggggccctcggcctcatcattacacagaaagcaaagcatcttccatttctctggcgtctcacacacgcaggtagcataaatcaatggttcgcgctgcatacctggctgtcccgagacacagctcgaggcactttgaggcacttaggagagaaagtagaatagtgtttctcatgctatctcagatgtttctcatgctatctccggtgtttctcatgctgtcgtctcggataatggactggctggggagcctgtgcagatgcaaattccctcccaggaggctctgaccaggtnnnnnnnnnnnnnnnnnnnntgaacttcaaactaccagtcagggaggatgttttctgaatgttgaagcactttacaggactgagtcctgagtgatggggggcagagggcgaagaaatgttctccaagcggaactctaggtaggcagccagactaacatcgtccttaagacaaatttagagcgaccatccagctccctgagatgtcatgaattcttgaagactctgagcattctccatcctcagccccgtggccctcccttccctaccaactgtgcacttaagagctgggggtttgcattgcctcccatttctccaaccacttgtggaagaaggaaatggcggacagggcaggctgcacaagtgtgtcctcacacctccttccacagcagatgtgaccctgatggcttctagatgcttccttgaacctgacacctcctggttctcgttatggaaccagagccagatcacaatttgttggcttttcatcccagcattcatgaggtagaggcaagagaattacaaatttgaagtcagcgtaagttttgtctcaatgaggccttgtctcaaaaacaaaaacaaaaacaaaaacaaaaacaaaaacaaacccaaaccaaccagccaacaaaacatgattcttcctgctactccaagtccatggactcaaactatctaaggtagccgagaacctgtgggcttcatgagccgcttcatgattctactacagccaggatggggcctgtgtgtgtttgcttggtcctttgtcactgtacctcaagtctgctgcttttccaggccctgccatttctttcttacttctctcagtgactttaagggtccgttcagtttacatatttactttgtttgttgtgtgtcccatcctgctgcatgggaacaaaggggtgttttttttttttttctttttcatgttatgttccttttttaacttttagctgcctacacagggcgtctaacaggcactcagtaatgatgactcaatgggtggatgaaaaaccaaagaactaataagaaattttcttagttgacaaaaaaaaaaatcaataaaaaaagaaattattttatcaagaaaaaatattaagtgactgtgagagtatgctcatcgttaagagtgcacgttgttctcacagaggacccaagtttgggtctcagcatacatgtcaggtggcccacaacctcctataactccacctccaaggagctggatgcttctggcctccttgggcagccgcgcttgcatgcacacacccacccacagacacacacacacagaactgagaaggttaagaggacagagcacattgttgtctttctccttgcaaactcacaagccgtacacatgaatgtagaaaaggcaggtcataaagagaccaaggggaaggagtcagcgcagggatgcagagcccaggcacaaagctgcacagagatcactgtgcagcctcggcattgctagtccttcctgaaaacgtggcttttgaacttttgccaccaaacttgagagtttatcacctccccaaccccaaccccagggcaggggttattctaaataaaacaaatcctttggctccttggcagctacggtcttccttacctacacccatgtgccacccgcctccttccctaacacacacaccctgttggcttccggaggctttcttaagactttgaacacccatccacttcatttatttaatgtaaggctgcctcagtccacagtgcttagaattactttaggatcaacgttatgtatgtgcacacacatgcatgagtgtgctcatgtacgtttgtgtggcttttatttgtttgtcagtaaaagctgggagtcgagtgaggtcacattttcacttaaaactaaattgctttttggctttagtcttcctgaggataaaatgcagtcagagctagagcgaatgtgactgatgcctttctacttctggtagaagaggccagcagactcatagtccgatgatagactagtgattgggactgacggagcaggttactgaagactgctaagaacacaactgatttttttttttttcatagaagaaaattttgcctggttaacctggaagattttccacccattctccaaaagtgtttgtccttttaaaagggcagctgggagatttatttaagccttgacagtctttcagtagatacctcaccaaagactgtgagtaagactggaatcgtgcgcagttttattgtgaatcaggaagtaaatggacttaatttcaggaaacgaaattgaaattaaatccacacttctccaagggaaacacataaataacgggacgccctgggtcaggttagtgcttattttatttttaaatgtcataactcatcagaaaggggagacacagtggaaactgtgcatctgtgttttccgctgaactctttcaacctgaagggataactttcacaggctctcgtaagactgcataagtcagcaggagagtggcaggtggctctcgggtacacacgtggggagagcgcaacgaagaggaagctgacaaccaactggtggcttctgctaggactgggatcctaaaggcctcccaagggactgggtggtaaaggctaggtccccagtgtggctctctgggagtcgactggaggcgcatccaggaatgtggcatcccagacatctcagattccttcccttgcttcctggccatgacgtcagaggtttggctttgacaagaaccccagccatgacatgctgtctcaccacaggcctgtatgatcacagaccgtactgcccaaaaatgggagccgagagaaacatagcctttgtaataaattggttgtctttgatgttttgttgtagtggcagaaatctgagtggtataactaccaaggagagggattggaaatcatggaggattgaaaggcctccatggttgaataactggataaaatattacaaactattagattcatcacacacttcaacctgttagaaagacatttgattatcagtttagctttgcttattctggacacatagtttttcagaggtaaacacccggggagttaatgccatagtttgttattgagtaaaatggcattgttggatagtaggtcttttgcagttcccactgtctagctcattttctagagcttcaaggacaacaaccccacatccatcatacgagccaactttgcatcactacaataaaatacctgggacaggtaacctatcaagataaaaggtccagttaacttgcaatttagcaaagtcaaagtctaaaatcaatcatctctgctggcttggcctccggtgagaacagcagatggtggcatgccattacagagtgcctgtctgaacaaatggtcacatctagaatcagagcagagacaaagacaggccagggtcccacgagccccttcaaagtcatacatgcccccaataacttagctattgaaggtccacagcacttcttaacagcacaattctaaagaccaaacctctacacacagctccttagtgacacttaccagtcaacccctgttaggcagcttatgtgttttgtcctcaggatcccctgccaacggtgggcttgtgctcatttacccagataaacaaggactgagcagatacaagtgaccagcgagaccctgaggatatggttgtcacccaagagtgaataagccactcactcacacagccgcgcacaggggcctgtttccacaacgtggaaccggcaaggaaggctggcatcttgcacagcaccgggggctgcggctctctgtctaatttttcactttcatccagatgtttcctgtcgggaaggcagagtcaataatgtatgagtcttataggtagaggcatatgtgcttattacaccccatgggcctctgctgcctgggagaagacatatgactcaaaaatggctacgatcttttaaaattcaagttgatacagccagcttatgagtgaacgcatggcttggaccgtttcagtacaagagcccgtgcgcaattacggtcattgtcgtggctttgggctttgtctggcctttatattcccagcacaaactcttcaggcagtcagtacaggggcttctatggcagaagtgagttttccactggaaaaagcgctggagcaagcagctttcccttggcagcatcggctgccggcggtttatttttaatatttgcttttatttcttaatccttccaaacaataaaaataaaagtcattaataaccagggtagctgtggcaataaatacttcagagtctaaaaatacattgtccctgcctgaccagttacccattttccagggtatctgagtatttatctagcagcacgagaccattatcctgagacacagttgtatcccactgacacctaatcttctaattaaaatcagaataatgatggactgtttaaattctacttttaagtgttcattttccatttgcatttaaaagaaagcacactcctcatcatcgataccccatcctgggttataatttgtctttcttttgctggaatcataatgtcactcccaacttgccgctggttaaatggagaagagcatcaaaatgtgctttgcagcttggctgttgcttggcaacctcagccgccacctcctcactggagtaagttctaattgggcacaactcttgacaggagtctctgacttactggaaatgacacttgattattcatctaggtggctggagctgatgtgtatcagtagggaattttgcataaaaatgactcacggatgtttttaatatctctaggtggctttcagcaatggcatagtggctgaaggaagtgataagtttcattagctagaattaatttttcatttgttagtcaacagctagagcacattgcaaggtattcctttttaaaggccccttcagtagctcacgtattcagacatcacccccctctaactttaactcctaaacatggctgccctcaggccaactgtgatagtcagagctgagttattacagtaaataccattgataatcaccatacctccccccaaaagatattttagctcagcgttctgagcatcccagtccttgactgatggacatattgccttcaaatctcttctgagtaaagggggcagcagtgcatcatggagggagcacagtcagggcacaagctctctgctggaagccaggaagtgaaagagaagacagggaagcggcagaagccatgggacccccttcaaaggcacatcccaataactggcagagctcccaccaggcccaagagcaggaccaaacctttaagacaaaaacctttggggaatagtccagattcaaactatggcaccaaacagaagaaatgtcagtttcttacatgtgttgatttctgcctttacgaatgttctagtgtggtagtgcagcatgatacataaattactgcataaagaccaaggaagggagggcggtgacagagctcctgtcttgttttgaagaacactgatgttaggtttgggcaggggaaggttataaggtaggtacacaggcacctagacagagcaatacagggcttgcttgcagtatggggagctcactcaggctgaaacagagtgcgcaagagaggaagcaggggaaaaggattgcagaagtgggttgaggctcgcagaggccgctgccccgtgtcagaggcagccaactgttaaatgctcagaagtggaggagtgacttgctcagaactctctggagggagagagcactccattttgctgtttaaccttcaaggggtcagatgtccccagatacatgaggcaaatccttctggagcagatgagaaccgcaagcatacctctggttaatttcttagtctttcttcacacaccaataaacaactggcttagctatacaccatcaacatgtggggctcatataactttaacagcatcatgtaactcaagagagccttcctttaccattctctgaacgggaaatgcttttcctccaacactcagtgagccattgttctccaaacttccagacatccaaaggcttttaaatgctgagttgttttggctttttcctccttgagttcatgctatcagacctgcggagagtggggttataacctaagagtagatatactgaggggcggaggcactgtggcacctggtttgggtgagaaagcaacaggaattagattgtttgacatccttagttctactttcatgaaattatttgaacacagaaataaccaggttccatcatcatggaattctaaagttgatgtgtcaaagagatgaaaatactttttctttaaaaaaaaaaagtatgaccctctactgacccaaatgtagaagatggttacctttttcccacgatttcaagcaaattcttaagtgttggctatgttttgcattgctgtgccaaaccaccacaggacagcaacttaagaagggaaagttttcccctggatcttagtataagaagggacacagcccacgatggcatgggaggcacagaggctggaacaagagacagctggatacattgcatgtgcaattagtaaacagagagtagagaggaagtgaggtcagcctccagacacgcccccagtgatctacctcctccaggagttccaaaacgcagcaccaccctctgcagatcaagtggcaaaattagatatataacatatatattataattattatatatattataatatatataatacaagtaagccagctgggcatgaagatacacacctttaatcctagttttcagagacacaggcagacagatctctgtgaattcaaaggcatcttcgtctacatagagtatcctaggaaactcaaggctatggaatgagaacttgtctcacccccttaccccacaaaaccaaaacagccaaacaaaagaacacatataagtctccgaggagatgttttacactcaaacaacaataaatggcttccttgagatcctagaatgtcatggaatgggacatcatagttcattataactagaacatgtcctggggtgaggaacccaaagtcagaaagattcagataccatgcctggaggaagaagtagactccgtgtgaatctctggtcttttgctcagaggcaaatttcaaaaatctaccctgagctcatgctaagacaaaaagagcctgttgatgggtcctgagtgcctttaacatcaacacattaggttatcacttagtccagtggttctcaacatgtgagtcagggctcctttgagggtcaaaggaccctttcacagaggtcacctaagaccatggaaaacaaatatttacattacaattcataacagtaaaagtacagtcatgaggtggcaataaaaataattttatggttgggggtcaccacaacacgaggaagtctagtcacagaactaggaaggttgagaaccactgacttagacacttctaaacaatcaactgagtaaggaaacaacggtatcaaaacaatttttttaataaaaagtaaataaactgtcaatagaagatggcaacctataaaagttaccttaaagaggggatattgaaaacctgctacctgttactttgtaacaactttacccaagccttgctgcttcaaacaacagacctttgtttctgtaactcaagcttcccgcacagtttatctgggatcctctgctcagggcctcttgatataatgatcaagtttctagtctggtctgtggtcttacatgaaggattaactagggtacacttgctttgaagatggctagccttttctgcagaattctctttctgtgggctcaaagagacagctaagaagcttgtactatgtccttcagtcaatgaggatgctcagagcatttcagcaaaatgaatatacaaaacacaataattttagaagatgggtgccacgactgggtttcggggtgcattgggaagtaaaaagacaacaggctcttgggccggttggtttagaacatacatacaggtcagcttccggacttagatgtcaaaggtgcttaccctatgaccttcgtcctcaagaggcagaatgacagcaacattccagtgacaaagtctgaaccagaggaaggagggaaaggtgaagggacacaagcagcgttgacatagtgagaccaaccacgagggaccaatggggagctgtctgcgaggaagaagagatacagagaattcctgctgtccaaaccagcctggggttggattctccataagacaggtgctatgtttggaccactcctgactactgctaggtgctttgcatattttgtttctaactgtggttatggcacttcaaaggtggcattatttttcttgttctgctggtgacaatataaagtcgctacatttaggccactggaaacgaattatgacgttccagggagtggagtcatagccactggcaatgactttgagtgcttgctcctcttggagccactggacattatccaagtcaaatccttccccctcgaagaaaactgccaaaggtgggattccgtagagcatcaaaggtgttgaagaatgcttctttgagaaggggaatgcctgaccttttcttggtcgtctccctgtaaggtgcctcctctgtccactcctatgaattagactccacccacctgctttctgcccacactattcttctgagacagctggtcaaattctttggaaaacactgggcactgattgaatttatataataaactccaggctaagcaagaacttccttccttggggaactttcttcctaaattgagggctttattttcagcaactacggttaccaaataatcacccagtcccactctccagggacaacacaggcttggctgctggactgacattctggccttagccaactcaagactgtagtagcaaaaatactatagactggtttaaacaatagagaagtgttttctctcggttaatagagactaaaattggacaacagggtccttcctagcaattgtggcttttggtggctcctcttttgtggtttgcaggtggtcacccatcattctatgtgctcacaagaacccccttttgagacagtgtctcactgtgtcgctcatgttggccttaaactcactatgtgccctttgccaacctagaagtcataattctcctacctcagccttctggatgctgtaattacaggtgcacaccatcattccccggatcaatcttatgatttcatttagcgttaatgatttcctgaaaggccaaatctccaatccagctacactgggaattagatcaacagcatatggatttcaagaggacacaaacattcagtccacaacgacacccagatgaaatccatttttaaaaccaaatggtatcaatattttatgtgattaaaagtacaacatatgtgcatcttgaaaatgttgggtaaaacaaaaataaacaccacccattgtgctacagagatggaacacagcagaatgggaggcaggcttgggatctgggtgtagagtattgtttcctctgggcttgggtctgtatgtataccacatctacctgctggtctgaaaacgcagggagggagctgcagggtcagcccaacccacagagcctttgctcgtgtattcagctcacggaagagtagaccttctataacagtggtacctaacgcaaggggggaaataagatgatggcaactggccaacatacgtacggaccatgctccgctgtcttgtgatattttctctgcattacttcttaacattttcatcatgcatgccccatctcatgtcacattaatccagattaaaatgtcattatccattcagtgtgacagacagcaggcatggcatggaagaaaatctgcaaccacatcagccagcatcaatgcactgtagccaagtgcacatgggagaagggatggtaggtaactggtgctctgcatcacccaggcctgcacttaagattcaacataaggggctctcctaatacacaggccatgctttcagcttctgagaagtttgtgtaagtcaaattttatacggcacctctcttgctagtataaggatacttaatattgatgtctaaagagacctcattgaaacaagtttttttgctgttatttttttttaatattcctctgacatttattgaaaaatcctggtttggtttggtttggtttggtttggtttggtttggtttggtttagttcaagacatggtttctctatgtagcacaggctgtcttggaattcactctgcagaccaggctgcccagaaactcagagatccacctgcctctgcctcacaagtgctgggtttccaggtgtgcaccaccaccacccagtcctatctctagaatcttattaaaataagattcacttggaaaactaagtttattgggataagtaaagagactgcaaatggcttaccagataaaggtgcttgttaccaagctaatgactgtagtttcttctctgggaaccacaagacagaagaagaacccagttcctgcaggatgtctctgactcccacgtgtatactgtgcactcgcacactcacatacatgctaagtagcaaatgactgcaatcagataagaatggcagccagagaagctggctagagagacgtgcttagaaagcattgagctctccaagcattaaggaagtcaggtttcttgggaaggatgcctgggagacccacatttattcttatactgatggactattctgtggccggtttgtgagagtttaaaaaagaatgcctccatcataaagaattgatacagggtcactgaaaacaaatcaggctcaccctattcatgtctttcctggatagacttaaggacaaacagctggggtcaataacactcctgcttcagccaaccactgacaaggtgggtcatctgccgattacagagaagatggtgccaggctgagtacttacttaggtttatcctgactggtcaaagtaccttgaaaaattctgcagctccctgaagtaactgtccagaggagggtcatgggcctgtgcttgaaccaggctgcatagtcatgaggtaaatgaaaacttagatagcatgttactgtagtttaaagggaacaaggaaggcatggctacgtgtccactttgagttagagaaatgcccctgtgcctctcagacccgttccttcctacaaggctcccacaccactgcaggtaatgagaagctggtgtcatacatgtgtccccataggacatgtggggccggctagcaagaagctgtgacagggaggggtccattctcccagcgtctcaatagctgtccagactgccccactcactgtccaggggttgttcttcccaggacagctgaagacaactttttatggaaataaaggaagtagaaatgcaaagcctggagctggagtgatggaccagtggtcttaagcactggctgctcttccagaggacccgggtttggttcccagcacccacatggcagctcacaactgtctgtaaccaggggatctggcgccctcttctggcttcctcgggcacttcatgcccatggtgcacagacatatctaggcaaaatttccacacagataatttgttttaatacaggaggaaatttttttttaaaaaagaaacacaaagcctttctaaggaatggagcctcaagggctgaagaatcagttgcatgcagcgaaagttatcagaaaagacctgtggctttcattggcctgaactttgacatttgtttgtggtgtgtgtcttgtgcaaaaatcaatatacatctgaccttgctactggcttacagggttcaggtcgcagaatgtgattaacttactgtttactagatagtgcctgaaacaggactgtgttccacctatgggttgctatttgagagtgactagttttttcttcccagaggaacaataagaatagagagaggccctgcccttaggggcgttgtaggtgtggctgctgtatcaccgatgagtcataggtgacagagagaggctatgtctacactcagtgttctgatccgtgaacatctgagcgattagtaacctaacatcccttgaaaaaagtgagccctgacaccgtgctaggtggctccctagaccgggagcaaaccagagactagaaaaaccctgtctgggaccaaaggctgtgagtctgagacagacaacccttgcaaggggatactcaggcaggccacgtgaggagctagccagagttgaccaccagactggcaccatggggtccaggcaggacactaggctatggtgactaccagtttggcaggcctggtggggggcagaccatgccaagatggcctctacccaatgttataatgcacaagcagggcataacagtcctgagaccactcctgagatgaccccagacactcagagactctgggtgccactaagaggatcaagtaagtggtggaggaatagaagagaaagagaaacagaaggatgtgggcacaatgaagagaggcagagctggactatagggtagtgagggacagcctgatgtgagtagccggtgataccacctgaaaccatggtaagatcctggcctgtggtgccactgggggccacatctgggtccatagctctgcagcatccggggtttgttatccccaaaggccgagtggatgttcctggtctgggctgctgcgggcgatatgtttatgtctaagggctgtgcagatctggccccatccctcacctgggcatcatggaacagcagactctggaggcatgagaaatggagaactgagcctgaccctagctgactgcggtacttgggagagcagaccacacacattacaggagttgttggctagctagcctagaggatccaagtatgggagagctgtccctaccgttcttctcccttatggtggcatagacaagggaaagatacccttctccccccccccaccatcggtgaccagcaggagacccagctctagggtcatgagagcaaggagacctggtccctgtgtgctgacataactgagggagagatgtcccccacctcacaccttgttacctacggcagccaggagagctggcccagaggtcatcagagttggggagctgtctccgcctctcacctgttgtaagacttgggagagcaggctgtgcacctcacctgggcaatacccagagctggccctggatgtggaggtgtcagtgagccagctccggggacgtgcgtgcaggagagcaagtcttgcctcttgtctgctgggcagcggtgcagatgaggcagagacatcctcccctcctcccttatccctctccatctacagcagtcaggagagccagccctgggatcatgagaatgggagacctggccatgtccttcaccaactgcaacacttgggagagcgggccatgcaccttgtctgggcagcagggtagagctggccctggttgtggggttgctggtgacctggcccagagggtgtgagagcaagagagatgttgggctgaccagctcagaaacccctcaggcccagatccagggctgtgtattggcccatcgcaacatcttccccattgctaaattgctggaatgcatgaaggggaaggggcagtcctacagatccaaaactacaggatctccatgacacagggcagcaacaggatatccaaggggagtcctagtgaggttccagtactgatagaagctagaggccttgttcccgaccaaacacaatgaacattgcaatgaacacttgcaagcaaagaagtatggacaaaggggactcactgtgacactatagcttccacaatgagatttttcccccctcagttaaaggggaagatgcaaaggtggatgcaagtaaaaaaaaaaaaaaaagaataggggctggagagatggctcagcttggtgattaagagcactgactgttcttccagaggtcctaagagttcaattcccggcaaccacatagtagctcacaactatctgtaatgggatccgaagccctcttctggtgtgtctgaagacagctacaatgtacttgcataattaaataattaaataaatacatctttttataaaaatgtttgaaaaggaatagagaaaggtgtacaaactatgaaagcagagaggtttttgtaacacatattagtcagcttcccatcattataagaaacacttgttaaccttcagtgtagaatgaggcaggctgccatggcacggctcacaggtttggaggttttagtgtgtgcttggttggacccattgttttgggtctgtgatggcccgtgatggaagcacatgacaaagccacacccccaggccagaagtgaaggagagaatgagtaaaagccaggggcccacagtctactgaaagaaacatccccaaaagccgagagacattccagtaggtccagcctcctaagagctcgccacctctcagtcatgctatcctcaggggatagatacccaagatccaactgtaatagagggggctggattttgtccccatccaatgacatatttctggtaactagattaacatttcataatttttctattgtctcaagacttgaaaaaagacttgaaaaagtagatattgcatgctcattaaaatccatctacccattcatccatccatccatccaacaaatgagtacatatgccaggttctgttgcatattctagagatttaaaaaaaaattgaacaaacagatgaaacctcccctgacctcagactattctagcatcaaaatagtgaaaaccagatgctagagggacagcccagtggttaagagagcatactgctcttgtaacaaacccaacttcagttgccagtgtgtgtgtgctgtgtggcttacaaccatctacaacgcaagcttcccgattccccaagaactcttccagtgggtacctgaaatgctccctgcactgaacacacacgcacataatcttaaaagtaaaatagggggtggagtggggggtcagaggctgagaacacttgtcactcctgcagaggacctaggttcagcttcagcacccacatggtggctcacaaccacctgtaactacagtttccaggggacccgctacgctctgacatctacaggactaggctggcacgtggaacatacacatgaaggcaaaacactcatgtgcataaaatcaaataaatctgaaaaaaaaatttaatttaaatacagttttaaagtttctttctaataatagtaataataatgaaaaccaaacatcaggcaccatttcaaagtattagtcccataaatgctcagaagaacctacagcagtattctgcctcagatatgacactgttctaggatgtgtactcagttgaaagatcccccttgacagttccagcctggcccttcaaatatataggagagaatgaaagcccttaaagagtgctacccacccaagagaacgtcttggacgtcaaagggacgggcagccaagcctgctgtctaaatgtgctggaaccacggaggtgtgcacagcgctgctctctagatctttctctgggcattagaaattttccacaataaaatatcttcttaatgttaagaattcaacaattcctcgtgcaggtcaagagttaccctgtcttggaaggcgtaagcagctgaaacacagatgaaaacccctctctcagaaataccattaagataacttctgccttaattaagaagttggaacagatgaccctcagtgcctccggatactcgagtctatgttctggtgggagatctgaaaacttaattggaacaggcatgcacggacttgggctagttccagggccaggacatatagagtgtggtctacttgcttgctaatgctcaccacacgccaggaagccaagcaccgatttgaagttttgtctaaacacttagtgatagctttcataattatttcaccagatctacgtttggtcctttctcctttggtgcatctaccccagaaagctcacttgagcttaagataggcatttatggacactgtattttacaaatattatgaatactttcttaatcttcgcctcgtgaaaagcacctttgaaatacagtctgtttccctagaaagcactgtggataaccttgtccatcattggcagccaatttaggcacgatgccctaattatacctctgctatctattatcagatgacacctctcatcagccaagcctgtgaacttctcgtggctcacttaaaacgctatgcagcatccagggacgcattcaacatccagaggtaaggctgctccattacaagtgagaagtcacaattctgagtggatgatccttgcgacagcacataatggctggacaattacctcgggagttgcaaaccggaagcaccagtcggtcataacggtgtgggtagactgactaatgagaagaaaccccacctaaaccacgaagcaaagtaacttgagccagggatgccagcctagtgaggaaaattcaaatgtgcggtggttagtgcctgagtagacttagcctctggtctccaaggacatgatgggcaagatctgccagggcagaagggacagggactttcaagaaagtacctaaactttcacaagaaaaataccgaggccaggcgtggaggtacacagctttcatcccagcacttgggaggcaggggcaggtagatctctgagagtttgaaggtcactggtctacataggaagttctagaccagagctgcacaatgaggccctgcctaaaaacaaaaaacaaaacaaaacaaaaacccaaacaaacaaacaaacaagtgagccatgaggctgaggctgagcttggttagtaaaatgtgtgcttggcttgagcaaagccttgggattgatcgatcaccagcatcagtaccacatgaagccaggcatggtagtacacatctatagatccatactctggatattgttcacgtggggaatacaaggcctgcctggaacacctgagactctgtctcaaaaaagttaaaaattaaaaaagataatgtaaataaggtatattatctgacccactacagaaactaaggccagaagaacacaagttcaaggcctgcctgggctacagtgagtttaaggccattctgggtgctttagtgaaattgtttctcagaataaaaagttaaggggctggagagatggctcagcagctaaaagtacttttttgctcttctagaagacccgggttcaagtcccatcatccatgtcaggtggctcacatctgtctgtaactttggtttcagggtatccggcgccctcttctggccgctgtgggcactgcaggcatgtggtggtatatatatatatatataaatatactcaggcaagcacttatacacataaataaacgactaaatctctaaaagtgaaaatggtgattggctggggaatatagttcgaaaggataaagtgcttcagcatatacgagaccctagattcaaatctcagttcagcttaatatattaataaataaataagtagtgatcgtttgtgcctagcagccacagctcagtggtgggcaggagagtggtgttaggtgtatatagctggcaatttaagcaactgactgacttttctcctagcaacctttagatgctctaagctaaatcatggctggcagcagactgggaacagaatgactgcagatcagccacagctgactcagaatcatcactgccaacagaactagaggctagtcaatggcagcgtttatgttgttcccagctgtcaacaaaccttctcgcccacactctcccagagtgtaagataaggtggccccctctgctattaaagcaaagcaaataactcttcggtcctggaaccctcaagcactagggtctgctgggatcgcactcaggagccatgcacactttttgcatcaatggggaatcggtgaccaatcatagcaatgttttcaatataagtcgtcaacatttcagagtcatcaagtgatttattctctagtgataagctggtggctgtggggcccatgcagaagaactaactgtatcaatgacaagcacagatgttacagttgtgaaagagtatcaatagcccaggtattagactccttagaaaaaatccttaagacgtcaatgcctgtaagaaaacaaaaagaaggattgtaaggaccggggaggtgactcggaggccaacggtaagctgagaaagcttgctgacccaagtgtgaccctcaagacccacacaaaggtggaaggaaagaactgataccaccaagttgtcctatgtcctatgtgatgtgcactgtgacacacacatgtataccatgtccccagcatgccatgcacacactaacacacacacacacacacacacactgtgcaaatgtatacaagaacaataaacacataacacattttgtgaaagaatagtgctagtttaaaacggcattgggagggacaggcttcctatcctggggttggttaaattttctgatgccattggaagacacttttcctcgtgtttgtttgaaaaaggcaatatatacttccagtagtaaattaaatatatcttgtaagccttccccaaagtttgtctactatccatttgagtaagaaaagaccttgtttttggttgttttttttttttgttacacttttattttttatttattatttatttaatgtatatgagtacactgtagctgtcttcagacacatcagaagaggacatcagatcctattacagatagttgggagccaccatgtggttgctgggaattgaacacgggacctctggaagagcagttggtgctcttaaccatttaaccatctcccagcccttgttgcaccttttaaaatggcaaaagcatcaggtatcgtgacacatatctttagtcccagcacaggaaaggcagagtgtactcagggcagccaaatcattagaaggaaaaatggagggtagctaataaaacaagctaatgagattgattcatcaatgccaatttgagagctattaattaatcattagattctggcctgagatgggctatgtgtgcataggggctaaagcccctaggctttagggctcctatttcccttcacaggaaggcgtcctcccactggaagatatgtgccttagtgttcaactctgttctaaggcctgagttagtgatgtcctgccctcaccttctcttccataagctccttgataaagcctccaatcatattctgctattgctgctcatccaggaagtgtcccttccactacctcaggaggggtatgctgtgggaagggcaatccagcatctttcaattgtccgcatttctatgtccacaggtgttactgctgttacaccatagatgtggtggccagtgtggcctttggcacccaggtggactcccagaattctccagaagatccctttgtgcaacactgccggcgtgcttccaccttctgtatccccaggcctctcctggtattaatctgtaagtgcagcccctacccaaggtagtgaggccagatcaccacccataggacagcttgcagggttgagtcccttccaccaggaatggtcccaggatgttctctctgagacatccctcaggaactttatctccctagagccactagaattctcttgtcacaatctggggtgatttatcaccaacacaggtaaccctggatcctgtttgataatcctaatgagaaaggaaaactgatacataaaaaggcagtcaagacttgaacccaaagtctctcatttcctagggttggttggttggttggttggttggttggttggttggttggttggttcgttagttggtttttgtcccatcactcaaaaccctcttatgaggacttctctaccagaagccaacaactcctaaacatgaaatcaacagatgggtcactggaaggaggcttcatgttaacaagactagaccattggattaattttacaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattagaatcatggaccatttgcttgcttttcttcttatctctgagccagtttcagcaggaagccctgtaacctctaacatcagcacactgaaacctgtaggcatttgtgtggagtcacgcagcctctttgtgtccaggaggtctgctggggctaaggctgccccacctatggactttcaattatagacaggccttccactaacaaggcccctgctctctacacttttaaacagaggtgtatgagctctgggatctcctgtctccagcctgactcaacacaaaaggttatgtgcagcttggcaggctgagagtcagtagagtcacatgcccctgtggcaaggcctcatccctgggctcagaacatctcctagggaaatattaagtgtcctgatcctgggagccttctcctaagaacccaggctgcatattgcatggcaggggaatatccacaatagatgaagccagtgtccttgtcagcagctgcaacaacatgttttagggacaattcagatggctgttgtggggacatttatccagataaagacaaatacaaatgaccagaaagtcaataaagtagatggtctgctatgcccctgtgacggcttggcacacagccagttacccattctgtcctgatgaactgcaaagacacttccccctctaaggttggagataagaatttctaagtgtaaaagtgggtttgtaaggccaggtacacacgaggacttactttattgcacaggcatttaatgattgcttatgatgtacagggaatggaacagaaagctagagtcagatcaagccccactctgagaagcgccaagtccacagggaagacaggcctcccaagtggctctgattcaaggctggtgcttgcttcccagccacaggagtctaatagccctgcttcattatcactcccccttcaacgctacttttgtttttctctttcaagtatcatttccatccataatggtcccattggcccggattctgcccaataagaaccgagatgaactgaatggcttttttaacacactcattaggaatgtgattgccttacgggaccagcaagcagcagaagaggtaactatttttataggacacagcctggaaacagaatggaacctaatttggcatcactctctcttttctttctccattcccccacaactcctcacgtcacatgggtctctcctttactagtctcccattctgagctttccagagccagtagaaagcaatgggagggaggaatcggaaggataataggagaagtcccaccaatgggcctatccctgatgtgagttgttgaatggatgtcaacccctgactgtctcccatcacctggctcttacccccaagcaaaggttgcagtagcccaacccccaccccagaattttctaagtcagcacctcatgcaattttcatgagcatagtctttctgctgaaaaacagcaagatggggctttatagcatgaatagcataaatattagcaagaagtttaggcaactgtcaatcaatcccatattccctttcaacatggagactcttgctagaaaatttgtgattgaggctccctgctctctttagcaggctgccgtgtttcccttttcccttacagactcacaccctgcttggcacatagtggggataagtaaatattggctgaacttgactctaaatagtatgcggttttcagtatgagaaataatcttcctgcatcagagatactctttgtccacattaaagttgtccattatgggtctcatcacactaaagacagtcacaaaaaaaaaaaaaaaaaaaaaaaaaaaggactaaaagggctttcacttaactgccttgagcaagatgaagctttaaaagggttttctcaaagactgtggctcagagggattcgtgaggcctgatggttaaggcattggcctagaatgaaatccaagtcaattagtagcttgatgcatttagcagccttgggcagcagcctgtcctactcagctgcacaccctggggactctgtagcaactgtgtctggatagggaaggtgtggggacgtatataccagctctcaaccccttggcctataccttcatcagctccacttgaatgtccttagaggtgggggaaagtgggccaactggtatacctggccccactctaaagccagaaaagccaggacaatttcattcaagtatatgtttctagtgtgtgaggaggaagcccaaaggacaagagataaagaaccattttcttttgttgttgttctttttttttttttttttttttttcgagacagggtttctctgtggctggctctcctggaactcactttgtagaccaggctggcctcaaactcagaaatccgcctgcatctgcctcccaagtactgggattaaaggcgtgcaccaccacgccctgctcaagaaccattttcaaacctcatcatttgctgcaaagggctaccttgtgagagctctttctctctctctctctctctctctctctctctcacacacacacacacacacacacacacacacacacacacacactgaaacccactggctgtaaaaccaagctaaaaattaaaaaaaaaaaacaaaactgttgctctgagtgactgagaggtgagaggttattaaagagccaattactgggattgcctcaagcttttccttctataaactttacagctatttgtttccaacaatgagttgatccgagaaaaacctcccaaccacaaatccagggctgcccatgtcaagacagatctatacagttactaagaaaactcacttagaacccttctgaactctgtatacattccatcaaacagatgtgtgtttgcacagtaaaaatgccgcacagatgttaaaaggtaaatatttttctaagctcgagccgatgggtggattagacacctacatctatcaggacaagtatttttcttggatttgaccataaagcagccctgtttccatcctaaatgggcagcttcacatggccttcatgatgctctgtgaatgaaggaatcccatctgcactaatgttctgtagctcgcaagccctagagagaggccctttcccctggcctcgttagctagcagttaagacagatttctgcaagacttcaccagcccttttagtagtctggctgggctgggatgagaggaaagaatggcagccaccatgccgcttctggaaaaatatgtggtgtagatatgactgtgagctgtcttgtcatcgccccatccacccaggaaaagccacagccaagcctcagggactaagctatgcagcctaacagtgcactttgcttctccaatcgcatcctggcacccagggagcctcggatgttccatttcgccagggccactgtgacaggtcagcagtggaaccacagtagccacccagatgctgaccaatagcagttaagaagtcatttggatagaaaatggacaggctcagggcacagtgaggaagccctggcttcctatagtggaaacaggctggtaggaaatggagaccttgcctcctcagcttcaatgtatgtaaacccttagtggtgagcagacacctttgatggtcactaacctcttcatctgcaaaggcctcctgctccaaataacagttgaacaggtgaaaccaaacccaatgtacccatccctgagggtacctattgctttacattaagattctattgtgggctggtgagatggctcaatggttaagagcaccaactgctcttctgaaggtcctgagttcaagtcccagcaaccacatggtggctcacaaccatccgtaatgagatctgacgccctcttctggtgtgtctgaagacagctacagtgtacttagatataataataaataaatctttttttttttaaagattctattgcatgtttaatatgcacttagcaccacacttggcacaggccgggcagggagggtaggaaggggaggggtcacaccctcagattgcttttcatctcatggtgtagaaaaagtagccacatatgaaaatgccaacaaactcaaaagatggagttccatgccaatgtgaggggcatagattattcatgcaacagaaatttcagaagccaatgaactgagaaaacaccacaactaggaaaatactttgaaattataataccttcctgttgcaggttctggtactctcgtcttgctgttttaatcccataaacttcagaaaagagcaacatcctagttgtcattcatcacattaaaggacatttcaaagaaaggatgtgcctggaatacactctgtgaatgccaaagccatggtaaacactcctatagttagaattagcctagtcaaaatgtaaaggatatgcaaattactgataaggaaggtagagggaatgataaggcagctttaagcactcaaaggagatggggattactgaagatagaaaaaggggttccataggaagcagcctgctccggtctgggggctttgaagacaagcttcactcaagccagctcgcccacattccatacccccatcccatgctgccgactgtcgactgtgtgagaaaacatacagccatccactatgtccttgcagagtaagtggtagacgtatgctctgatttaaatctatcaggtgttttctcattggaaattcagccaatagaacaaatgcatagaaagcattaatcagaactacaagaccttggttttccccctcctccagctctagggatctactgaatataggttgacaaatgtttactacacacgagcggatgcacgcagttctctagattgtacacttactgtttttaaagatgagatcccactgtgtctatggctctaacacttgctttattttaagcacagtattttgggggaatggggagcgagtcagcctgtaatggaatgacttcatccggaatacatgaagggagtgtggtacataaacaggaaataataatatttggccctataaaagaatggaatctgttggttttcagctacatagttaagacaatgaaggatgatatgttaagtgcaataagccaggaccagaataacaaacacaacatgcttgttggggtatgttgaaactgaaaaatcaaatctcagaaacagagaaaggtggtcactggaggctggggagggtggaggaaagggaagggaaagggtgtagttttgtacccaagccattatgggtaagaggactaagtctggtgttctccagctcagcagagtgactatactcacaggaaggtgtgactattctctgtaaataactgcaaaagaagagtttgaagattccagacacacacaaggtacacgtgatagatatgaaaagactctgctctcactgttacatactgtgtgtattaaataatcccacggttgctccacaagtctgtacaatggcaaagaagggaacagtgtcatctctgcactggggcatcagttggctcctcactgctgtcattcaggtggatactgactcttgccatctcagataacacagtgaccaagacctattcctacttagctattcagaagccactcaggagctccccctaccctgtcccctatccccatcctgtggctctaatgtgcctttctctttcctcctcagaggcggagagacttcctgcagatggtgctggatgcccagcactccatgaactctgtgggcgtggaaggctttgacatggtcccagaatccctgtcctcttctgagtgcacaaaggaaccaccccaaaggtgccatcctacctccacatctaagcctttcactgtggatgaaattgtgggccaggccttcctcttcctcattgcgggccatgaggtcatcacaaacacgctgtccttcatcacatacctgctggccacccaccctgactgccaggagaggcttctgaaagaggtggacctcttcatggggaagcacgtaagtacagcggggtccaggtgtccatgggcatccatggacatccacgggcatccacattgcagtggatttggtacaacttctgattaataacctgccaaaatctgtaagataaaataaggtcacacccaccttctctagctctctgggcaagcaagtaaaatagagtgttcagaacgacagaaaaataaagagcttgtgagactggctctggggacctgcagaagcccaggaaggaattgggggtcaaagggtagccatagagaaggggtttggctatcacatgttctgactgtggggcagcctccctgaggaagacaggagaggggagtcagcaaagggaactgaggctgaaggcaggagtgggcacaggacactcgatgatgcaggaaggagaaaacagaggaggaagcacaatcacacgcacaagatggtagaatgaatgggccagggagccccaagcacagatgcatcctgggtattccttggaggtaaagcccctctgtggtagatcacagcagccacctgccttgagctgggctgttctctcacctcatggctttctcaggaggctacactgccctcaattactttaagtaagaaaagaccccacaatgggatcttgtctattacattctgatatcataacacaacagtcacagttttggaaggtgccctattccactactggaagcattagggttaaatatatacataaccagaaaatacctcctagaacattctaccttttgtcctactggagacgtagaggcaaagttagtcttcttctccaagtcactttataaatatttgaaacctgaagaactaagattagttgttccacatgagcctgtgtggtcaacttcaagttctctgatattatgacagctgccaagctgggtatcccccgtcccctgcttatacagattgatcttttgagcctgggtgcaagagtttgtatttctccttattactttttcatgcagtcaaaataattttgaatcttgattctgccatctgtcatattagcatttcctccagctagtgtcatctgagacttgctaaccattccttccatttcatccaagtcattgattaaaatgttgaacaggacagggtttctgtccaggctgacattgatccactaatcaatattcttcaagcatggagtcccaacaagccatgaatccagataaccctaccacctgtctcagtctgctttattggtagttatttaatattttgttccagttgaggagtaggggagaaaggagggtcagagatgatggggtacatcccagtgtgtcttttagaccatacttagcacccgataactaaaccctgagttaaactgattttagcaaaacaagcacttgtatggatacaaagtcctgctcagtttgagagtgaatgagacttcagaaaaacatttagcggcacctcaaaggtaccatcatgccttagtttctctgatcttagcttttggctggttcctcctattggccccatgcttagccatactgtccttgggaaactataggaagtctgacatgggtgcctgagaccacggcttcctcactgctcaccaccaaggaacatgtatgactgaaggtcacagaggtcactgaccaggatccctcgtccaaccatgggccagttattgttatcagggcatggggacactaatatgccaagcaaattgatttcagccccaagatcaggtgtgctaagaactgggggagatgccttcctgaggaaggctgagggaaagccaacacttagtctcaaactaaagggcaaggcaaatgaagaggaggctgtagaagcatctgaagggtgccttgtgaggtgctacataggacaggagcttggggaaggtgcaaatgctccaagatgtgggggtcattatcatcactctgagggagttaatggccaatagtctattaagcaatatcccttccaaaagaaaccctccagggccatataaggtatgcacaatcagttctaaactgctgtaatatctagacagcctcggaagctacaacctgaactatctgggtatgaagctgtgggcatagaaatgttcccatacaaaatctgatgctacgccctcacctctaccatggcctgaactgaacctgacctcaaggacaatggggccaactcaccaaaccctggcctctttcagcctctgagcctaggaccaggccttcttcccccaaagccccatagagctgtgctaaatgcccccaagttctggggagacccatgggtatgtggactgattgtaccaggtgaaagttttcaaccctctgagatgactggaaggcagatctcaaggtcctgaccctagacattctaattctatcaatgtaggctcccgggaaggaggtgctggatttttgatccacagtcccagaggttctgaagatgatggtctctggttcattttgagaatacagcattagactattgggacccagaactatctcccaagaaagaatgctctactccacccatgccagcctgagggctgttttcttcctctagacagattttggggtagtctttgacaggtgggaacgtgtctgggttgtctttcttaagcaatacatgagataactggggagcatactgctttgttcagtcctgcgcatggtcctcactcaatgaatacttgtagattttctttttctgccttttctctttctccttttatttatttatttatttttaccagactcagaactctgttaatatgggccatctgtcaggacatggaaatgcagattagctgttcacacattaagtatttccctgaaaatattcctgaaaatttgcatgtaaagtatgatttgttacaactttcctgctggtttccattcaacaaatatctcttgagtgccagttcatgccagcttccacggctgcagactctccctatgcccaggatgttctgaccgagctctgcagagcagtcctccttagaagacctgtcattcaagtgtctggatcctggctctagttccttcttcccacaccatctcccctccagtaatttccttttgggaatgcagtgagaactactaccctcctctacgacaaaaagcaaaagcaataacaataacaataacaccctgtgtcacgtgagactgcttcaggcagtgatagaaaatgttacccaataggcaggtaaggaagatcaggtggtaagggcatctcctgccaagcttgagcccctccaacaacagttggagaatgagaaaaagagctcttacactatcacctgacttccatactctagcagtgccacccctccccccacagccacaaaataaataagtctgagcaacaacaattcacccaggtagactccagggtacagcaaccaccagaggtgggcttctgtcaggaatccttgatgtaagagttccagctccatgcctaacagctctctctgcctctcagcttcagtagctctgggcagtcttatcataccccgtctttcccatcacttcaaaatagccatgttaactggattttgaacagtgtaattaaatgaggtgcacgaagcagttttgtgcttcctccactcatactttaaacaccctcttttgttttttcttcacgtgcgtgttgtgtgtgcatgccgtgtgtatatatgtgtttatatgcatgtgaaggactaaggctggagtttggagtctctctccatttctctccatcttcttcactaaagcagtgtctctcggttggacccggagtttttatatggggagtctgtcttgccagcttgctctgagggttccccatctccactgtctgagtttggcaattataggcaggtgttactcccactcagcatttcatgggttctgggacctgggctttcatcctcacagccctgaagtaagctgatacaccttgcatacacataggtatcagggacccaaggtcagggccattgctactacagcaggcactttacagaatgagccaagttcccagcccctgcctgagagtttcaataggactcctgcctggagggactgtgaggtggtaaggtctctagtctgatgagttaatgagctagcattaagtccctctatcacagagcttcatctccagcagttacctacgacctccatgtcaggaagatggaaacagcagaaagcagggttaagtccagcatggggaagaatagaatctgaaattctcacacaaaagaatttcaccttttctcaaggatagatccctcaacttatgagaacacagggtcctgctcgtcttgggcctgggtcacttgtccatctctgccttaaaaaaaaaagtggacctcacccctttctcttagactttcagtgggtgggaaggtagatccctcagaccctgttcctggaagtggggtgaatggcccccaaattgaaatttcccattttctaaattcccttcaggaaagcagcttttttcagatgagctttaggaagtcaggactgtgagtccagcagtacctaggacacctggctcctaagagtttcttataaactatatggctgcttcctgtgacgtccacggggatacttgatgcttcctactgctgacagcgaagcccaggctagcaggttgtcatagtgtaaccttcaccaatcaagaagtgatacacggagctgggcatggtggtgcacacctttaatcccagcacttgggaggcagaggcaggtggatttctgagtttgaggccaacctggtctacggagtgagttccaggacagccagggctatacagagaaaccctgtcttgaaaaaccaaaagaagaagaagaagaagaagaagaagaagaagaagaagaagaagaagaagaagaagaagaagaagaagaagaagaggaggaggaggaggagnnnnnnnnnnnnnnnnnnnnaggaagaggaagaggaagaggaagaggaagaggaagaggaagaggaagaagaaatgatacatgggccatgaaagtcaagagttccaaagtttcacttttagcaaaaacaacttaatgcatgccccattgttggggaattgctacatgttttttcagcccttgccttctgcctagcaatgctccagctcctgctgtctactctgacccatttgacttcggtttggctgcctctcagggagcgggcttctattctagtataaatataacagttataatctgcctgacagacagtgtctccaggcgtctctctagaccacacataatttctgccaatgacttggggatttttgtccaacctctcttcctttcacttagagtcctctctcttagtctgctactataacagaagacttgaaaatagacaagttacagagagagagagagaggaaggaagagggagggtgagggagggagggatggaggcaggcagggatggaagcaggcaggcagcaggcaggcgttcattcattcgttcgtttcactagctttctagatgcgggtaccagagtctgctggtcagatagtaggggctttcttgttactccatgacatgtcagaggatgtcatatgatgagatagcaagcttgctagctttatctttgctcctttccatttggctttatgtatgtttgtctgtgtgaatgtatacacgcacacatatgcacacacacatacacacacacacagaggcacacacatacagagacacatagacacacatacacaaatacacacatgcacacacagagacacacacacagaggcatacatatagacacacacacacactcagctatagagaccaaaagtcattgtcaggtgtctttcattgacctcagaggtcagttcagctaaactgtggccagtgagcgctggggaaccacctgtctcatccttcacactctgggatgacacgtacacgcccttgacgccagcttttcataggaatgccaagtgcccacactcagatcttcacactgcgagtactttcccagctgagccaccttcgagcttcttttgtcataaattcagtcataccccatgatcccgtctaagcctaattgtcaaaggctctaccttctaatggcattcacatataaaatgagagatcaaaacccaaggcataaattctggtagctgaatatttggaccacagtgttatccttctcaaatcactgggacttttggagacctcatgtttcccccacgtcatcttggtcagacggaagagtgggtgcatcggctgtagtctacctaggagactacaaaaaggagacaactttctagtcagacctttgacatgaggctgtgtcactgtatgctccaatatttaatttttaaaggattaagagaaaaaaaatacaattctttccttcacactgtttttgctatagctttagcacttcctgttgaaattcttgacttttgatctggctaagccattttcctgcctcctctctggtgtcagactgtgccagccaaaatttatgagccattttccttctgcttaattgttgatataaatctgctctgcagaacctagttataaatttatcacannnnnnnnnnnnnnnnnnnnnnnnnnnnnnnnnnnnnnnnnnnnnnnnnnnnnctgctcagggtagtttgaacacagtcatgacttagaaggacaatcaactccccaggaactctccaacagctactttgtcacattataaagatctaattaaaacacatcttcctcttcctacctctcctaaggatcaaagaacactctgtgctggtttcttcagctgattagctcatgctgcttcagtccagaaaggttggggatttgctccttggagtatccagaggatctcaaagatccaaacgtaccccacggttataaaaataaaatagccctgcgccataagcagctatttcataactacatgcatccttttgtcacgggggaacattgggttgggaactatttggataacctatcataaatttgtcctcactatggggagtcggggattggggagagtcttccagccagaatcacatacagggtcacacaggaagtaggatggagctgcaacagggaatgaggctcccagtcagccagggttcttccccttgtccgggtctcacagaattctggatgcgcttggatactcgctgacagctccataccaagccaatggtccccatggctcttcagaactgccccctctcctgtaggcctcacaacaatgcatctaaatgcaaagcaactccatagaagtaagaacaccctgatttccaagcataaaaataagaaccatggtggaagcaggcccaggctgcggcaccagccaaaggctaaaaatattgagatggctcagttagcaaaatatctgtcacagaagcgtgaggaccggggtttgaattcctaggattcatgtaaaaaggcaggtggggtagtagttatctataattttagcattggggaggcaaagacatgagattctctggacctgctggctggatagtcttacccagtcagttagctctaggttcaataagagaccttgtctcaaaaaacaagagctggcatggtggtgcacacctttaatctagcacttaggaggcagagatctcagtgagtctaagttcccagtacctggtaagctccaggccaaacaagaaagaaatagagagcaatagagtacagcacaaatatcaacttctggcctctacacacacacacacacacacacacacacacacacgcgcgcgcgcgcacacgcacacgcacacgcacatgcacacatacaatttaacatacacaggaactatggagccaaggtgcagattcctgtaggactgatccagagtgggacccgagcatctgtggtccttacagtttccagaagcctctagattctgatgctgtctgtcagccgctcacatggtaagagccaggcccttcaactgtaaatcccactcctgctgtgatgcgcacagagtcactttactcccaatgataacaagggcctcaaagttctacagtgcctcgccttttgtgaataaaatgttaatgatttctagattattccagtgatgatgccagtcattttatggatgggagatagactgctttgggactcattccatcctaacacatcttggaaatccgttagtcttaaatttatccgacaatcttcttgcctccttaagtagttctctgatgggaagtgagggcatgtttccggttgatttaaagtcacattcaaagcagacaaagatggtaagtgagatgcagcaatgcagtgtgcttgtataaactggatacctgcaacgtgcacccactaggctgttcccctcaggctatgagctctgtctggccttgaagctctcctagaaattgattgatgtacccagcatcttggttgcttgcccaaagtgttgtcgacaaagggaacttctctctctctcttgtcccttgaggaaaggaagtctcaatgaggggtcactcagaagtgaacctcaacttgcctagtctcctgtctttctgggagtttctaactcaaaggatgtagcaccctagcaatgaatgctgggcagggcatcctcacacccgtgaagtggggcgtctctggcagtatgcctgaagctctcagaaattgtgatctgtggaccctgctgccaacaagacaatttctggagggaaaaccaacaacagatacccctatgtggaccacttgtgagtccctagagcagagtggccagtaaacctggaccaggtactagagataccatggctttttcacaaacagaagggcagatggcacctctcagggcccatctgggctgtaaatggccacagcctctccctgttaatatccaaggctccaaaatcttccatattcactacagatgtccagtgccaacccccacagtgacccctgagaaaattgacccagactgtgatcttcctccagcttcacggagacatctgtaccctgactatgtgcctcccctgcccgtctcttcctcggcactgcagctcctttcccttctccttcgatgccctcagcatcatctgctctctttcctttcccccttccttcctgccctagctctgctccccagaatccagagagaaccagatctcctccgcctcacctctaggctcactgaccactaaagctcccagcccttagctgagaggtaagcaagacaggcaggctgaagggcaggaaggattttagaagcagtttcctgagctgccccacctcagcaagcatggctctttggccctttccatttttggtgatgaatgctccaagttctccctaccccaccctccagagcacagagagaagtggcctgtatagagatggccctcccaggactgcaaatcactagtcagcctggatgtgtgcctttcccgtggcaactcagagtgttttatattcaatatcttggactctagaggatctgggctttgctaagcatataagatgtagactcagttcacagcaacccagaaaagcaggaattgtttcaaataaacccgagtgaggaaagccgcaggcagagctcagtgttctgagggtccacttggccttgagttagacttgaaccaagtggttcttttaattaccgtgcacgactaaagaatagactttgtcccttacggctagcttttgaaataactttgcgtttgacttccctggacaccttggacagatgccgttttacacagaagtttccaaatagcccagtctgctgggaatttgaaaacttgtgatctttaaaagacctcctgtcaacccacttctagacgcagaatgccaccactgggacgaagattcccaccattctgtcttgacatagtatctgctattaacctgcacttctctggcaggagcaccaaaatcaagcccaggtaagatgccagccccacgggaagagaaagccacatctgccaggcccacctgcccagccagtcccaaaaaaggacctgattcatccctggccgatgagatgcagatgctgagagttgctgggtgtgggtgcagggccctccttctccagctggaggcagatctgagatgtggtcagcagggtggcgccctgggtaaaaccagtgggttactgcttcctgggaggaaggggtagacaggggtcaccactgaaggagtaagcataggctggagtgtacaaggtggttgttagcattcagtctaaactcctccccactgttaccgggcaacagtcaggtaggcctggcccactataaaaggggctattcacctcctcctcctcctcttcttcctcctcctcctcttcctcctcctcctcctccttgctgtcttgcctcttgctcccttgctccctcttgctccccctctctccctattcccttcccccatctctctatgtggtcatagccagcttctacttctctactctctctctctctctctctctctctctctctctctctctctctctctctctctctctctctgtgtgtgtctttctctgcctctacaaccttctccatgccctgaataaactctattttatactataccgtcctgtggctggtccctcagggcgaagggatgtcttggcatgggcccaccgaggcacccctttccccaatatctcaccacacccccaaagaacatatcccctatgtctctttatctttttataagcacatcagtggtccctaccatcaaacagctgtgctctgatgggcttttgtgggggcatcacacagatctaccaggtgatggctagaatcttcagaacaagaaaaggaggggaacctgagttatctggagcagccacacacccaggagaatgatgggagaatacacccaggtatatgatgagaggctataaggtcaggcacgatggctccagaacaagggacttccttctaagatatgggtgtcccctaaaatctagcgaatttataacatcagcttggggttcctctgggactctggccagccctctaataccttggacacaagagagcaggagctggggagtcaccacagaatgaggggcctttccaaagtgtttgtgttacagactttctgtctgttccaccccaggactgtgagcggtgtggtgctttgtgctgtgtgttgtctgtctcagatgtttggtaactgaacatggcatgtgtgacaacattgacgagatgagcctgcctgtccaggcctatgcatattccagatctgaggggatgcgtgactctccagtgaaaggcagtgtggaaggttttctgaagctgagcatttagaaatctgtcttttccttttaaatatttagattgggtctctagaatacaggagagcgttcctcacttgcttaatttgatccccgggccgccccctccccctttcttttggtagcacaaagttgtttttcaaaggctcatttcttgaatgttccctataggaagaatgtaattaaactccactggcctcctcctgctgggaccaaactggggcaggagctgtgggggaagcacaccacagaccccctgccaagggattcttgttatagagatgagaagggaacacgtttcccccctggctatgaacaagaatgggtagagagccacgcagactccagttgtcgtgacttcctctcctacacactgtaattagtcagttagaacagaagggagacacaaagtcctcaccttctcagccgcaagccagggtcactcaactccagtggctgacaaaggggtgagctggcccaggactcggggtgcacacctggagctggaggatcttgaatttgcagcttccctggaataaacagtgagaacctatctcaaaatacccaaaaactgagccaaacacaacagaaagagacgccctacagtcatggttcttaaaaaacaaacagacaaacaaacgacttttttcctgaaaatgcacagcttgggatcctggtcctttgtcccatcaggcacaggtttgtgccctaggcatgggacagggatgggggcagcattgcatctctctaggactcctggctggtaatagggtgaagaagcttgagttgttgagttgaggaccacaggtcccctgtcacctttcaccaaactagacaagagcaaagattgtgccttttatgtcccatgtcccaggtactggtctcacattgccaccgcacatggaagacactgaatgaccatcaccgatctgtggcagggatcacagacacacctttctgttccttggttttcctctctgtaaaatggggataggcatattctataactcatggattgtcgcacagatggagttaacacgagtgtgatattttaacaggatcagcaatatacacattagcggctaccacctgttctgtgcctcagtttccttacctatttttattgattggattttattgacggattggaacagatgctttctctgctatcagttaacaacagcactgaatgtgttcagggaagacccaagctccttcctttacaaacaagcattaccctggtcctcacaataacttcacaaagtcagagctgtcatagtgcccatggcattggcagggaacacacacacacacacacacacacagagagagagagagagagagagagagagagagagagagagagagagagagagaaccaagaagaaagcgaggtttattttaaggagttggctcatgcagtgtgggggctgacaaatctaaagtctgtagggcaggctggcagtcggaaactcataaggagttgacgctgccgtctggagacgggctcgtttctccaggaaacagcaatgttcactctcctgccctcaactgaatggataaactcccaccactcgattcaaggtcataccctttatttaatgtcgcgtagatgctaacactatggagccaaataccttcctagtagcacagtggtcagcatttgattatatggttttcaaatgacttggcatggcatagaggaccgacagcatctgcagatcagggttacactgggaaggaccctggcttccactggctttcccatctcctgacttgtaccaagtatgcttatcaacacagtgtctgctgttcatgttgactgggtaggcaatagtggctctagacatactggaaaagagggactttcaggactgccttctggggtggagcttggagctgtgtgtgcctcagtttcatggaaccgtggaaatgccagttgtccggttggtaagggcagccctgcccgtgttcatctgtagcaagggagcctggaccttcctcagccacgccaccagcatcatctctgacctgttgtcctggttctcagcaccaggcaaggtcctaggtttcgtatgacttttcctatcaccatgacccactctctgagttcctgggttgtctttttgagtagcttgtaatggtatgaaatgaacagtacataggcagcttcacccttctgaccataagttcctgcatgtttcacccacacccacaagaacattgtggaagctgagacctcagtcctgggactgctttctacttcagcagatattctgcctgaagcctttctcggttatccattatcatgatcatcctataataataataattatatctttgtagtgtctgtctctcctacatttatatggtataggcttggggttggggcatcactgtgttcattgagtatctttacctgctgagccatcttgtgagccccatttctttcttttgtggatggtattggctcattctttatagaaagttctctggctctcctctaccttctctttgagatctgtcccacaggaacatagtcctaaagttggatttcactgtgtttgttgttaaacacattaagcatgtacaagagatacttaacttgcagccacattgaccccctagcccctgggacctaccctcctcccaccattgcactgcaatgattgttctgcaggaagccctctccattctccctcctgggtaccagtcagaagccaggctgcatttgactgctattgagcactctttcagctcagtgtagaggcctggaaggttgttgggaacggaagagaggtcccgaactatgagtgttccccatctttctacccaaaaggatgcaggacctccagaccttaccaagtctctggattctctgactagcgcaaaccaaaacctggtgtttgtcgtggtttggcagtgaagtggtccccgagaggtttgtgtgttgaaggttttcttcccagttgataatgctattgaatggtgactggaccatgaagccgctgatggatctataatctggtggtattgctagatgatggtcaagagcgaagcctatttgaaggaagtgtgtcattgagaacaggcatttgaacagtccctcttcctgttctttctggctatcatgttgctttcctctgctatgccctaccaagctctgccaccatgttgtaccttaccatatcagataggaagcacagatcatgggccaacagctctcaaaccatgagccaaaataactccttcctcctttaagtcatttcttacaggaaactaacacacctatgtacacagccattcaacatggtataatctgacttcagacagcttaagacctttatcctcaagagctataaaaatggcagtggttgggaatcttcttctgacttagttggtcgagactgagttctggccttctgaagggctccatgggggaatctaagatgcagcaggtaaggcaaagacctgttgccaaagtgctatggagagtctgtttcaaaagatctaagatctgccctgaagctactgtcaatgacaggaacgattttgtaaacacccaatgataactggcacttctcatggcattttagaaaagctgctggtcaggttgttaggaagtagcaggctttctgaaactgtgtgatggccacatccagttcatctcgccagctacaagtcccacaaggccttagagatggttgctccgagagggtggatagatgactctccaaaagtctctcaccaatcacaccaaacccaaggccaggtggtcacctagtctttgaccaactccaggaccgtgaagcccatttctccctcttatcagcaagacaaatgaagctctgtcccaccataggtctccaccctagctaagaatgctgacaaggtgtcgggtggaggggtgagcggcctcttggtctctctcccactctctcatccctttatctctagctgtaaatctcatttgatgagtccccagctcgactgcaaaggagagatttgtagacctggaagatgctaatgatggttcttacctcctgcgcaacagtaaacatttacggggcattataattattcataatcacttttatgtgctaaatgaatctgaccttgctctaaagaaaacgaccctggtagccaggaatcctgggtaaaatgaagtctcctagaagcaactgatggaagttgtccctcattccatagcacaggggccaggtacttctaacaaccaatactacatttttatttcattttaaagactaacatgacatgaaagctgagaatgaagtaactaaactaggtcagagacagaggctaaatctgaacccagatcaaacagcacctagcttccctggtgccatcgtggaaatagccaccacgtctgtgatgatgaggagatgtccaaagagagggacatgcagtcaggtgcacatatgacttatgttctattacctcagtggcagccaagttcatgagagggtgttggagaattcgcagagttgattcctcctctgcccaggatgtcctctttctgctgcgaccaaatctcaaaggacaatattagaaacaaaacaaaacattttttccaggtggtgggtagtacacacctttaatcccagcactcaggagatagaggtaggtggatctttgtgaatttttgtaggccagcctggtctacagagtgagttccaggaaagccagagctacatagagaaatcttgtatcaaaaacaaccaaaccaaaaaaaggggtggggggcggctggtgagatggctcagtggttaagagcactgactgctcttccgaaggtcctgagttcaaattccagcaaccacatggtggctcacaaccatttgtaatgagatcggatgcccttgtctggagtgtctgaagacagctacagtgtacttacatataataaataagtaaatctttaaaaaagaaaaaacattttttacttgtcaataaggaaatgccaataagttaagatgcatttgtctttatcagtaaaagaataaatttagtttaagaataattaacaaactaatcaaactggataaaaaacaatacccaacaaaagaaagaaaagtggggctggagagatggatcagctgttaggagccctgttcccaacacctacgtcaagtagctcacaactgtctgcctcaagggtccaatgcatccaaggccatctacacacttggtgcccatacactcatgcacatacacacacacacacacacacacacacacacacacacacacacacacacgcctaaactaaggggaaatggattcttcttatttaacatttggcaaatttacattctccttgtctgcccttggatctcttaaattaatctctatagatacttccatgtattattagttttttcttcctatgtaaaatctgttctatcaagaattcctctattcatcccagcttcagacagacagttcccttccctggggatgatttatgcaccaagcccgtcagatatctggctgcatttttcttcctgtccctcaaatgtttccttaaagcctacttaatagtgcctgtagtgtctacctggagttctgggaagtctgggtctggcctctctgcagtagtctgtgacctttccaaccttgctcttttctccaaagttctaaggaaggactgtgaatattacccctgcccctgtcctgctcctgacctcctacgtcaagtttcaaaggccttgctgattcgagcctccttcagatcccatcatccatttgcatgtgggccagccttgccagaagaggcccatgagtgtagtctgtccttgccggtgaggcatcttgagtgcgcatttccagcaaccccaccttcctcttggtccatgctcaagccttaggccctcttagcttttcagctgtcacagccccaagaccaagaaagccacagactccacgccctggaacgtacctgctttcaccatctcagaaaggcaaggagctccgacctcaggagctcccccgcacaccttctcatgggtagaagtctcttcagcttgttccgcccggggcaggcatgactgtccctctaccagtgcagggtctgtcgtgagttccaacggtcagggtctgggccaggtgttgccgggttcttgacatcttaatcaaagaattaaaataaaggtgcacacacaaagagattgcaaagtaacactggagcagatcaggaagacacacactgtcaggagtgacagccgaccacaccatgagggaactcaaaggaccttcttactgtttgagactttccccccatagggtttaatagaaggatgaatctgggaaatctttgctcattgagtatgtcccttcccgtgatggtttgaatcatatgtgtgcttaactatgtagagctgtaggtggtaagtagggaagtctcccttcatgttcactcagaggatacagtttgctggactacacatgcatgcactcaatggcagtgtaaaacatacgaggcccgctgccttctatacacagacacattctggtatgcgttccagtagaaactgttcataaaggagaaggtttcgtttgatccttgtcaaggggaagaggaacttatgtccgttgtacgaagggaggtgcacacccagtctgacagattacgagatgcactgttaggagagagatgcccaccccaagcagtgtctcaggatgctaaactattctctaggcttgtgggcctcatcatatcaagacctgagtgctcagcagatgatgattaaagcaaaaaaaaaaaaaccataagtcatcacgcacacttgtttgcacgcatgcatgcatgctttactgggaattaaattcaggacttcatatatggtaaggcagacacttgactactgagctacctacctttgctttgtaaataaggaaataaggaaagggcattaggagatgtcccagaatcacactgtgttgcagcttcctggcccaaggcccatgctcacttatctgtgtagcttgaagaaccagtgtcctctctaagaaggccagtggagcccttgttgccctcctgagtccataagtgtttagaacagtgatggcctgggtctgtaggatggcatgcttcagcacccacgagaagcctggtactgcctcttcaacatcaccactttcagttccagatcattctaggccctcttacctgccttcttccctgttgcttatttctgccaacagccactttccaagacagccctggcattctgagatctcctgaaagccatctggcttcctggcttctaagttttacttggtaccaggttaacaaaggtcatgtgccccttgcaaggcttgacccttccttccagaacagaaatgggcacctcctccatcagctgtgccacaaccttaagaagcagtcacccaagggtaggtacacacatataagcagggtacccaggaaataaaggctttataattgaaagtcctcagctacagagctaattcaaatccagcctgggctatctgaaaagggtatttgtctcaggaaataaataaataaataaataagcaagcaaatataagtaaataaatggaaaggaagaaaaaggaaagaaatatagtgggtttatttatttatttatttatttatttatcattcaggaaggtaaggtctctaaatgagccaatcaagtgctcctgtctaaggatagctaatgacagacacctatgtctgcttgaacattaaattagccaactggtgggacatcagactagagatgtctttctccttgtgtatgactgccccaagagacagaatgacagatttttcagatagagccccgcctcctggtgagttccttgagcacaggtgatcaggccaggaggcgccattcttgggcaggggtatacatctcccaacagccatagaaaccaccactcctgggaccgttctccagggtcctggacagaaagaacttcctgagtcacttacacaaggaggccaggctccagtgatcaggcataggtagtcagctgcctcaaaatgcagagcaaaacccttatcaggagatgtcattttcctctaaatgtcatatatacaatctttactggggtgtgatgacagagagtgaataacttaacataaatttgcataatgcaatacagctgttaatttatgatcatattaaagcgcaaagttttttagttggaggcattttaaagtcttaatcttctaaatttccctctgtttgctctgtttattacttaaagctgccaaataaaacacaggtatctgcttcaatttgaatcccagatgagcaacgactaatttttttagtgtatctcactcagcatttgagatatactttaaaaatgtatgtgttttattctgatatttacagttaactgggtgcttctgtttctactctaaactggggaagactgcagagacagctcagccccagggtctttgctccgggagcagggggattatcgccagggataatgcccgctgcagggaacttgtgcctttctgctgtgagggaggctggtcctctgaggaacactaacagagttaaatgaatcagactatacaggtgtcccagtgcaaaaggggaaactgaggcaagtaacatatgtgagcatacctgagaacaccaggatataaaaatgagggcataacctgcagtggtggtgatggtggggtggtattttggttgctgtgtgtgtgcatgtatgtatgtttatgtggatgtgtgtgtgtatatgtgtaattgtgtatgtatgtgtgtgtacgtgtgtatatgtccgcatatgtgtatattgtgtatgtatgtatgtgtatatgtgatgtgtatatgcatatgtatatgtgtgtatgtgtgtgtgtcctgcatttattcacttatttattcatttatttaggttttgtatttttatgctgtggttcagctgtattttgttttgtttgggatagaatatatctatgtattcctggctgttctaggattaactatgtaagatcaggatgaccttaaatttgagcaatcctcctgactctgctccactgtcatccccttgtgacaggattacaagcatcacgcctggctactacagcgttctaaatgttggtcttcaccccttaaactgaattcaaagatccctactcctgagcctgggttgtgagtctcactccctcctcttcctagcctggtctttgagttgtaatgcacactcagggaccttctgctgcatcctgcatctctatattactgggacaagaccggcttatcatgtcatctcaaatgtcatctcctcagatctccaaactgcatatttctgagctgatcgcctcatagctgtggcttctacttaacttcaacagcgttaaatctcatttatcctggttctggccattctgtcttcagcgtcttcctgataatcctgtctcactgtctccatgcctcagcagagcttgacagtgagtctcccctgtgcccctgctaggactgtcactgtcgatggcatgaggcaaatgcagtgagtaactactgcgtggtgttacaggctcacagtgtcctacgcagttgccatgagcccctttagagtccagaatatagagcctcggaggttccaggtgctttccttaaggctgtgatgcaaatctacaatttcgcctcctccaaatcttaggctgagctgagtcttgcaaagaaatcaactgacaggaaaagccagcaagctaagagatgcccacatgggctatatattttctttctatccctacccagaatcctcttaaatcttaccttctccttgggaatgtcctggaatctcttcatgggctctccattccgtgtgtgttttcttttcggttgtgacagtcgagtcccaaggaaatccttgtttcctgagcattttcccatgcctcagcagtaatggccatctcgcccacaggatccaaacccagtgatccttcagatgtttttattagctcagtgaccagtatatggggagaggcaagttggcactctctttccattccgtcggaaacactttccaccctgtccctcttggccctggcatttgcttcgtgagttgccaggaaaccccatggggcagcagagcatagccagcaacctgcacccagcaagctgacatggacactcagcctgcatcctctgagtcccccagcctgtcaccagtgttgccttcacccagcctgcggtgccaagctctgagtcttaactccctactgaaaggctccttacccagccagactaccccatactgggaacaatacagatcctcctagagcctatgtcctcacctgataaaggggacagtaatgtcatttgctctttaagctgcaagcctgaggaaattggctagcatgggaagcgctgagcacagagcctgccgcctgccgcccagacttctgatctctctcctgtcacattatgttattcctacctcaaaccgtctaaaaacctcaggcacatgtcccttacatgcatcccctgctgctctgtcattgaacttctggtactatacacacgcgcgagcgcgcacacacacacacacacagagagagaacacccaccctcccctgccactttctttttgctggcaacttttcctactctgctgttaaattcacctctgacatcctattttcccaggacactgttttcttccagaggccaacaaaacaatgctcaaatcagaaagcatgggtggataccagccaccgaggttccagaaccctcagtctctacaagagattgctctgtccattcctgcctactataccagaaataagaaactcccctctatctggggatggggggatgggcagcctgtggccaataaccttccactcttagctaaactcctctaaagaggggcagcctgtacctttctggcattgctaatctctgcccaaatagggaggcctcatgtctactgcccatcgtgtccctgtgactgtatccctctgggtgcagaacatgcagcagaccccatatgcgaaggtgtgatgcagagatgaaggttgcttttatgatattcctttccagaaggtcggggtggctccatcactgacccattatcaagtcaccattgaatgtatctaaatttatagccatcactgtgaccctgtgtcacgagaagccctatacgtttatgagtagaaatggcacttccctttattttctccctgagttaagtcttttggctattcttctaattcatgataatttctcttatgtctccctcaaatcctctctttaaacatcttgtcctttacctttacatttgctaatggggtacaaaccatcgtccacaggctggaagctctgttccaggaggcacctgtgccagcaatcctcgatgcccaatacagtgtctggtgcatcatgggtatcctgatggaccattcatcacccaaaaccatgctaccctctccaactttacctttccctgtgtgcagggcaattaaggggtcctcactagagacaccagttggcctactttctaggagcctgttcccaaggtcacctcatagaagcctcctccacgtacagtgggagatgtgcagtgagcattcggtgagcctcttcagaaagagagcaaacaagattgggtcaggtccatctacaaaggttgcctgagatgagggggcctccagtgggacagggggaggcagaacagaaatagggagtgtccactgagcttccttatgcagacactgtcttctgagccatccttgaatggaggtttgtgctgacacagctccgtgcagcaagcaaggccagcacttctctcttgcactaggtgagaaactgcagctgtcagagtcggctcaggccgcccagctggcgaatggtgaagcaaatttaaactctgtgtatgcttctagtattcagtactagttcccagggtggaatttgaagttgacggcaggaaaccctggaagaatttccccagcaatctgtaaggagtagtcttggtcgaatgttctagaaactaccatcttgagcttggcagcttggatctaacgggatgggccccatctctcaaagggtttctcatccttggctacaccctggactcactctggagagcttgctgcctttggctccctgcaccctcagtgcctcacaaaacaggtatgtgaggcttagccacaaactcccctggtcactccaggtaggctcaaggaaggcaaacaacacaagatgaagctagctgtccctttctgtccaccagagctcagcactcggtggcaccctgggaagaagtctcatttccacactgcccaccaagactgaaggcctgtccctgataccatgccattcaacgcacttccagtttcattcttacatttggggcctctgagcctaaggcagccatgcaattataaaacacacacctgatggggtggaatcctttctgttgagactactcatcagagaaaaaggcaactccaggtatacaaagtaattagttccaggcagttgtgtctttgttctgtgtgacaaacaaacaaacaaacaaacaaaaactacttttgggacacaaagtcatctgggcatcctgaaaatgagagccaggtcacccttgccttgacctagacgactcagggccatgagaacctcccaggctccaaagagtagcaatgtgcctgagaagaaatgccactctcctatcaggggtgctctttattttttaagattcaactctcaaaccagaaatccacccacctgccaagtctaagtttggggaaagaacattattttcttagctatgtgaggaaacaccacagcatcctagggactgagcccaaagtaggcagatatcaagtcatatgcccagggctgcctagccctcagagtccagtcatagctgcatatggaagacaaaggccagcgcaggcagcctatgcaccaggtgcatcgagagaggtattgttttagcttttaaatatatgctaattgttagatttaaggaatcataattctataaagatctaggccctagctttttcttgaagcaatggaaactcgggttaccttcagcccctcccttcctgcagcatcagacaagggcagctcccgcctgcagtcaggccagatgccagcagcccttccacatcacacccatggcctctgggccccagctcacagagtcacggtgcttcctggtactccacagggtttgcatcaccgtcgggctgtgaccttgctcccgtccctgcattctgagccccagaaagcaggtccttgtctgctgtacatccaacctctctaccttgcacagacaggacacacctctgcttgtctcagcctctgaagctctctctgagccttggcgcaggtgtatcgactcctaaaatgcttgtggcacttgagtgattcacggggcattctagagaactctagatgccagctcctgaacttgccaaccccgggtgcaggccacagggcagagtgggctctatggctccctgtctggtagacacaggggtgtcctccttgtatgcagacaccccttgtatgcagacaccccttgtatgcagacggcccttggtggctgtccctgcttgtctggctggcaaggagaattgagtttgctcagccatctgctctagggccatgtgccaaccaaagtaggaccagttagtcatgcttggtgacctataagcagagcgagagggcacacagagtgaacgggggaacctttagaagaggccactaatgtccctctcctgccttcatttggggccacttcttctcaccctgcaggtccttagcagaaataaagacagtacttagtgtgatattttcactactttccaaatagattcacatgtctggctaaacttctcaagggtgatcctgttggtcctggggagatttttgaaaagaagctgtgctagctgaggtgacagaggataaacaaatggggccagagcactccccaaccaccacaaattagactgtgaagacaacaaggtgggtaactaccactcacatgagctcgatgccagaggactccaccacactcagggagggctgacgctcaaggctaagaaaaccagctctatgtagctaaccacactgttaatctagggctgcaggattctggtcccttccagaagacctcccagccccgtgctaactgggaccagcactcaccagtcaaagcagtctgtctcatgcattgtgccaggtccaaagggagaggtcccacatggtctttgcagtggcttctgcagccgaggaagcagagtccgcacagcatctttcctcctcttggccagagctccacattcaaatcatagtcctggcctctcctccccatctttaccctccctgactcctaagaccccagtcctaagagggactctgcctgcctggctgacaccccatctcatgaggcatctgccatggactgttccctggcctcttctctcctgtgcctttcgtttgtcaaagttcagtttttattcactccatgccacaaaccccttttgccagatgctaccatctgtcctctcctatggatcttactcataaatcccctggcctccgtccctcatctataaactacatggcacaggtgacagtcacccacagaactctgaggatctagaactcccctttctcataaatggtgtcactggctctgttcgcactccaccctcaggtttggcatctctccatcccaactctatcctcattttagcacatcaccctaccccttgttcaggaccaaggttccgaacggtgatcctgcaaacgcccgtaaggtctcccagcttgtgtgcccggggtacgaggtatgcttgtccctacctgacactcctccttcattacccaactcagcagcccagacttagagctgttcatctcagctcacccatgcagcaaccgttcccacagacatgcagcctgtcagtaattcacgaccgtgttctcccaaaattcatcctacatgttctgacacctaagacctcctatcttggtccctagagggctctaactcagctgggcccacccctcaggattgctgatggcctcctggccctctcacctctaacacacacacgcacacgcacatacacgctctcccttccctactctctttaccaccctaccttcccagtgtctgtgtatacggccatgcacttgacttcagcttgtggctgcctggtccaatgatccagagggagaaaaatctacagcaggttggccctccccagggtcctccctgacgtgacttggaatgccacctctgatagctagagccaccctctcagccactctgactaagtccctttgggcagccttgcccctgggtggggtcagatgcactgagactgtagggtgcagagccaggcgtccatgtgtgcacgaggcccagaaccagagcagcaggcattgagacaaaagaaacacaagactctaagatccccagccaaaacaaattgccctcattaacacgggcctccaccaccatctctgggctgggaccaggctgaagtgaggcagaaaccacagaagagcgtgtgccaataaaacggcaataaacatgcagcggcaatggaacccggttcagcgttgttccaaaaccttgtttaactgcttttattgtttctgtgtgagagaacacaaatgcatttggaaaattgcttcagcatcaggctcctgctctctgaggaaaggcttcccaatgtccccccacccccacccaaggcggatcctgaccttcacggggtccccatgaaagccacggggctctcccttccagccatccactaacatgtccctatgcccttggccccagggactgtgcatgggccatctctactcatactctccacagtgctgggtgcagagcagagacagccggcactcagccatagacaaggaagtgcacagacctgaaggggtcccatgggaagctaaatggagccttgtgaggcagacaacattattagggaagaaggtttatttctgaaagaatccatcactgaaataaacccatgagctgaggatctcctgacacgagtgactgaggggtgacttgttctcatagtcatccctttgggggtttcccacattagaacagcccagtcaacagaaacaagaaagccaaaagagggttcccggagcaagacccagagctgggactggtgcaaggcctggggtatcaggaagctctaaaaagaacaggtggagggagtggcctgtgtgagaatccttgcatgccacaggctcaggtggcctaggaaatgaggaggggcttttctgagggcattgagaatcgaggatcggggtggggggtggggggagacccttctcacaccaggaaagatgcagagactggggcctctgtgttccccctgcagtaccctgggggcctctgtgctccccctgcagtgtcctggggcctctgtgctccccctgcagtgtcctgtcctggggcctctgtgctcctcctgcagtgctccgtgggtggatcatgagaaagagaagtaggagggtgcacgaagatcctgcatctccctcagagcccactgtgacctccacaggttctgtggccacaagtcacagggagtggagaggagtcacagcccctctggagaggccagtgggagtctatctgccgagaggctggcagccggcttcactgggactcagccagaacgaggagtctgaatgcacggagcagctactttgagcaattactaaactatggtctatggaaaatgagactctgaggcaggtgctgtccctgattaaatccccaccccaaattaattaaaaaacaaaaaacaaaaaccacctttctcccataagcttcgttctgtttcacttcctgctggagaaggggcgtggcataggagggaaattcaggccatccttctctcagggccttgctgctcttaattttgctgttgcagaggccactcttggcaagaagtccttctcatgagagccaccagctacagagaaagacctaaaatagcactaggtggaaaggagacaggcggcagggtcacacgagggcgtaagcatcatagaacctcagaaacagccctaggttcgccccagcattcccactgccacctaaactctggagcatcccttccctcccgtgtgacatgggcagccgctggaaggctgtacccgttactcctctatgtgaaatttgctgtgctaaaataccatatccagacacaacttgcagttgattgtgcttacagttccagaggaagagtccataatagtggggggtgggggtggggtgaaggtggaggcgcgcgcagccggatgagatcccctctctatagcacgtagggagcaagtctctgaccatcaaagcccacctccaatgacgtacttcctccagcaagactgtaccttctaaagctccatcacatccccaaatatatgactaacagggaaccgagtattcagatgcacgagcctacggggatattaatatgggggatattactcattcaacccaacaaagtgttagttgtctttgggacaggggcgtcattagccttgcacaaatcctgcagttcataaagtgccatggaattatagtaataatatattaataatataatatattaatattataatattaaatatattattggatatttgatatgtaactagatatttactatattatatagatatataacaatatatatccactatctagtatataatataaaattaaacatatacataattatatttttttgccaagaaaatagagcatgatagtggaggcttatagtatatgtgtatgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacacacacacacacacacacacagcttaaataaaaagcacttttggtctaaattcaggtggctgtagcaaaatcaccataggctggaggctggaacaacagacagcagctttgggtctgggaagttccagaatgaaagggctggcagatccaggtcctaggaagctcttgcatcagggtccataccttctctctgaatactctcagggctttccttggtgctccccagagagagggaggagggcaggtgcacttgcccacactgcccgcttgtgaacactagtgtgaacgcaggatgctgaggaatgcaaagtcacactactcgagtttgcctcctattccgttgatccagagcagacccgacttcaccccgcaagtacactgtcttgcatgggactttctgtggtcacccgaggaggatataccaccgcagtgactctgacttcggtgaaccagaagttcagctcagtcaagaacactggctcagcatgggtgaggtcccaggaatcttcatctctaacaccgccaagcaagaaagtgggggacaaagggggaaagagaacagagcaaagagaacacatccggccgtgtatagctgggttttcttacgctggttttgttgttaaatgcgtccctctctagcactattcgcagaaagcatgctgctgagcctgcatctcttggcctaggctctgaagctgcctctgcctctcctttgctgagcactttgagctgtttcacctgtctggcctgtggttcctcaagacaggtttacatttctagaacctgggggtttcctctcgtgttttctttcaagtgtcccatgattgataaccagtgtcagcaagaatattggtgtctaattctcttctcctgagctggtgcacaaaaatgcctgcagaggctggaggggtcgtgcagcagttaagagcacatactgttcttgtagggaaccaggtttgagtttccatcatgtctaaagtggcttgcaactccagtcctgggggggggggggggttctaggcgccctcttctggccttcacagacactgcatgcaagtgaatgcacttgctgaataaacagcccaggcagacacataccatacatacatacatacatacatacatacatacatacttacatacatacatacatataaaatcaaagtaagtaaataaaaagagcctcaattctcaatgattcttaaaatctggtaccgagccaggcagtggtggctcacgcctttaatcccagcactcgggaggcagagacaggtggatttctgagtccgaggccagcctggtctacaaactgagttccaggacatccagggctacacagagaaaccctgtcttgaaaaacaaacaaacaaacaaacaaacaaacaaacaatctggtaccagatactatttgggcctctagatactactcttggacaacaagggtttatcttaatggaggagagcattttccatgcctggcttggacttgtccctaccccccacttataccctgacctttgaaaacagactgagtggacaatagggatctgaacgtgtgtgtgtgtgtgtgtgtgtaaggagattcctattctaataaatctcatcatggtggagatttttttttcccagaaaattctgagcccagacaatggctcatttatttgaagtcatattcaaagcaacagaactccaggtcaacaagaaggatttctctgatcttagagttgattgcaaagggatttacgactcatggacgggggtggggtggggtgggggagccatttaatgatagattctgggcaggtggaaggtgaccttgcaaacaaacctaagatggtctgctggaaatgctgtgacatgctgtgggacaaggatcacctacggcagtgtgagacagaagcccaggagctctgcctgggaggatgtttgggtaaatatttgggcagcctttggctactgctgctacactggtgaactgagctggagaccagaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcacgctccaggcaaggtggcagagagggggcaggaagcaggagggcgggagaggtctagaaccggctgtctaaatttaacaggcagtggcttttaggccaagtggataaaaaataaattccagtgctcagagctcttatctgtgtttaccatttctccaaacagtgagtgacctactctgactctcagggtagattatcaacaaaaagcacacaggaagtaggggtgggtggacggtaaatcgtggaccactcctccttcccttcccgtggcatttacttggtctgtcagagtgactaaaatatgctagggtcacagaactgtctttgagcagatgaggcacatccctggcacatcagaccaactcagaggtgaaggcaccttggggtcaccgacccattaacaaaggtacctgctaatagcacacagcatttccctgccacatacgtgacctatggcacgtgacagacacactcttgttccctgcattcggtctgttcccagttcttgcaggacacaggacatgtgagtttcatattattccctgttgctcacgtcttctgtccacccttggtctgcacactggtatctgttctggcccagctcctcccctagctggcaatgcactaaccttccatagtcctgaccctggcccttgataaggggtgacccatgtactcatcagctttttgtcacaaaagcaaatactcaagaaggtcaattagtaaagagaagaagggctgtttgggctcccagtgatgaggcttagtcctggttattggccttggttgcctagaacaagcaggattcggtggagtgaagccttcaactcatggctgagatgttaacagaagaggaatgggctggggtccctctacccacttcaaggtcaaccttccaacaactggatgacctccctctaagccccacctcctgcattctcacttcttccagagagctcagggctgctgctttcctggatgagcctcgaatacacgggctgtcagagagggtttagagccagattacagcaatctgagacgttgttcagagtcccatactttctagtgacccagccacctccagtgggcagtagcgaaggctcaggccctctgcttttctctctcttaattcccaaaggcacagatactttgtgtgactgggtttcatctccccacttctaggtacaagctgctgtccctagggggtagggtgggggccctaacatagatctttaggaaccaatgcctcctctatctaccccatggatcctgtttccatctttctctcagtcaccagcagtgaagcctgtggacctctatctcccaagcctccccccccccgttctactcttcccttataacagtggttgtgatgcccaggttgcatgtgagaatcccctggggagattggaaaacaacaccaattgacgcagaatgtctcgggggtgaccccaccccatcctagccccagcagacagcaccaagatggagatgcctagcttacattctcaggctgtgcctggagctcactgtttctgcaataacccgctgccttgtttcccagctcctcctactccatctattcttcctgtccttgtcagatcacaaaaaataccattttcactgtattacctccactcctcagaagccaacagtggccccaccagaacaataaatctttgcatgaacaaatgaatggcttccacggcacacaatgaatcccatatgctctgggactgcatcttatctccccttctccaccctccccacctcccacaggctgctaagcaatgcctatctgtggaatgagtgaataaatacattttctctgcaaattaaatgcagtccactcttcctccacacccagagagcaggccgggtgatttcacgatcatttacaaaagggcttatttctctaagcatcgaatacaatcagctctgagtgattcatgctaatggagaggacagaatgctaaatattataaaacagcagctaattcaaaagcgtaaatttgcttgatgccagaatgcacttttgctcatgagtgctttcactgcatttgataattgggacaatttttttaaaatatacttttttttttagatatgtctgatctgtccccatctccccctataccaccccaagacacacactagtagaataaacaattcaactcccaaaacagcacccaattttgttgcctcaaccctttcccaggatggttcaaattgctagatctcagactgtcaaaatgggtcgagggaagccatggggggaaacatggagttggaataaataggaacacttgctccctttttaaggattcatccccaaaatttcaggcatcacaacccatttgtagaagaatttgaaatatctactgctactgagccacacatatttaggaccctgccgcttattcctggacacataccccaggaacctgtgtacaagctcaccccaaaccatagttaagaatattcacatcagctctgttcatggtggccttcaaactgggagacacccataagggacaggatggacccatggctatgtatgcacggtaatgacggcacacgcgagcgtgtgcttcgtggcagcatccctgactagtatgtacaatgccctgggttccatcctgagcacaaaagaaacagcaagaggcagagggggtgttacaactacagctacgctcaacacagatagatcacaggcaactctgaggaaatggctcagacatggagcctgcttactaagcctgccactgacaaaagccataggggacagggagacaaaaccattgctctgtcaggtacttctgaaatggctgggacaggagtggggcacagagcactacagagttctggaatgtcctgtgtcttggtttggaagaggggaagaaggccaaggtaggtagtaggccaaaaggcttagggggggagagatccattacaaggtgacaaaggttggcctgcgtctctcagggcagttctgaggactgaatggcatgcagatgtgggatctctgatgagtagaacagaacctcacaggatgaaatgctatggtttttattcggtaaaggcaagatcctacagagggttggcacggccggtgacgttcaacctggggccttatgtggagagggatgatggtggtggtggtagtgatggtgatgatgatgtgtgtgtgtgtgtttgttcatatgtgcatgtgcatatatgtgtgtggtgtgtgtgcatgaatatggtatgtttatgtatggtatgtggtatgtatgtgtgtgcagtatatgtatgtgtgtgtggtatggtatgtgtgtgtatggtatgtggtgtgtatgtatatggtatatgtatatggggtgtgtgtatgtnnnnnnnnnnnnnnnnnnnnagtgcactatgcctgtgcaagtgttgtatctccttttgtttgtcccctcagttaattccttaatggccttggccttccagcccaggcacacctgcaatagtccctttgtttgtgtgagatgaattctggctcttgtcttttaatgtggatataaatagatgccatgtccatgctcttcgtggcttcttctaagctatgaatgtatttctgcctctaactgccaaattctctaaaactagcacacaatactttcagagcattgctacataagccagggaacttaagagaagagtgtgtgcatgaatgagcacacacacacacacacacacacacacacacacaccccacatccaggccctgtggcttcccacaggaacccactatgaaatctcagagacaaaccctcagttgagagaagttagaggaagcagtgagaccacaggccagacagggacacccaagccaggcagggagaccccaggaatggcagtgtcttagtcagagtttctattgctgtgatgaaacaccacgaccaagaagcaagctggggaggaaagggtttattcagattacacttccacattgctgttcatcgccaaaggaagtcaggacaggaactcaaacagggcaggaacctagaggcaggagctgaaacagagaccatggaggggtgttgcttccttgcttgcttcccctggcttgcttagccagccttcttatagaacccaggaccaccagctcagggacagcaccacctaccttgagctgagccctccctccttgatcactaattgagaaaatgccttacagctggatctcatggaggcatttcctcaactgaggcttcttcctctctggtgactctaacttgtatcaagtggacacacaaaccagccagtacaaacagggagaagccagaccatgtgcctcaaggtggggtttgctcctcagtttgtggtcaagggacagggctgaggtcatcacatttcccacagatccgtttcatgcaatggtctgtgctccctggagagtcccggtgcctgggaacttttcttcctatgtctgtatttccccctacgcttaaaagatttctaattccctgcttctagagagaaaggagacatcactagactctgtttgtacaacacaggagtagccatggggggaggaggggtatcaatatcacgtgatgctgctggagcataacaatcagagccagccattttcatttctgttgacaaaacaagaaaatgttaatgtttccattcggtccctgaatctacaggagaaaagtctttgtaaatcaatgttcttattttcatttacactgcaggtcacatctgtgcacacagctagtccatggctatgtgtcaatctatgagtaagtgtctgtgtctagctttcaaagaacacgataacacttaatacattcatacacacacaaaaaaacgtaaatgtaacgggggatgggtaaaaagtctaaaggctgccaggaaagggaaaaattgttctccacttaaaagatgtgccaatgacctgggtgtggtgacacatacctgtaatcccagcacttggaaaactgaggcaggaagatcacaagttcacagccacctagggctacaaggcaaaaaagaccctatgtcaaaaaaggaagcaaaacaaaacaaaaattaaacagcatttaataagttcaatgtaggttgctggagacatggctcagaggttaatgacacctgcaaaggacctcttgcagagcaccctggcatccatgtgctagaacgcaaccatccataactccagttccagggactctgttgccctcacaaagacatacagacaggcaaaacaccaatggacataaggtaagaataaattaatttttaaaaagaggctcaaaacaaaagaaacaaagctagaatttaccatccagtgaagaccaaacataaatgacaatctctctgaaaatcaagggatcatcatgtgcgagtgtgaacgtgggggaggccccatgcacttttcagatttccattttcctgatatttaattttctcctttctaggagcacagaaattcattttataaagcaaatccccgttgatatgactttaataagccttgggaatccctttcttactaacactccctacagaagacagatcccccttctcaaaaggagtcctgccagtgggtgtacccaccacaaacaccaaccagtttgtcacagtgtctggaagctgacacttccatcatgcatttgcccttcctttgagtcaggccggggcatctgaggggacctactgatggcgccccgggcagcggggccaaggccggagctgtagtacgatccattcataactgtgtccttcacttgtggaacatggtggctccccaaggactggccagggagagggacagatggggctttttcacaggtgagaggtgggtttcaggttccttacttctaagtctggaggctgcagaatccagagtgacttcataatatctttctgaaacgtagatgtttgacatgttgcctggctggaagtaagcgaatactcctactcagctctcatagttatcctggtccccccatctcactgtccccttaatctgctaccctctgtccccacttcctggacatcctcatgaatatttagcaactgttagaaactgggacaacagcctggggtgggccagtcataactcagtgtagtcccctctgtctcttcctactatgtggacaggacaggacaggacaggtgtgcgtgtgtgtgtgtgtgtgtgtgtgagagagagagagagagagagagagagagagagagagagagagatcagcattcttattcatgtttgtacacatggaggtcagaggtcaacatgaggtagctgtcattctctacccacgatccccccttctccccgagacagggtttgccatcagatctagatcatgccatgtcagctagactggcttgtcagtgttttctggaatcctccatctctgtccccattcctagggtacagagaaggctgccatgcctagtttttatatgggtgttagggatctgaacttgggtctttgagcttgttccgcaagcacttacacactgagccatctcgccagctccagcagatgctatttctattttaagcatgttgagtgagcctccagccttttcttccaaggacacttggggagggggagggggagggggcgtattttatctctttgaaacaggatttctcactgaacctggagcttgctaatttggttagaccagcggccatcaagacccaggtttgctcctgtctcttgttcactggtgtagggatgacagaagtggtcctcaacctgtgggttgtgacctctttggggatcccaggggtcgcctaagaccatctacatatccgatatttacattacaattcataacatgtcatcactacactaaaaacaaaatgagccatgattctttcaaaacagccaattgccctgatggagccgtagtatttgtctcatcctcttttgacgtatcatccacacacttttctttatgacggccagcgtgggcgtgcctccctctgggtccccagggatgtgtgtccctctcttctcccatctcacccacgtccacttgctcacaccatggctgaactggggagccgaggagagcgatgagccagtgtgctttcgtgcacctcttgtgcctggctcagggctcacagcctgggtaaaggaatgaatggttccccaagctgaatgagaagctctgttccccacaagcctctcctctacaacaccagtgacgtcccgttgccatgatctgttagaagtgtggctccccttgtcactctggatctctggcaccacgcccagcagctgtctaaggtgttcacggtgagagccctggtagaaggtgctcagaacacactcccagcaagactctgggctcacaggtttcctccctggccttcatttttcctcccctgtatcatgaagaagtcagatacaatgatttctatggtccctttcaggaactggggcgtccccatttaccatccgtttgctgccctctgctggcagctcagctcaggccctttgtgtcccggagatcctggacttttgttgcctggcctggatctaactcaaatgaagggtgtgtttctttttaccttgtgtgcttacttttcctatcctggggtcactcgaggttacaggaaggctcttgaggggccccatcacaggtcaccaacaaccccccccccagagtgggcctgagtgcctacaaagtcagaacactggcccattgtgatgctcacgggtcacctgagtcaaagtttaggggcagtgaaagccagtgcagagaaagaataaatgaaggtgttgactttataatgaaggcatcagttaacccaaccagtgagctcctccttttaacaaatccagacaggttataatcacatgagcttagttgggagccagcaccatttatttacccatcagagaaacagctcctacatctaatttatatatatatatatatatatatatatatatatatatatgcataatacatacatatatacacacatacacacaattcatgttttgtgtgtgtatgtgtgagagatgtgtgtgtgtgtgtgtgtgtgtgtgtgtgtagagggaaagggagagagagagttctatattgtggtatagtcaccatgtcccttcctccctacctctctttcttcttttctctcacattctagcatttgttaggactcctgtggttgcagatagcagggttcaaagtgtcactgacttggtccacgagtgggaacctgcctggagcagacaggaccaagaattctatgaggcaccaggaaatgatctctgcccttggcctctgcctctcactttacatctactttgtttctttcttgaaccaactggtattttgtgctcactaacccacaaagcagaaggcggccaccaacagctcatgatatacccactctcaactccaggctcctttttctctgtcccaacccagttttctacactggtccccttggactaactagtcacgtcttccagagctgactacacaatttgtaaggcctaaagtgaaatgcaaacatggggctctttactggaaaggcaggaggactgctgagcattcgggtggagcacggctcactttcctccaaggtctctcgtttgccatggtgctgtttcatttctactcagtcatccttagtaaagaaaaaaaatcacctacattttcaattatttccttgaatttttccacccatctttatatcatacaaagccagtttccaaagttgcgtgcagagccacagaagtagtgcaattcatgttttgtgaagtcaacagccagaggacacaaacaaaccaaactgctgaagatggaaagcaaaagaggaagtatccccagaacccccaaacttcttcagacctgggctgagaaagcgcagaccttcacgggtgccctgaaccccagtcccaagcctgactgcaggtggggtctgggaaagtcagtccagctgtctccccttcccacagtccccacagcagagcactacttccaggagtcttggatctgtgcaccctctggccagtcccaccacatacccatgttcttccagctggaagctaagatgaccacatggtcaccccaagatgctgcaatataagtgagccccattcacattttctcatatctgtgtcaagggtcaggacagagaaagcaactgagaactcctctagggaggtaacagggggaggggcagggagcagccatccaagccccagaagaagtacccaagctctttcccacttcaccccagaacgcacatctaacagtgaggttatgaggagtctcaggacaacaatcacagagcaccagtcacacacacggggcctaggatggagatggaaatgtgataagaacccccaaatggaggtgggcaagcgttgggaaagccaggcaatggctgacattttataccacaaagtgcaaacatctcccttgccttccaaactcatgagcattcatagacagggggttcaaccacctatgtgtgctgcaacctggcatgacgatccatcactaacagctgtgttgtattgagtggctgaaccatcgtagatcagctcaagtatttcttataggcttcaagactccaggtgtcctggcacagcctcctctcctgccactagcatttctgcattttatagcagtttcccaggtaacactgtagctgcctcaggactagcatcagggactagcagtgccccacctggcggaatggccttgtggtcctctggttctgagcctctttcctgcaagtagagtaaaaacctcctggggtgggtctgtggagactgacaggtgcaggatggacttggtctgtgggctgcctcttgctgctctgcagaggaggggggcacagaagaaagccctcccccacaactgaaaggagcgaggctgtcactcagtgtgttccctacttttttcccttgctatggctaaactcgtgacacaaacgacatttggaagaaaggattgctctcacggtctcagtgagtttggtccacctcagtggtaatggtacagtagagtgacaggaacttcagtggcatttgttcttaagaccaggaaacagaccaggacctaggctttaacaaccaaggcctgcctctagttacctacttccagaagctaggcttcacctcttaaaggggcctgactgctctaattaatgccctctcccatctggagaaacaagcattcaaaacacgagcctgtgagaacatttcagagatgaacagtaacacctgtcaaacagaaatacacacacacacacacacacacacacacacacacacacacacacacagtaccctgtcccacccacggggtacccattccctggtgactacacacactaatctgtcctccccttgagagtcaccagatgttaggaaccatgacaactgcacccccccccaaatttaaccagtcttttccaacttctaatctgatgtgcgagaaacagaatattactattttgcaatttttttcattgtgacttgtattcctcctcttgggctttgcctttttcataccctttgacagctttttgtctgagctgtctcttcttgctggtatataatagctttggagggttgtgtcaactgttcatccttgctaactgttgcaagcttttattctctgctgcatctctgtgtgtctcttagctttactgctgtaccaattaccatccaggtgacagcctctcagagatgcaggggaggggggcggggaggggggagctgccaccttgctttgctgggcggattaaacaagagcacgggcttgccatgcttagccatgccatcagctcccaataaatgggactggaactgtagtctcagagtctgcctttgttgcttttcctgttgctgtgatcaaaatactgacaaggcctaaggggaaatggtttattttaggtttcagttccaagctacagcccatcatggtagagaagtcacagagaacaatgaaagcacgaatgccaatgctcaacttgcttcccccactccacaggccagaatcccagcacagggaatggtgtcacccatagtgggcagttcttcccccacaattaaccctatcaagataacacactgcaagcccatctcccagctgactttcccttccgttgagttgacaacacaaaccctcacaccagatctctgccaaggtagagccaaagaccctcaagtcaaaggctgcacttgtttgtcttcagtaatgtaaaaaaacaagaaataaaaacacacagagcatgctgggggctaccgtgaggccatctggacggaatctcctcctcctcttgtgggacttgtgtagaaatgtttattgaagttggaatcagagctcatgaaaaaagaccaagagctgtgagattccttctaacccaacctccttttgtctgcttcctgcctcagccagcccctgagtaccacagcctgcaggaaggtctgccgtatctggacatggtgatttcagagaccctgaggatgtacccaccagctttcaggtatgtctgtggccccctgagcatcactatttggggccttcactgtctacccggtatcattcctaaagggctgggttggttaggttcctgggtttctttgtatcccttggggcaccagacacaaggcctgagaagtctggcccattctcctataggttaactgcctttaccaaacatcactagcctttgcatggcttttcttcccagcccaaccctgtctctttggcctcctagcctttgatggaatctgcctttgtccctgaccattgatccatccacccttcactctttcatcacctgtacattctgtgtaggctggaaattagccaaagctcctgcccctggagggggtattgagcagaggaccacctactagaatgttccttccctggtgttccagctccttgctggagctcttacataagagttcttgcaaaaaatttcatagtatttcttttttcaaagagtgtgtgtgtgtgtgtgtgtgtgtgtgtgtgtgcgcgcgcgcgcgcgcgcgcgtgctcatgggcttatgtgcagcactagcaaggactattttttaatgtttatttttctgtgcatgtgtgcctgtgtgggtttatgtgcacctcttgcttgcaggtgccagcagaggctgaagggcatcagagcccctgggactggagtttcaggaagttgtaagccatctgatattgatgctgggaactgaacctggagaacaataagcactcctaacgactgagccttttctccagctccacagtgagggcttctgcctggcacgccagcactctgagctggaactgtcctacatcttacattcttgggcacaattcagcactcataacaggtcaccaatgcatcatcacaccaacctgcaaatcagatcagtaaccaggtctacttcttgccaactctcccaaaccaagtgtcccagggggaaaggtatcttaaccagggtcccttgaaggtagtgagaccgtgagcagacttcactgaaacagcacgaaccactgaatcatacccgacaaacgtcactcagcactgtttcaaatccacacagaccatatggagatagcttttgtcagttttgagagaaacttgtgatttgagggtagctcaaagggatgtttcaaaccagaaacatgacaggtgtatatacagacatgatccaaaatgcacaggcctgcaaatatacgaagctgctgccgtgcagttgagggtctccatacacatcagctcagtaattcaaaggcttccttcttgctcttctgatgctggcatgaagacccaagtaagtctatggccctcctgtggctttctgaggagccacaagtaacctgatgtccaatccttccttcctcatgatttatatccagctttcctcccacgggatttgcaggcagctggtatgcgctgcaaaatgcaaattcaaaatgaaattcgaaacaaatcgctcactagtaaaaagagagcaaggctgcttcaaggaccatctccaagtcccggaaaatgactgacagctgggggtcaggtcttgccagagttcctgagattcctggaaaagaggaaactggctgagctcaacagctgtctctccacagcaggaggaaaattatataaacgggtcaaaaccgtatcttttcaggctgggtgtggtggtgtacacctctaaccccagcattcagaaacagagttagacagacctctgtgagcaccaggtcagctcgacaacataatgagaacctaactcaaattgaaaaaaagaaaaccaaatatcatttcccagatctaaacccaatcaagaattcatctcatggccagacatggcggtgcacccctataagcctagttaacacctgagcagctgagccagaaggagcgtgagttacaggctagcttgaactgcatacaaagatcctatctttaaaaataaataaataaaaaatattccctccccaccccccgaaggtctcatctaggtgacacattaaagaatgaaaggaccaggctctaaaataaaacgcacagggacagacacttctgcatgtggataccgccccaaagcctcctgattgtaacttaatatttctgtccctatctagctttcaaatgaatgagactcagactatgatttatttatttagcttttgtgcaattgctgtgtaaattaccccaagtctaattttctaatagctagactggctacttccccaactgtgctccctaaatacttgctgtttgagtcttctagcagtctgtcctgagggtggggggcatttcattcgggcacttgttcctggttcatctcgtctaacagagacttcttgttccctgtgtcctcttcctcctcttttctcctcctggttcctacctgcgaaccccagccaggtaactcaaaggctgcctccttctatcctccccagttgtcttagggtttctactcctgcataaacatcatgaccaagaagcaagttggggaggaaagggtttattcagcttacacttccacactgctgttgatcaccaaaggaagtcaggactggaactcaagcaggtcaggaagcaggagctgatgcagaggccatggagggatgtttcttactggcttgcttccccttgctccatcagcctgctttcttgtagaacccaaacccagggatggcaccacccacaaggggccctccccccttgatcactaattgagaaaacgccccacagaagcatttccccaactgaagctcctttctctgtgataactccagcttgtgtcaagttgacacacagaaccagccagtacagcagtaattggctgttgccagttttatttaacaaatagttttaaattggggagcaaggtttacaaaggctgcacttggcaatttgctcatcttggggcagccagatcttaggtacagaaattagcatgtgaatacagcatttgaatggcagcaccagaccagcccctgacacactatacatagccaatgggtgcaagaatggatctgggaaccagatgccaagatctcccttgttgatgggagaggaagtagggaacctgaatgaatggtgaagcttccttcatccaatggcatccagtgcctgggctgctgtatgatcctacctgggatctgatctgccctgagcttctctcttccgatggaagtggggcctagatatctgttctgcttccacacagcatgggggactcagaggtgacagaggaggaagcacctctaagcagctgcaggatgaaatctcagggcaggagcaccaggtactgggcattgcaaccaccaccagcttgggcacacgtagctccatggccttccctaaattccttagaggaaatataattatcagacaaagtgcaatgacagattggttttgctcctgaaaggaattacgagtaactatgggctcctctgtttagtttgtttaatctctctgttttggaggtttctttgctcctatagctgctccacaggcacacccagccttaccaacccctggctaccccatgcacagtggtgcagcatggccgccacagctgctgctgtgcacagggctgggaatgaatgtacagcgtgaacactttcttttcccgtggttttttaagaaagcatgttgactttcacatgccagtgtggcttacctccacaggcatcacagacatgaccactgtcagttgttcctaagccttatgcagcagagctcagcacagtttcatgagtcagacaggagacccagcatcacctaggagggcaggccctatttcccagtttgcagaggatccttgttggtcctagtggagtttaggaagggcagaaaggtggggttactatggcatggtcatgtgttttctggaactgaagttgggaatttcatattccatgtactagctgagtttgaagttctgggtttttggagtcagctccaagcctcatttggatggtgtcagaggctttgaatctagacaaggtctctagcctggcttcttactgtttctgagacatccaaaacagaaagattaaacagaggagcccacagttactcgtaattcctttcatgagcaaaaccaaaaatatcattgtactttgtctgataattatatttccacttaggaatttagggatgtttaagcctatcacttgacataagcagcagaagattctctttaacatatgtgtgtatgtgtggggatgcactgtgcaggtgcgcatgcacacatgtggaagtggccagacaatcacagctgtcatcctcaggaaggccacccatcacctttgagacaaggtctctttggcctgaacttcatcagttaggtaagactgctggctggtgattcccagtgacactgtctctgtttccccagcagtgggattacacacctaccacacatcccgcatctacctcaggtgtgtgtgctagcaaggcatgcagttaccaactgagccactgccccaaacacgggattatttaaattttatagtaactgcaaaataatatgcttctacttaaaaaccaaaacaaaccctaaacaataggaaggagttaaagaaaatggacttccagccctgctcagtgacatccctcgaaagagaccatggcagtttaggcgttgagttggccagttttctattgcaagcacaaacacctgaaatagacagctttaaggaggaaggatttatactggctggtggttccaggacttttcatccaaagttagtttgcttcattgcactcaagcctgtggcaagacagaaactccccagtggaagggcattggggtgaaagggctgcttccttcattaaagccaagaaacagaaaagggggagagaaaaacagacaagagggtaaggggagagggcaagataagagggaaaggtagaaaagggggaaagaggatggaggaaagaggggggaagagaaggggaagagaaagggagagggagagagaaaagagggagaggaataagagggaaaaatgagggtagggacaagatagatccttctatgataggcccaacctgcatcctctgatttggcccactgcctagtttccaatgccactaaattatgaattccatcagtggatcaattccctgacaagttcagagcccccatgatccaatgacttgccccaagacctgcctgtgaacagtgcactgggaaccattgctttaaacacatgacccttagaggggacacttcatgttcagaccatatatggtattcttctagaaatgttatgtccacatgcaaatacatatagtctacttcctcaaaataaaacatgcttagacaaaagaaacaaacaggctgggtgtctactaccagatgaggaagatgcctagagtccagcacagtggttctcaacctgtgggtcatgacccctttgggggttaaatgaccctttcataggggttacctaagaccaccagaaaacacagatatttatattatgattcataacagtaattagagttataaagtaggaattaaaataattttatggtgggggtcacaacatgaggactgtattagagggtcacagcattaggaaggttgagaaccactgctctagggtaatagttgaccaacagtgagtatcttagttagggttttattgctgtgaagagacaccataaccaagacaactcttttaaaaggacatttaattgggggtggcttacaattttagaggttcagtccattatcatcatgtcagcctgcaggcagacatggtgctggggaaggagctgagagctctacatcttgatctgaaggcagccaggaggaggctgtcttccgtaagcagcaaggaggagggtatcttacgagtgggcagagcttgagcactagaagacctcaaagcccacctacacacaatggcacacttcctcccacaaggccatacctcctaatagtgccacttcccatgggccaagtatattcaaaccaccacactgggtatacttatactacagaactgctcccttgaaaatggttcaaatgacagtttatgttatatgtgtctactctcaacaaagtagtaagtcaacaaaccttaccaagaccagttctagcattagaatactccagagttatcataatagctagtaggacaaacacccttattctagccagccttacatactattttaagtatttagagtacagacagttttccactaactccaggccctctactagggaagtacagaggtgagaaggtataggagctgggaacaggcagacaggagtagtacacatctcctgatatcttggccatgtaagggaaccaggtcttttctatacagggaaggtgtctctgagaccaacctttgacccagggtggctttcctaatttctcatctcctggtcccccccccccacacctccccagtcccctggttttggttggttggtttgagaatctgaggggtttttttttaaagatttatttattttatgtatgtgcactgttgctgtcttcagacacaccaaaagagggcatcggatccaattacagatggtcatgagccatcatgtagttgctaggaattgaactcaggatgtctggaagagcagtcagtactcttaaccactgagccatctcttcaggacctatttcattttcttaatcacggcttcatcaatgatcagtggcccaggagggccaaaaaaaaaaaaaaaaaaaaaaaaaaaaaaaaaagctgccaatgtccatggggttggatgcccaaaacctttgaggatcatgatgaggaccatctgggggagggaggagacagaagccagacagcagagatgaaccaccagatgcgagggagaaagatgaggggaaactgagggtaactgagagaggcttgactctgaatgacagcatgagaaagtcaagaatcccctgcaccccctcagatacctgcccttgaaaagtacctctgccccccagtgcaaggcacgcagagggccaccagcctcactttacctgcaaatgagcaatgtgtgaagtgaggagggtgaggaagggttttcaattactgagacaggaaggtgaagtctgaaagaatcccatagggtaccacagccccagctgcagttggagagagagaaggtagaagaggtgctgctgaagagaagacagtacctgtaactccacctctgtccaaaacaaggcttgatcccatcctttaacattatctataaactctaagcagaactcaaaaggggctgccctggagattaaaaagctaaaggttacgtttgcaccctaaagtaagcaaagagcatctgcagctctctacttctagttccgcttccagaaacttatttctagtcccaaagcagaacagtatagtgagagcagctcaggttggggaggtcaggtacggacatcacaggatttgaagtctaggctcccgtggtggtgtgactggagaagaggctgggatgcagcgactccaggtacgcacagggcttgaaaggattcaatagctgaaatgtgtctgctctgtctcaagcttggacagatcaatcagttttgtctgttactgaaagcaagcagtagtttaacttctgagtgctatgtggcaggatgcagtcctacctttggcaagaactcgaaggaagagacaaggaagttgtatttgacccggggtgggggtgggggtgggggtgttttccatgctcgggtccaagggtggaatcctaagtatcttagttcgggttttactgctgtgaacagacaccatgactaaggcaaatcttataaggacaacatttaattggagctggcttgcaggttcagaggtttagtccagtatcatcaaggcgggaacatggcagcatctaggcaggcatggtgcagaaggagttgagagatctacatcttcatctgaaggctgctagcagaatactgacttccaggcagctaggatgagggtcttaaagtccacatccacagtgacacacctactcacaacaaagccacacttactccaacagggtcactgcttccaatagtgtcactccctggactgagcatatataagccataacactaaggctatagaactgtagagccagccagctgttaggttagatgcctggcccatggcaataaggcaaaactccagagaactatattgggtttgcaattttaaggaacggagttcatgcactcacaagtgatggttgttgtgagaagctgtggtaagacaagacacagaaccccaggaaccaagaaccgtcatcatagacaggccagggaggagagccagtaaaggtggctcagaagagccagctcttgtcccacacagtgggcggctccacactccttgcagcctgagcgggcaaacatcccatgctgtcaaagcagcttctactccatcactgctcgtggtcttaatcaaaggtccctgtcccaagcttgttccctgagcatcccaaaaggcccccagattcctggcttctgatctgctctcttagtcacagccttagtccatgagatgtagttctattagtcaggattctctgaaggaacagaactgatagaacaaaaatatgtgtgtgtgatgtttactaaagtagcctacagctgtggtcttagtctaatgatggctgtctccttagagaaaggcctagaatctggaagatgttccgtccatgagactggatgtttcagtcgtaccaatctggtgctggagtcctagggaagtcctagaaagcttcaggtttttagtctgcataggaatcctgaagaagcaggctctgataccagtgaagggatggttcattagcagggtagatgggcttgccagtgagaatgaggacaagcaggcaaaaagcaaagcttccttcttccatgtccttttatgttggctgtgaccagaaggtgtggcccagatttgggatgagtctcccatctcatcagaccaagtccctcacaagtatggccctgctgctttggtttttgttaattccagatgtcaagttgacaaccgagattagccactcacggctgatccgccattagtcgacggcacatagggctaagtgaagatataggttgcatgtccacaaggtgggccacccattattttaatgatcttatcatgagaaccaaccacagagttgtgggcagagaatagaagccagacaacagggctacactaccaaatgaaaggcgataaagcaaaagggagggtgggggtaattagaggaggcttaactgtgagtgtgaacaagagaggcagtagattacctgaatgcagcccctggaaggcacctctgcagctccatgggactggaggcttcttgggagtaggggatttatgagacaaaaaattgttttctgaatggttcaccttaagagcgctgtgtcccatgtctccgacagcactccataccccatcctgggtcccataacaatctgaggaccctagctgcttgcacactggcaagattttctgcctctgtctcccacaggttcacacgggaggcagcacaggactgtgaggtgctgggacaacgtatccctgcaggtacagtgctggagatagctgtgggtgccctacaccatgacccagagcactggccgaatcctgagacctttgaccctgaaaggtaagtgaattccatctagagcaggggactgtgagggatgtgagtgtatgggatagaaatgttgctatagagacaaaagccaagagacatgggcatagccatcctcaaagaaagatcacaccaattcagatatacggacagtgaggcatcaattccaaagggaaaatggaatggagagatctagcgtgacagcagtaatgtccacaaggatcagtatctttggtttttctaagccagagcacaggaggcagagtggtggttgttgttttaggttcttaagatttcatttctagttatatgtgccatgtgtgtctatatccaaacatgtgcatgtgagtgtaggtatctatggaagccagaagaacatcaggtctcatagagctgcagcataggcaggtgtgagctgcccaacataaggactggaaaccaaactccattcttctacaagagtggtacacaatcttaactactgaaacatctctccaccttgatatgtaaatataaatgaatatatatatatgtatatatatatgaaagcaacaaaccatcacctccatcattcagtgcactcacaccagcatagctaccctttaactctaagcccatgaaatccaaaagacctggatcctcttcctttcatggacatagatctggcccattgtcaactgcacctctaggctctgtggtataaatacctgggcagcccccagctcctccttctggtcagaatcagtcacttttccttttgctgtgatccattaggggatgcaggtaaggtgccgctgtagttttcccttccctgactccatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggttctggctcaaaactcctctccagccaagctgactaatttttttttttttttggtttttcgagacagggtttctctgtatagtcctggctgtcctggaactcactctgtagaccaggctggcctagaactcagaaatccgcctgcctctgcctcccaactcccaagtgctgggattaaaggtgtgcactaccacttcccggacaagctgactgatttaaactggcttctctcagcttctaagtgaaaactctgcttgtcctcaaactaactctggcactttgttctaatctggccccttattctctggcttcatctgcctttgctgacctgcaatggactcatagacaaactcagctctactgcactacaatgactcccaactgactggactccactgcgctgaactgaacatactgaacagaactgactgaacactcaaactgactgatctaaactgacttccatccccttctctctgcctgtgctgctcttaaatagcctccctttcctatctgttctcatgaaagttgggtgtatcccatcttggactcattctgtcaaacctttctctgactcatcactttgtccctcaaccagaggtcactttcaaacatggctgcttccttctacaaactaaccttaccttcactgtttagatttaaagatgtataactaagggcatgtccttattccagccagagcagccatgttgctggattaaaattcctctacacccagggcctcaagcttcccacatcttgaacagcaaagccagggtggtggggaggcagctatcaagtcttcaatgggatgacatgttggacctctgggaaggcttcaaggatgtggccaaagtgcctaaaaactttgctgagaggaaatgagaggagttatgtggtccaatataagagggaggtgtgatagggtcagggtatgcttgtcaagccttggaattctggattatgtcctagattcacataccgttggataataacttcctaggtgaggcgagaaggtacacccagctgattgtctgaatggaacagtgcttctaagactgggcagaacactgctgagacgttggtgatcggaagctatcagttacctaaagccttaaggacagtcctggacacaggatcttgttggccctgacgagggaagggatctcacatgaagaggtcactcagccagaaatgggactttagatcagtggttctcaacctgtctcaaccccctttgggggtcacatatcagatatttacaattcataacagtagcaaaattacagttacaaaatagctatgaaataactttgtgatcaccacaacatgaggaactgtattaaataaagagtcacagcattaaggttgagagtcactgctttaggttgagcaggtatttcaggccaacgataaccttcacctgacccttaggttcacagcagaggcccggcttcagcggaggccgttcacatacctgccctttggagctggccccaggagctgcctcggagtgcggctgggcctgctggtggtcaagctgacaatactccaggtcctacacaagttccgctttgaagccagccctgagactcaggtgagggtctgatattccagggtagggccaaccctgcttctctgccccacagtgcatcagcttctgctagggcctctcctctcagggacgcccatctcttgatgaaacagcagcctcgatatcatcctccatgagaagggagatgaacaaatgctttgtgctcaaattaagtgctggccaataatcccatgttgtgttttcttattagcatcgccctcagttaaacagcatatgtcctaatggccaccaatagctttagagtattcagctttttcctatagaagccaagggaccctccctctggctctttctgttcccaaaggtcttgtctcccagcccacagctaaattttcacaagtcatgcttcaggctaggttctaataaagttttctggtagatatgattaactttatcaaatgttttaatttgttctattttaggttccacttcagctagaatccaaatctgccctaggccccaaaaatggagtctacatcaagattgtgtcacgctgatatagaaggcacgtgggaaagaggaagcactttgtaatggtaacatctgcacatcgctgcaggagggcacccgggattcagatgaaagcctcgtgtggagatggagagtttataggaatatatatcttagggtgatcaaaagggcacatggcatgtgagcctactttgtcacaattcctaaatgtttaataaatgtttaccatgcttcattttgacattactcagtggttttcttgggactgagatttaacaaaggaaaggtcattttgattaaactgagagtatggtgtcaaaggaagtcctggcctcaggacagaggtatttacagtgcaggggacataggaacacacaggtgaatagtcctgacagcactggtaaaggtttttttttttagcttctcatgattcttgggtttcagaaaataatgtatatagacactcagcctccaaagtagctccaaagcctcattatactttggttttttaaaaggacagagaaatttattggaagattccacagatagacctcccttatttccctgacagttctcccaattcctgaccactctacagccactcaggaggcctaagtgtgcaggtccctgctgaaggaacagtcctgtgcaggaggggtgggcatttgatgaaatgtgttagaatgtatctagtgccaaagtgtacaggatccagggcaagaacacatacatgcaactaattagaaggctctgtgaggacccagttgggatctactagagggttttatgcacatcctatttcctgcctcaggtttactggtgttacaaagaacagagggggttgtaagtgcaagaggggaaattgaggattcaaactgccatcaagggacaggagtccagtgattctaatgcagtcctgtccctattcacaacagacaaggcaaggcaggtatgcctggggtctataaatgaagaaacagccttttcgccccaactccacacaaccaggcaccagttcagtggctctaagaccctccctagcattgtcaatccaaacaatggtctccagcacacacaggaacaaatgccacccccacccccatcattgcaagaccaagagctcaaacaaaacacaataaactttcagaaccatccaggatgtaatggagccacattggaaacccatgaaaatcacactgtctacagctgtgtggctgaccctaaagggagggggacgacttatgtttcatttaactcatctctctctaggctgattaataacattgccctgtgtaaggtttaaggtcactccaatgatggtaactccagttaaattgccttggatttaatcttcaagggacatacaagtgatacaactctttaagatggagctagcctccctgccatcttgggccagatgagtgcattcagacatagcaacatgtggaaaacacattgttctagaaggaaactacattttgtgggcctaaacttatgagttagaggtaagaagaaataatataaatatgcatgtgaacatgtgaccatagtgctagagcttagaaggagaggtaacaagtgagggcccagactttcagtcctactgagccagtgatatcagctgttatttcttgctgtggtctgaacgtctcacctctaaacccatgttaaatctgcactcactctcgagctgactgtttgggagtgtgggttctttagaaggtgattgggtccaaaacaggaatccctcatcagtgagattaacacccttgtttaataaagggtctgggatagtctcctctaccgccaaggttactttgagaagatggccagctataaagaatgatcatgaccagacccccgagtctacaggcaccttgattttgaacttcctagtctccaaaaccttgaacaataaatacctagtgtccattaaagccactccgtttataatattttgctatgtcggcctacaggaccaagataatcccaacacatagcaaagggcctggtgcctatctggcactcttaaaaacagacatcaaaaaaataaactccagtcttcatctacttcagattgtctttttatttccatactctcacgtgacatttgaagcacaggtattcaatctcattgtgacataaaatccacacctggaagatgtccagtgtgcttaagggatttgggtagaggcacttatgggtcaagcccaggacttagggagacactaatgtatgtttcctgccagggagagttaagtttcacttatagcaagaactgcccaagttagtgccaaagcaggggtcaaagtgacagtgatgccgaggcctcccctgtagtccccttccacaaaggccactatgctactctgacaaaagcaaactggaccacaagaccctccaaaccagaattgttatagagacataaactcgtcacagttacaacaatttcataaaacagtatgtataaattctgtgcttggtcttaataaacatcaaagtcagcaaagagttaaaaatacaatactaacatcattataagtcaaacttaggctcacaatcaatactggtaagatcataagccaacctaaaaggacctaaaacctaaaactgttatcagacaaggattaagattgtggcttcaagtcgggcctggttatagaggcttttaaccccagctgctcaggagactgaggcagaatataatttagcaaaaccctgcctcataataaaaacattttaaaagggctggggtgtagctcagtggtagagtgcttttgtagcaagcacaaagccctgtattccatccccagcactaggggagaaaaaaatgtaatttcactgagaagccaatattaaacaagagttcattaaaagttttgtttaaaaaaaaaaaagaaagaaagactttccaaatagctccaccagacagacagatgtggcagaaacgcctaatgcatcctggccatacttactggcggctagtgaacaagttacctagggcaacaaagatggaggggctagctgggggcttggaggaggtagagtattgaatgaggtactcggggtagacctggtgcttctcaaaaactacaaagatggttgggtcggacatgctgttcacgcagctgtcatagaaggcattgctctggccttccttggctggagggcggacgaaggaagtgctgcccctgacgaaatctccgaccagcacccgggccaggaacatcatgtgagagtgtgtgtcggatttactgtagtggtgcgaataggcggcatctctcgcaaagtagctccctgaaacgatacagacaagctgcacagggcactggaagagcacatcctagcaatgggtgatgcagcagcctctgccctttcaccaccacattccctcttccattccacttctctgcccttttcctcactcgtggaggcatcaacacctctctattcagcagggcatccaaagaagtcacctaatccattctattctcagctccaattccagagaaaatctggagtctgctgataattagttctggacttcagtttcccatctatagaatggagcttagttgggtgatatggaaaatgagtaacattcctcttactgaaccattctatagataccagtagttatacatatagaacaatgattcttcaaatgggaacctgaactagaagctgctccctctgcatgggattcccaaatctatcatcagcttgttgatcccacaatcatcacatcagaccaaaactaatgaacaaacagtaagtttgagtaagacaaacagattctttttgctgttgttagtgatgggttgttttttttttttttttttttttggtttttgtttttgtttgagactaagatctatttacatagtccttgctttcctgaaactcattatatagaccaggatagccttatactcaagagatccatctgcctctgaatcctaagtgttgggattaaaggtgtgtgccaccatgtctggccagcaaacagatccttgaattttctaaatttgattatcactatgtgatacaggagaaaccttcttagggagtgctgaagggtaaaaaggtaccacagatgccagctacttgaaaaggccaacacacaacataataaaatcgaggaatgtggatacaatgtatacaagaactacacagacatatgtgtataagtatataaacacatagtctgcaactttcctgtgactttcaaattactaccaaatacggtttcaaaataaccaagagaaaaggaaactagaactcatgcactagatgaaaggacagtctcaggacatagtttctgttctaaggacttcaggaaggcacagcctagggtgctcagcaaggttgaaaaggtgttgctctctttttccaactctcactacctctcagagcatccattctacaggaaacaagtcccagtgaggcaggactgccctgtcttaagttgactgagctcttggtcacacatgtagagcaatagccaaagtactgccagctcagggtggagccatttctcactggcagcattgactggttggctccaactgtagcctctgtaaggctgttttcaaataatttcccaactactgttggaagcacccctaccttacctttgccataggatgtgccgtgcagaccacagacccgccagtcaaagttctgctggcagatggcatccacgaagttggcactagtaccatgaaacagctgcctctcgtctacttccttccccccattttgcttctgcatctgacatttttgcctagaatggtagaaaaatacatggtgagggaagaaggtgctgacctccaaagaacagtctcctgaaccagttttcttttttttttttttaagtttatttatttattatatgtaagtacactgtagctgtccttagatactccagaagagggcatcagatttcattatggatggttgtgagccaccatgtggttgctgggatttgaacttgggaccttcggaagagcaggcggcgctcttaaccactgagccatctctccagcccttgaaccagttttctaacgcagcattatgtgactaaagaggactgaggctgccctggccaactcctggaggctcaaaccacagagcacaggttgaccaggccaagaagcaaaagcaaagcttcccctccatagcaaaaggccccaaaggcagacaggtcctcaaagcaggcatgggctcttccacccagctcctgaatggagctgaacctgggaagtaaagttgtaaggcttgggaggggcatcagccctctgagcccatcctcccttttctactctgtttccatcactgcagaatgctatcctccagacccatgtgaggacaagtcggcaggccccaggccaccactgagagtcataatgaatttctaccctctgtggagagatgctgggtgaccatgatcatgctggtcttcatgtgatagacagacagacagacacacagacagatgatgcccctgctctctggctacagctttacattcttgaggctgatggtgtgagtgaactgtcttgctctggccccactgatcttcagaaagtcaagagtggaccagagtggagtctggctttgctagtcatggtgagaacaagacctgtgctagggaatctttagtcccctcacctttgcaaggggccactttatcatacagccttaggataagaaaataagagaacagagacagttcaaggcacacagcagcacggggtgagtatggtgctgcctctgaccgtcctgaagaggcagagcatgttagtcaataagcagctagcagaacaagaaagagagctctcagtcacacataccactggtagacttcccacaggcccatgttctggatccgctcgatcttctgaacaaagtagaaaggtagtgtacggttgaagatgttccacaccttctgatactcttctgaggaagaactcagagtgatcttctacaatgagaaaatatctcttatatgtcattgtcaaatgattcaaatacacgagctgttcctgtgaccactaggaacatctataaattcaggataaagctaaaaaatgatggcttgcttcctctgccctgggatgtagtctctcaagatatggaatgtttacaaggtaatttccctcttgttcactgtaaaaacgcccataagtcaggcaggtggtgtctaagccaccatcctaagtgtctctaggatgttagtccttgttcctcttttacatcccacacaggtcaaagacaaaaccataagagcacatggcctgtgagaactggaattaacagaggtgtgtgcgctcctccagcccttcacatgctgcctcttgttacaatttgtgcgtgctttgtgctctgtgagaaaagtcctctcaggataggcttcataatggaagagtctgtctgcagtgtttagcatgttcccagcactggaaatcagcaacatgcctcacactgatggagcagtaggggacattcgtcaggacagtgtcctgctgcacagcactgctcccagaaagcagacctcaaacgagctactgaactgccctcctgcccactgctgtctagtgccttcccctctaaatgtcctgtatcacattcaaatattccctgtttctctccatttcttactggaacagactggttggtcttagaacctctgcttagaaggcccttccttctgctcttcctggcaaaggtcacagctcatctttttctcatatcaaccacctactttctctgggctctacagtcaactcatacaaagtcacccagcctaacatccccaagatctacaaaaacaaagcagaaagcccacatgtatctcttccctctggtgtcatgagacacggctgcataaagctttcttttcacactcatcatctctacagaaccctctctgtccagctccagggtgtgaatcccataccttaaatcccaggtcaggcagggctgcagggtcccagtagtctgggatgctctttgggccgtgtaacttagtattgctaaaaggtaaacaaaacttagactcttaatcttttaggcacatggaagtctatcacaggtgaactctacttaccaggatcaccagccctgagtctcagtgcaatgcatttagaagctagaagacaaggaagcacacagcacaatgtttccaacaaaagagcacttccatcttgcctaccaggcaaaccaaaaagcttttcagtcctgagagatgcacttctcacctgcataccaccaaccacacagaaggaacaaagcacttgattaaagcagtatacacaggccccagcttttatccaactcttgaaattcaaaagacaccaaatgctttcttgaagccttaatgatatgcacttgatatacagaaaatattttcaaagctgtaaaattggtctccaaacccacatggtaacattaatttgagttaagctgataagaggcttcttgtggcctgttatttgtcctccttaaatatgcatacatacacacacactactgtgctaaattaaaggatgtcatataacagaggcactgaaataccttctaaaaatataaacaaataaaagccacacttaaaaaccagatgactctaaaggcttaagaacattactgtcaaaactacaatccaattcatttcccgctcattgaaacctccagtccttcctacagcagatctaccttctggttctcctggcatgggatatgtccaggacatcccagaaaatgtcacagtttagaaataactaagcaaggatccatcggaataccagcctcaaggttctttttcaccaatttcacctattaagatggcaaacttagctgcgtgtggtggcgcacacctttaatcccatcactcaggaggcagaagcaggcgaatttctgagttcagggccagcctggtctacaaagtgagttctaggacagccaggactatagagtagaaaccctgtctcgaaaaacaaaacaaacaaaaaaagagatggcaaacttttcaagcagattatataaatcagcagttattcttcctatgcttaaagaaaacacttggcacacacaaaagaggcagtctaatgacttctgataagccttgctccttgatgtgtttttttttttgtttgtttgttttttttttttttttcgagacagggtttctctgtgtagccctggctgtcctggaactcactctgtagtaccaggctggcctcaaactcagaaatttgcccgtctctgcctcccaagtgctgggattaaaggcatgtgccgccatgcccggctgagttgtgacttttaaacaagtatatatttaaaatttcatcaaaaataaactttaaggaaagaagaggtcatattctcaagaaattatgttgttgtatttgagtcacaaggcattatttcttggacttttcctcttacttataccaaatcttttttagatggcctccttgttttataaacataatcaataaactttacctctgaagtcttcagaaaaccaacagaacctaagcaattctggcttctcaggttaataaagctatgggcaactaaaaacattgttggcttaaagtcccagctttggccatggcaaacttagactataagggaaacttggtacatcttcacaatccaggtcaccttcttctagtgcatacgccatctggctagctccaaccctactgcacctgctcaagactaaaccactcttgctttaaaggacatcggatcaacagcgagatctcaagaattccccatctgttgcagaaagtctctctcctcccttatgttctgcctatgggttcaattagaggccccaagcagccaccctgtgacacaaggaaacccactgtgaaagtgaagttggtttgttaatgactattataccacttttctttattttggtattccatgatattcaaggatgatatacatgagcctttattatttcattacttcaacatttgtaaagatttaagtttataatttagttgtcacattcaaagacaaactgatgggcttcaaatctaaccaggtttgcacatctcactaaatagccttgatgaaacccacaatgctaattctcactgtggcttaaagactttcccaactagtaggtttgaaagacagtagcatgctagtcacacatgctagtcagtacccttccatgcagtctgagaagcttcctgtaactgaaagcaaagcactcctcaactaaaaccacataccaagccagcgcacaaatgtcacttaccaggactgcttcatctgcacatcctggggagacacatacttgggtctgcgacaaacctttctgatagtgccatacacaaggtttttctgcagaaaagctgaaaaaacattccaatgaaaaaaattacacccacacacacacacgcacacgcacacacacacacacacacacacagagtgggggtgcatgcacagcaggaatgttctctagatggaaattaaatgggttggacagataatacaacatgtaaaactcaagatcagtcttaaaaataaggcaattttatacatttcaaacattcataaagaaaataggtatccttaggagactgagtttaatgaatagagaaatgattagtaattgatgttatcaattatatgagtgcttttgaattgttccttccaatcatatttaaattaatattttgctcagcatttctttccagcttggatgtaaagaggttccagtcaagcctgaaaccaaattattgtatcttgagttaatgtaatttatatgtaataattttgtccttataactttttaaaaaattttgagtaaactgacaaccttgaatcaatcttttcaaacctatgttctctttaataaactaaacatctgacacaccctcaatatcagattcaccccaagaactgagggtgtgtaccatccaccctttgtactgaaaatgacaaatgtctagaagtcgtgtctcttagtaggtgctacttttacacgtaaatatataaagccaactttgattttcattttaggaacattttaatattaaaaattacagctatctggaactcagctgtctttgtacatcgactgtatagtatctggaggacgtgtcccttacactcagctaagcccactgtttctggagttcagtgttcacccagaagcttccacaacccttgtcacacctca

SEQ ID NO: 2000 - DNA, 1970 bp, Mus musculus
tataaagaaaggcacactctaagaaagagcacttttgggggactcacttgatgggatgttcagctgactacctacttctttctccaccacctatatacagatcaggactcctataagggcaggagagcagcaccctctttcctcctgaggaccacccctccggggtctccgaggaaaaatggaagtgttggggcttctcaagtttgaagtcagtggtaccatagtgactgtgactctgctcgtggctctcttggccctcctgaaatggtactccatgtcagctttctcaagactggagaagttgggcatcaggcaccccaagccttctccttttgttggaaacttgatgtttttccgccagggtttttgggagagccaattggaactccgagagcgatacgggcctctgtgtgggtactatcttggccgtcggatgcacgttgtcatttcagagccagacatgatcaagcaggtgttggttgagaacttcagtaacttttccaacagaatggcctcaggtctggaacccaagatggtagcagacagtgtcctgttgttacgtgacagaagatgggaggaagtcaggggtgccctgatgtcttcattcagtcctgaaaagttggatgagatgacacctctcatcagccaagcctgtgaacttctcgtggctcacttaaaacgctatgcagcatccagggacgcattcaacatccagaggtgttactgctgttacaccatagatgtggtggccagtgtggcctttggcacccaggtggactcccagaattctccagaagatccctttgtgcaacactgccggcgtgcttccaccttctgtatccccaggcctctcctggtattaatcttatcatttccatccataatggtcccattggcccggattctgcccaataagaaccgagatgaactgaatggcttttttaacacactcattaggaatgtgattgccttacgggaccagcaagcagcagaagagaggcggagagacttcctgcagatggtgctggatgcccagcactccatgaactctgtgggcgtggaaggctttgacatggtcccagaatccctgtcctcttctgagtgcacaaaggaaccaccccaaaggtgccatcctacctccacatctaagcctttcactgtggatgaaattgtgggccaggccttcctcttcctcattgcgggccatgaggtcatcacaaacacgctgtccttcatcacatacctgctggccacccaccctgactgccaggagaggcttctgaaagaggtggacctcttcatggggaagcacccagcccctgagtaccacagcctgcaggaaggtctgccgtatctggacatggtgatttcagagaccctgaggatgtacccaccagctttcaggttcacacgggaggcagcacaggactgtgaggtgctgggacaacgtatccctgcaggtacagtgctggagatagctgtgggtgccctacaccatgacccagagcactggccgaatcctgagacctttgaccctgaaaggttcacagcagaggcccggcttcagcggaggccgttcacatacctgccctttggagctggccccaggagctgcctcggagtgcggctgggcctgctggtggtcaagctgacaatactccaggtcctacacaagttccgctttgaagccagccctgagactcaggttccacttcagctagaatccaaatctgccctaggccccaaaaatggagtctacatcaagattgtgtcacgctgatatagaaggcacgtgggaaagaggaagcactttgtaatggtaacatctgcacatcgctgcaggagggcacccgggattcagatgaaagcctcgtgtggagatggagagtttataggaatatatatcttagggtgatcaaaagggcacatggcatgtgagcctactttgtcacaattcctaaatgtttaat

SEQ ID NO: 2001 - protein, 543 aa, Mus musculus
GPPLRGLRGKMEVLGLLKFEVSGTIVTVTLLVALLALLKWYSMSAFSRLEKLGIRHPKPSPFVGNLMFFRQGFWESQLELRERYGPLCGYYLGRRMHVVISEPDMIKQVLVENFSNFSNRMASGLEPKMVADSVLLLRDRRWEEVRGALMSSFSPEKLDEMTPLISQACELLVAHLKRYAASRDAFNIQRCYCCYTIDVVASVAFGTQVDSQNSPEDPFVQHCRRASTFCIPRPLLVLILSFPSIMVPLARILPNKNRDELNGFFNTLIRNVIALRDQQAAEERRRDFLQMVLDAQHSMNSVGVEGFDMVPESLSSSECTKEPPQRCHPTSTSKPFTVDEIVGQAFLFLIAGHEVITNTLSFITYLLATHPDCQERLLKEVDLFMGKHPAPEYHSLQEGLPYLDMVISETLRMYPPAFRFTREAAQDCEVLGQRIPAGTVLEIAVGALHHDPEHWPNPETFDPERFTAEARLQRRPFTYLPFGAGPRSCLGVRLGLLVVKLTILQVLHKFRFEASPETQVPLQLESKSALGPKNGVYIKIVSR

SEQ ID NO: 2002 - DNA, 261817 bp, Homo sapiens
aggaccctatctgaggtcagactgtcatgcctggagacaagaggcagggctcaagttttggtgatgtcaaagagataaaatgactttaaactgtaccttgggaaatcagttttttttttaaagctgcttaatgacttaaaagtgctttgaggttctgtgaaactcatcatgatcgtactgacttctctcctgtgatttttgttgttgttgttattaagtagctcatggtgacaagctgtgaactttctcagggaaacacaaggaaccactgagggcactgtggccttgctttccttgggacagagggaaacactccctgcaggaggggctcagtgtagcactgtgggctgcaaggggaccacgagaaccagaactcaggagcttccgtatgcctctggggaaaaaggaagtggctctgacagcctggtaggaaccactatacctggagccccacctggcagtgcagcctagcaaagctccactcggcattctggagtgttctggggcttctgtgcacactgctacaggggaagggagaggaagagccctagctctgctcccccagcacacataacattggaacagcctcttcattgctctggcctcagattctcatgtgtcaaagactgaataataacgcatgaagaccccaccagggttatactatgacccagtcagattctgtgaaatgcgagtgagcctacaaaaagagattctttagaaaaacagaacatcatggtattgccaatcccagcaagttttcctgatcctagatcactgccataaggtgtggggaggaaagcaaaaagaaaccaacatttattgaacctctggaccaggcaagccgacaagtgctcgatgcgtgttctcctgcaccaccccaacagcagccctgccccaactccacggccgcagtgccttccaccgcaccacaaggcctcccagcatggcccacctccatctccacggccgcagtgccttccaccgcaccacaaggcctaccagcatggcccacccctggctgtctggttccttctattatacccaggccagtaaaaattaccttgttcaagtatcattctgataatatcggtccccttctccacaccacaaaatgtcacttgaattagaaccccttttaaaccttttaacaactgatcccaaacacttaccattctcatctgctagtctattttgtgcttaccactccagccaagcaaaaattactttgcaaatgaattccattatgcactctgcttattcaccttgttaagccaacaccagagctttgcctattgctgttgtctctttctataggaatacctcatttatccgacatccttggaaagaagctatccacaaaattgatctacataaattaatttccctctctaccagaaacttaaccatttaagcagccttaaatcctctttggagtacatcactgtaacaagcaaatgaaagaatttctttaaccactgactagtggaagcatttctgtaatacattagagaacctcccaggctcagttaacagaacataatgaaactgatgaatcttttcctgatggtacaggtcacacttaatgaataatagtaatgacactgtgctggagctgcagaggtgagtggttcaggggaaaaggccgaaagcacgtgtgcattctctcttggtgctccttctccctgtcacgagttcccctgacacttactatcctccagaagtccctgctatccgctcagattctggtgagtagatgccgtgacacagaattcaggaaggtgtaacttgctgtctttctgtacagtttcaaaaacgtacatgctggtttttgtcagagccctataaatctttcattagatacaaaataaacaaattttaaaagaacacatttccacaatcggcaataagctggagttttccaaatctccctgccctgtgactttttaaaattttttaatttaatactcacaacctcggcattataaccctgtgacttttaacagaaatccaggcacaaacaccattaaaatttgcttccttaatgctatgaaactataagttctatattgtatagagctggcttcttatcataagcccttggacgaatgattttacttgggaataacgattccataggttgaatcaacagggaaatattagtgtgaaggaaaatggtaaaaatacacaaacaaaccctttgttcttcaagatgcaaatctgtgactgtgtgaagccagaagtgctttcgtagtcaatgtcatggaaggttctatggtgatctctcactgcggatggacagaaccacctggaggaaaaatacccttgtccactcacatattaggctgcattctttttgtgacaaaggtttttatagagtcgacagcattaacacatgcagaagaattgatcaatcttaattctgcttaaacacagtggcatttaattgatcagaacctactaaggcaaaagtacttaggcaagaattgttaaaacagactactgtcaaaaacattacaaatttgttcaatgctgtattcagaaataagtagctataaaaccacaaagatattttggagtttcaaaggttttctgccttttcttttttggcaatgattttactagcttgctttctaagggcaaagatatctgtcagaaaaaacacaacctgcagtgatgtcgttcattacatcttttgccttttccattggctttaaaccaaagagagggaggactaccctctgaaagtctgacttgtaaccactctcataaacacctagctcactcaccttggagaacctagtaaaacaggtatggctttagctgactcagaatctataacgaatttgacaaacggtcccttctaaatgaggatgacctgacactgctctgaatcatcaagattcttctgtgtgcttgctcttctttcaagtgtagttcaagtttttatacttatggcctctgcattctgtttgtcagatctacgggagataattaagcaagattctaaagagttggaagttgaggggtgaaatgcaaagtgatcagtggagtcaagcagaaggtggctttgttggggtgagggatgccagatacaagtacaagaaaaataaagacggccgaaatgaatgcgagctacagatgagtcaccaatccagggctgcgtaagttataacttagatgcattaaaaggaacagtcaattccagaaatatttatgaagcgcctactaggtttaaggaactgcacggctattgtaggggacaaagatgaatcagacatggttcctgccctccaggggttcacgatgatgcaagaaccctgaagtcgtttttctcttatatgcggtactaatgagaacattattaaagagctgtattcagttttaactgccaccatttttttaaatagggagaaactagagagagttcagaagagagaaaggagatgctttcagtgacacaaaaccggctctgtgaggaaaaagctaaagagacccagttattatctttaagtatatgaaaggttttagagaaaggaattgagtaaaagaaaacaagtttgaatgacagcaggcgagatttcagccaggcccaggaatttcttgacaatcaggttaatagaatactggaattggtcactcagggagttccaactgccctttcctggaaaaaataattaaataaataatgaactgacaatttcaagtcacagacattcaccttcctgaagacgggggtgaactatatctgtgtcaaggtcttctgctctggggctctatgcccctgaagctaggtcaggcttttctttttccacaattccctgaatgatctgctctgggtaagtagccactgaatgcttcggagtgacagcccgatctatatccccaccaccaagtgccacacaactacctggaatacaaggtctcagccaggcgaaaaggctgggaatcaattctccaacagccacatatgatgcaagagtccactcgcaacaaagcctacgacacaccaaatatcagaaacgaaagtctctgagaacttgtgcaaataagaaacgtatttgcattggcaaggatataaaatttaagtaacaaatagaagaagacaggatcttctgcaagttacagacagtaatatttatggacatttctaagaaagcttgtaatgagtattttctacactcagaaacacttttttgagtctacgtaaagaaaacacttcaagagagataggaaaatggggtcttcccactctttatttatttattgagaaagactctcgctccattgcccaggctggagtgcaatggcacaatctcagctgactgcaacctccgcctcctgggttcaagcaattctcctgcctcagcctcccaagtagctgggattacaggcaccaccaccacgcccagctatttttttttttttttgtatttttagtagagatggggtttcgccatgttagccaggttggtctcgaactcctgatccacccgcctcagccttccaaagtgctgggattacaggtgtgagccactgtgcctacccaagtcttcccattctagctgaagaaagcataggcatgttagaagtatgaactgccactaaaaaaaaaaaggagaagaaaaaattccatcttgaatcagacccatggtctagtgagtctatgcttctttcacttcccccaccctgtaaagtcagggacagggattaagattttgtcatttcgacaaacccagaacctgccacagggcctgacacacagcaggtcctgcataaatgtttgctgaatgaatgcgttaaagatgggccctcgtctgtcaagaggtggaacatttgagttcatgtgggtgaagggcgcagggcggtgcacagcacaaagtcaatatggcctaagtcacagtgatcaccgtgaccctcaagcatctgggtttcttttataggaaaaataaagatctgcctatactgtaggtttttcttttcttttttcccccaaaagagaatagctatatgaaatggaactcttgcgagtttgggcctttcaagttcacatcccatcggtggttatataaagtctactgccattattctgaagcccgtctttgacaccaacccaaagtccttgaattgtcatcaataagactaccagaaagcacaggcgaattacacgttcagagaacaataagaaatgctcacatatcacaccctcttgatcatcactactttgctccacacaaacctcaaaggtggttccccaagactggtctctatgggaggaagggagagagagagagatgaagaaatataaaacataaaatacaaagaatctgagcccctgtaacttacagaaagcaccaaattgtcttttgtaggaaaatgatgtttaatgcatggtgaggcagaccctggcttgtggtgggcgaggagcctccccttggaggaggctcttggtgaaccacctctgggtgctcccttgcccagcctgctgccttgtttaggaatggatcttggttaacggcaaaggttatctttcatacttggggatactttccaagaggcacagctgcagcccctgaaactctgccccagcagtttatttccacatttttcaagtagcacagaaagtgccactatagaagagaaattctctacctgaaaccagcagaagctcaatgcaaataaagaatctggaaaggtcacagagggagtaaaaagaaggttctttcttctatggctatagggggtttattgttgctggtgcccaaactggaaagggaatcgcaggagattaataattgaaatgttgctattattggttttcgaaactatttgtgggttattctttccctggagtcatcatgtctgtaagcatctcagaagatagagggatttaacacactctgagaagatgcctactacagccagggactttacgtgcactagtttctaatggagttcctgcacagtccaataaagcccaaagtcgtatcactagattcaaactcaggtttctctgattcaagtatcatagcacattgtctgaaatcaaggataaaattaaggcaccttactcactactcaaatgtggcgagaagaaaagcaacatttatacttactcatttttaaaatataaaacctaaacacaggaacagatattttagggcatgtgtcatcaaactctgctaacccaagatgattcagaatctcatttcttggtagacagcttggtagataggcatcttcaggtccatctgatgatgaattgcagcagacagtttttggaagtctgtgaagtgttcctttacataagccaatagtaatcaacacagcatatctcagggagaggaaaacataaataacttggaatttaggctcctctcattcagaacccataatagagaccttggtggttggcctttgcactagatattgaaaaagcctcgcaaagcaagttgatggaggaaatacaatcacaaggcaaatgtttaaccttctaaagaaaataaacctttttataagaagttcagttccaaaccaccaaaaactaacatgctatttataaacctatccttcaagcaagccctggaagactgattctctttgccacccattaattggtattatcaaataccccttgtttcaaaaacagcatttctgtctaaatctctggcggttcagaacgctccattaatgtatctgggccttcacctggtattccaacttggtgcagcagcaccccattgaaacaattccctctcgtgtcgttatacttttcctgagaagaatcatgcacactctttaggagctcaaaacccacaaggaatccctcttcttatagaaatctacaggaaaagctctgctcgtttagcatgcacacagggagtccatgtgctctgattgagacaggggaaaaatcaggtttcctgaacccagaggatgtcaccacggcaggagaaaggaggtcatcagagtcttggcacactcatcacagtgagtgaatgcgggtcctagcaacctaatccttgattctagaagtcacctgtctgttttagagcatgtccaacaatctctttcaaaaacacccagatctgggcttttggcagactgatgtgggccagttgaggtgggatggggaggaagattagaaaaataattataaaggtgcacagataaacatccggaataaaagggtgcacagcgcaggaacaatgaagagggcacacggacaagatggagggaaactgagggctgaaagaggccaccgcggaggtcacctgagacagggaaggaaggctggcaaataaaaacagttcatgagacttttgagatccatgattattcttaaaccgtaacaccctacacacctgcagttctttatctggcgtaaggaactggaagaacaatgtagcaggaacggggagagccaagtctcagcctcgggggcatggcctaccttccatatggatttaaaatgaaaggagcaggaggagaacagtgcagttcccaagatggctttccacaaagttgacaaaatacaccccaactcacatacccggtccctagtaacagggaaaccagccgtttactatagttctgaattcaatgccaagttccttctctcaactcaccgggagtgtccagcagagggagtctcaaggaggtacttaataaagagaaaattgtttcattttaacactctagacagtgggagcattgactgtagccccctcctgtagacgcagatgaacaatgaacgcccgacatgggttctcccgcatgttcacatgtccaccggcatgttctattctgcgtggtggagtgatcagaaatttcgttttgttttgtcgaatggttaaatggaccttgtgttcttcagaatcaaagaggaaagcccctggaataacatctctctgttgccttctaaacagcccctttgtttctaagagagtctgaaaaaaaaatatttacagtctataggttatttacagcctcgttatccagggcctgactggtaactttattccggccagaaacctaattcatttggagccctgaaactaataacagattttcttttaagtttttttttttttaatcagcctcttataacagagataaaactattaatgccttccctgtctcactggccacaactgttctccggatttacaggaggattacattcccccctcgtgccctcctctgtgccacacaaaccctgtcccctctcatttgcgatttcatccacagaatatctgaacaaaaccgaaagaaagccgggggacccacgctaaaagtatgtgaaggctgcgatttcaatgatttcatgagacaaacatttacacgatgaaacgactgaaaaatcagacacacttgggtttaaaatttctcctactacaagcacacaaaaacacatcgaagtgtaaaaacttagttgattctgggttgctttctggctggaagctgacagaacggactgaagagaaacgaaagacagtgtgcgaggcagacctactgcttttctgccttgcgttcttttctttcttgctaaaggcagtcaaatggggaaaaataccccgatgccaggtgaaggtgcacaacacagatcgacccagaccgagccagaaaaacgtctccgccgctcccccggctggaaaacccaaagtccacgtccccttccacacgctaatgaggggagattttcgcctatttcattgttctgcctggctctgacatggacttttcatctctctcctctctccccacctagccccgtgcattccgattccacagcccccccaaaatcggaggctcgcggagaataaaggagcgtggggtgggcgcggaaagaaatgggaaggggcgcggggcggagagcgaagtggaaaggaggtgctccgaaaggtaatgtgggggggcggtggaagctaagccgcatcaccttcatttatcgcaaataaataaaaagcacagtcaccggtccgccttccccggcgtccctgccctccccgggcagccgcccaccctcgcacacgccccctcccctcctgcgcccccggcccctctccccgccctggaagcaagaccctgccggcgccgggtcccggtcatcttccgggcgagggagggggtcgcggccccctcgggccccgggtgggggctggggcaggcgccgggggctgcgggcgcggggccgcgggcagaacaaagctgcgggggccgcggagggcggcgggcgcggggtcggcggggccgggcgccccttaccttcgtacacgggggccatcggggccggggtgtccgcggttcatggcaacggggacgggaaagcggcgcgcgagctcggcccccccagcctcagtcggaatctgccatcttgagcctgtgtctccgctctcggcgcagccgaggccgcccgcgcccgcatcaccgcctcccgtggccggcgccgggggagggggccgggcgcgccgccgccgccgccgccgccgctgccgcccgggcccggcgcggggggctcggggctcggggctcggggcggccgggcgggcggagcggccgaggccgaggcgccgagcggccgcggcccccgagcggatccgcggaggggcgggagccgggggcagcgcgcggccagggccggcggggctcagctcagcatggctgggcgcgggggctccgcaaaagttgctggcggaggggggcggcgggcgggggcgggggcggggcgcggggccgggagagccacagggagtccgcgcgcaatcgagcgccgatggcacggatgcgaggcggggaaggccgaaccgaagggcagagccgcgccggcggcccgaggggaccgcgctgggaggggctgccgcgcagcgcggggggactgggcgcagggcgggccccgggtagtgggtgagagggccggcctggacccggcgggcgcacggctccgagcccagcgcagccgagccggtctgcagaggggcccccagaactttgtgtgtgtgtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggaggtaggagtggaatgaatgaatgaaggagtgggcgcgcgccgtgctccggaggagggcgggtgagtggaggagcttcggaaagccacacgaggtcagaggcaccgaagccctgccgtgcacgccgcggaaatgcagcccccggggtggtcgctgggttcctgccggagtctggcttccacgccaccctgatcttctcctcctcgcgtctacactgtcccgagggccgccactccatcacttgaatgggagctcacaactctctgggtcctcgcttttctcagcgctctctcctatcagggcttccgctaaacactctccagactctccccagccgggagcctctccaggtttgcttctccagctgcctcccggatgcttggataggatgccctgccatcccctccaacttaggaagacttgttgagtctcctcttaggcactgtttttaaaactgtgggtcgtgacacagtaatagatcataaaataaatgcagcggaaggcaaccagctttcaaaaagaacgaaatggaatccaatagaaaatattagagtccattgcccttagtaagggcaactattgtttcataaaccttttgtttcgattataggtactggacaagtgtactggaccatgatgtcaattttatttccgtctgtgaatcgtgggtttaaaaaagttgaaaagctatctgtgtaaaataatgatctctaacactgtataactttcttaaaaacaacctcgtgattttctcactacttcttatcctttccggtctccatcctccgttcccatccttcagtccttcccaaaaaaggcaagctctttcacacttttttagtggtacatcacgacaccttcctctgtgtgatcttgtactctgcggtcttccttgcccccataatcaatgctacacttcctatcccttctcttaacctaatgccattcacgtttgcagaatcctagactactgttgctaaaaggacctcagaggtcatctgggccagccctgcccttttagagttgaagaaatggagtccagagaagtaaaatctgttgcccaatgtcacacagtattgaagcttaggaataggtctcgtggctcccactctagtgttttttgctccacaccggtcatttatctccttcccttctatcctccctgcaatctttaactttagtcttggcccaggtcatcctaaatattgccatcttcataatacgtggttctggccatgccacgctcctggctaacatcctctaaggactcaacctctgcaggtggggctgagtgccttggcttttcatcaaggcaggcgagtcctgacttagctttctaaggacatgagttcagcaagtcactgcttctctagccaaactggtttacttgtagcccagtgccagcttcacccatctctgtcactgtgcctttgcccaagcggtcactttcccacccactttcccagaggggtaccttctccatcttctctctttaagcagattctacctgtgcctggctcacctcctccacaaaacagcccgagatagcgtgggagtaagtcagacctaggttcaaatcctagctcttccacttaactatgtgatcttggtcaaaatgcttaacctctctgagcctcagtgtctgtattttgattatgagaaggagaacaatagtaatgttctccttttgcatctgtaaatctctatcatagccttcaccacacaggtatgtaactccctgttaatacataccctacatgcatgtctctctgcccctttctagtgctggccattagaacttgctgccataatggcagtgtagctacttatgtctgtggagcacatgaaatgtggctagtatgactgaggaactgaatttttaattttaataaccatgggtggttagtggctaccattttggacaaggtgtctctagactgtaagctcagtaaggacagaaaccatgtttttcttgttttggattgtatgtccaataactgcattgcctaacgcatggtgagtactgcacacatatttgttgaatggatgatagctgcaatttgttgcatgctcccttgtgtccagcacaacactacaaactcgataaaaggcatttcatatagtcctcatcacagcctctgaggctgggttagattagagagagagttttatatagagggcagacacatagtaggggttcaataaaagttattattattctaactcctccctctgaccagccccactgacttttgtctcatctttccttaggctcacagaacatttcctgcctgttgctcacactctgttgtccacagcatacccgcaccctagatggctgactcttgtcttctgtgtaggtaccctgtgttcataactggattggcagcgtcttggagcaaggccctgctttataggactgcccctgaattcagcactgaccagtgttcagtaactgcctctaagtccatcccagctgctgtctagcagtgagtgattctaggcagtcttaaaatgaatatcacttgtgtcaaccgaaaacattttacaggtagtctcctccccataagaagggaacaatcttgggcaaggaaatagagtcccatggaaggggaacaagatggagccatacagacagaggtccaccttctcttcagaccaccatgactgaagctgtatccatgagatgcaaaacatgcattcaattgagctagcgaagttcgtatgatataacggaaaaatattcttgaaatgagcttagattttccttcatgaattggcagactgagtatactaattgtctcctttccttccggtgactgcagtcaagtggcagcaaggtataaacctaacagtgaaatgtcactgaaggagagcatgggagctgggaggagagaggatctgtgacagaacctggggagtaccagtatttgagacatgggaagaggaaaaagagctccccatggacaagagggcagagaagttggaggacagccaggacgggggattcctcaacatcccagcaaggtcaacagtgctgcatgctattgagaggcccacgtcagatgaaagcagaaaagcagctgggtgctgtggctcacgcctgtaatcccagcactttgggaggctgaggcaggcagatcacctgaggtcaagagtttgagaccagcctggccaacatgatgaaactccatctctactaaaaacacaaaaaaaattagccagacgtggcggtgggcacctgtaatcccagctacttgggaggctgagataggataatcgcttgaacccaggaggcagaggttgcagtgagccgagttctagtgccattgcactctagcctaggcaacaagagctaaattccatctcaaaaaaaaaaaaaaaaaaaaaaaggcagaaaggcatcaattggatttagcaacaagagttgcattagtgactttggtgaaactagtttggagggaaatacaggtttcttaaattctacctgaatatgtgtcctgttttatgggtggagatagtagaaggatggggagggctaaggaggtaccagaaaagagcaccagagattgctccaagcagagagggccttaccagtcatgggcctgagacaatgagaggggtctgggagctgtcccatttggctagagatagtgtgcattgtattttatttatttaataagcacattagcagtcagtgttctaaggagtttaatcaatcatttaaaaaaatcacttttttttttttttaacagtacatggaactctaggttgccaaaataccatttaacttcagggtgcattgaagaacaataataaaggcaagaaaactggaaaggatttagtaaccatttataccagttacctctccttaatttgcctttctacaaaatggtgcaagtcatatctttctcaggagttggtagagtgaacatgggggagctttgacctcatttcaagttcattttgcttacaggacatggaacaaagggtcttttttttttcatgtatgcctatagttgtgaaactgcacaacatcacaatatcttcaaggccacaggatagagataaccctctttttggtgtatgcatttaggtgtgtatgtctctcttactctcagggtattcttagcatgatgtctgtgtggcttgtatcttattctcacttggtgtgtgttgctcttattttcctgacagctctttattttccatgtgtgagcctgtgcctgtggtttatctctggaggatgtgcctgagggaggtaggtcactatctcaagttctgtcttttgatatcacacctctcttttggtctcttgctgtatctctattttcctctctttctgactgtgtgtctaattttctttttctctgtatctttctatcttttccacacattctttatttcttcttcctctccctttattttaattctgtttcttaacaagtcataatagagacctatttttgtttggattattcttaagaaattaccttgtctttctgctttaaacctttgatcggtttcaatgatacagtttgtaacagagtagtatttaataacaaaactctttaactgaaagcttcagtaacaagacattacactcacagagaatttaaaagagtagacatttcattcaaatgaggaacaatagagctgtggctttaagggcaaaggggagagcgaggcttggcagggtgaagggaatctgattgtggaaatggcagtcttggagaaattacactggcaaaatcaggggaatagggaaacatcattcatttttctgcttttgctcctagaagaaaaatgatcagacacctgaacaggggtgcaggaaaagcaaagcgatgccataagagcattgagcagaaaggaaatatggcaaaaaaaaaaaaaatgcaatcagcctatgaatgaaaagaagctgtaatgtagatgcacagaaggtagggcgattttgttggaggttgcgggaatggcagattaggatggatttgcacatgagaagcagttcagagaagcaacccaaccctgcagagaaatttctgtgattatgggaggtaggtaatagcttggttttcctgacctgcagtccaggctgaacttggacagactaggtagaaatggtgcagaaagaagcttggggtggaggcagaaataaaggtagactgaggagagctcttttaaaagcctgcaggtcctgttaagcctacctcagccatgaatcagtggacctgtgcatttctgtacagtgtgaagtttcaattgtaaggtttcctcccactgacatgaaagagcttgctcctatctggcaacccctggaggggcttgactgtcacggcagagggcagttaggactgactctttgctctgaggttgccagtggcttcttagattgcaaatcgcatgccctttcttagcccctcccctgcttgatctctaagcaaacatgagttagttagacactgttaatcacctcactcttcttgaatcactcccctcccttcacatccttcacatgcatgcttgtttagttttttttgttttttttttttttgtattttttcccaaaattcctagtccttcctcctttcacatgcttgtttaggtttttgtttttgtttttgttttcaatactcctagcctgccttcctgccttcctgcctgcctgcctgcctgccttcccccttccctccctccctcccttctttctctttctttctttccttctttcgtttgttctttctttcattctttctctctctctctctcttccttccttccttccttcctttctttcttcctttctttttttcctgagaaaatcaattcatcaaatgttcagctacagcttactatgtgctagattctgtagcaggacctgggagtataaaagggaataagccatagccctggctttcaaggagctcaagttcaaagaaaaaccaccaagcaaggagcatgatacaatataatgagtgcagcagtaaaaaggatgcacatggtcaaaagatagtacagagggacaaatggcaaggagtgtgtttggggcaggggaggtggcacgtctgtgcctggcactgcgagttctggcaggtgacagcaaataggatagaaagatatgaatgtctaggatatgtaagaaattataatattgctaaacatgcaaagcaaggccgagacagtggtcaggaatgacgctggagattgtatgccaagctgaagaacttatactttattctgaatgcaccagatgtggggaaaaatgaattcaattttgaacatgttgagtctaaagtacctatgagatattcagatagggatgctcagttgccaggtgggtgtacaggactggagctcagccaagggtttttaataggagatagagattgttttgagtcatcagtaagtgtataatgcgtggctgatccataggaggtgagatcacacagggagaggttacatggcagcatttctcaaagtgtggtccttgggctgcctgcatcgaaggggctttctaaggatgcagactcctcaggcagaaccccaaacccactgactcaggaatctctgggggtggcacctggaaatctgcattttgaatttactccctaggggatacatttacacaaagcagttccataactacaggtgtggagagagaggctaagaggctaaaggagggaactaagaagagagagacctgatcatttaggggccgtgtccttctcccttcaccctgtttcttgatggactggacctaagctctcttctgttccctttctgcttgttctcttggcaagctgatctctagatctctgaggctggtatttgaattgacatagtctcattagctcttgtcccacatttccacctgctttccagacactgctaccaaatggaactcatctcctcccaaacctccttctggtaaacaataaccacctcctagtccttcagctccagccattgcaggtcaactgccaggacccattgtttcgttgttgttgttgttgttgttttttgtgtgatagcttttcacattcttccattcctcttcctttctactgccagtacctgattgagcctatccctacctcctccttggactgctgcgctatttttttaacagatgtccctgactccagtctctccctcgtctttaattcacataactgattgttgacaacattggcttcctgcgcactgcataccattgctcagagatgttcggagtcaccatattactgcacaacaaccttcatcaccttaacctgacacctaaatcccatcatgatctgcccaaaatccccttcccaatctcatctcccactcttgcatctcgtgcatcctaagcaatagctgcacagctttgtctttgtacatgccagcctctgcccagagtgtcctgaactccacgtcttccccatcctttaagacccagttcacatgctatttccttcatgaagcctttcctattccccagcccacatccccagaggtcatttatcctttattctccccaaagcatattttaggtctgtttctgctgcattcattttttcctatctagtattagagggttttttttttgtttgtttgttttttgtttttttaatgtctcgcctttccctctatgggagcaatgaaagagggactgaccatcaggaacattaggtccatcacttttaactggatgatgataagggaaatgatttcatttctctgcacctcagttttctcatctatagagtgagataataatgtctgcctcatcagtagaaattattcatgtgaaggaaggggaagataaactatacaaggcaacaaaacaccgtagtgtcaggtatgaaggagacacttaataaatctgtactgaatccatgagaaagggtatacttctagacagctttgaaccgttctgggaatataataattaagtgatagaatgcaaggaagaatttagttttgggattacctgtttttattttagtgaaaagtttcacagatagaccttttacttccaacaacttcaaggcttaattttattttttaagcctagggttcttttttctttctttctttttattttattttttcatataatcctgaagcttttcactctatgtggaagacacacgtggttgcctgctgcctatctctggtgccttcttcctcagttgtagaactctgattttatttaggcagtactgtacctgcccaagaaagtaaattatgattggtttaagtcagttgcagcaaatcagtcatgtttccagtggtggtcatgtggcccaatgagataaaaggtaaaacttggagacttctgagaaagtgtctcctttctcataaaggtgtgttccatgggaagaggtggtccatttcctttccctcttttcagccatatcctagtaggatgggatgctttaggtgggatcaattagagtgatgtcttgcaagtaaggaagtaaactggctttggaaccactgacctccagccttattgagaggagagctgtctttatgaagacacctttagcaaggatcccattacctacagctaacagcatcttagtcatttttaggaagaatttagttttgtgatttccttatgtgttttatcacagtctgtgtatagatcttttaaaaataattcaacagcttcaaagtgtaagttaagaaaaaaacaaataatcttttgtcatagaattctgaggattttcgtttgtatgtatgagatgaatttgaatttttaaagaatttcttttggaatatggcaatatcttcagcttgcattccacttgccctaggtggtacacttcatcaactttcagaagctgctgattggttttgcttatcttttctttaggagacatatactgcctggactgcctggctgatgtgagctagtttgtctggttgagttggatgtttaaatagaaggcagaacaacaacaggtaagatttttaaaaatatcctttaatttctttgggctctattgacattattacattcattacaaacttctggatgttaagtcctgtgtttaatagccagagaggggaaggtggtgggcagctgggagagtggtgactaacaagatggcaccaccgggttcctgagtttgagggttgggtaaagccagggcaacgactgggatggccaaggagagcaagcagtagaaactcaggtccaaagggcattaggcgtgaaacctaacctgaccaccctatttcatattgcaacttgcccctctacccatgctgtcctctactgcaccccattttcccttacctggtgttcttaaccttttttctttttcctgtggatttcttctgcagtctggtgaagcctgggattgccctctcagaataatgtttttaaatgtattgaataaaaacacataagactacaaaagaagctaattatattgagatacagttactaaatgtgtatttctttattgatacaattttgagaaacagttactaaatgtgtgtttctttattgatacattaaataacaagatttaaccacaggtccaatagctacaaaatagtgatgaatgtaaacaacagttcaagaaatctgcaacaattgtcaatctgatacaaaatgtctgtgatttcaattggtaacaaagttataggtattgctgtggcttctgaggttgttagcctacagtcaggtttgaaggtttaagattaatgaaaataaacgtgccatttttccccctatccaagttcacagatcccctgaattctatccatgaagatgctatgagtctggaactccaggataagaatccctgctcttatcttattctgctatatctgcatagtatttattctcttctaacatcatttattatttacttatttttaaagttcatttttatggtctgattctttctattagaatgtaagtttcacaaagtcattgtctgttttgttcactgatacatttcaagtgtctagaacagtgccttgtacttacttgtggctcaataaatacttgttacatgagtaagtccagaatgcaccagcatctgagtctagacagaggagccaggcccatggtccttctgaatgtggggcaccatgcagctgcacccatcaaactgcccaccagccaattctcttgtactttggagggagccagactgctatgtggaggtggacttggagacactgagttctgcccatggcaccattgggattggatgtgtggaggagaagaggaaaggcttagggctgggaatgaaaaatgcacatggcacatggaatggccgtgccctagggttggcctgccccagactggggccaggtgttagacaacagttaatacaaaatatgtttagacaaatagatcgggcctggactggggagggcctttagtgcccagcagaagtatttacatctatttccaaaagcaatagagaagcactgaatatttttgagcaggagtccaagttggtagaatgaaagaagggctggaaataagggctataagattttgagtttaagtgcccaccttataaatcattagcaaaagcagaatataaccctttctccaattctgtatgggtgacacccaccagtctggtaaatggaggtcgttagtgtgatggggtgtcattctcactttgtttagcacccccactagatatacatattcactttttgccttttttataataatttgagaagttatagaaaatgcttatacatttaatatgtttaatctctctctctctctctctctctctctctttctttctccctttctccacagggtcttgctctgttgcccaggctggagtgcacttgcagtagcataatcacaattcactgcagcctcaacctcccaggctcaatcattcttcctgcctcagcccccaaagtagctgggactacaggcatgcaccaccatggctggctaagttttaaaacttttttgtagagacatggtctctctgtgttgcccaggctggtctaggactcctgggctcaagcaatcctcccacctcagcctcccaaagtgctgagattacaggtgcaaactatctcacccagcctttaatctttttattagtgagatatctgacccaacggctaggatctgatggtctttttagtatggcctcaaatcactgtatcctgtaagcatttttttttttttttgagctggagtctctgttgcccaggctggagtgcaatggcacaatctcagctcactgcaacttctgcctcctggattcaagtgattctcctgcctcagcctcccgagtagctgggatcacaggtgcctgccaccacacccggctaatttttgcatttttactagggatgcggttttgccatgttggccaggctggtcttaaactcctgacctcaagtgatctcccctcctcggcctcccaaagtgctgggattacaggcgtgagccaccgcacccggcctaaacatattttcttctagagtgtttttaggtctgcacacggagtcctaggtcaatgccaacaccaactcacactgagccctaactatggaatcggagcaacatcattatttaggcccatggacaaaataccaaagtaatctgtttctatgttccattatttcctcctctccatacattatacatacaacaatttccctttatcacacgtacctgtgactacgtgggaatcattctatcccaaattgctgcagcacaatctgaggcttactaaatatttgcctcagccataaagctgatagagcattagtttaaaatgcaagtagggaccatgaggatcttttgggtttcatgttgaaacattcaagctgctcttcctactacggctattactactaaatgcattatatgatttttgaaaactagaacaatccaagtctggctaattttttaaaattcccatttctttcactttcccaactgttgtctattcaccctttattctacctttaaagcaagaaaaactgaaataattatttggaaagttttttcacttctgtcaaaacaacaaaacctatatcgtttgagtgattagtcaaggacagttgacaaaaggacagtagtcaaaaagaaaaatggctccctaaactcttagagaaaagaaatcaagcttgcattgtgatcaaactaaatgaatgtacatagtaataagcaaaaattcaaatggcagaccatgtttttcttgcacctatgaattcattctgatggataagatagatggcttaggactccatattacatttgtatgaattaatagatattaggggaatgtgtaataagtgactgcatgattgactgatacaggttttggatttttacttttatttttctgagacagggtctcactgtgtcacccaggctggagtgcagtggtgcaatcttggttcactgcaacctctgcctcccaggcttaagcaatcctgccacctcagcctcctgagtagctgggactacaggcacccaccaccacacccagctaatttttgtatgtttttgtagagatggagtttcaccatgttgtccatgctggtctcgaactcttgagcccaagccatcctcctgccttggcctcccaaagtgctgggattacaggcatgaaccactgtgcctgggcttaggttttggatcttatatctgattatccacaaaaaagaacccagaaacactaatatagtggaagccattgcctcagttaggtaacactagttgtggtgacagataaatgctaacggtagcctaacacaatgaaagtttatttctcgttctgacaacagtcagcataggggtttagtgagtggccttccacatagtaattcagggacttaggcgtcccctacctgtgagtgggagcctcggaggccttcacttccagctggcagatagaaggagagaatggaggatacccccacgggagatttttacgggccaggcctaggtgtggagtgctggttccctttgcactctatgggccacaactcagtgacatggctacctctaaccaaaggcaggctgggaaatgatcacatatgatgcagctactaaaaataatgtctgagttatacccattggccaaggggaagtgtccgtgatatattcgtgagaggattaagtttcagagtatgttgtattgtgtaatatttataaaaagaaatgtgaaaatccctaactatagtgcatgtctttgtataatcctagtgaaaggtgcaggcggctgtataacccaggccccgcacatctattaccacggatttgggtatggaggcagtggcagagacatgaaattattaactttttctttacatatctttggaatgttttgttttttttttttttttcatttcttgcagtgatctcatacttactttggaattaaatttttaggtataattttaaagtatgggtggtagtttttgtgaaatttagaaaaaagaagtgaagaagaatgtgtttgtgcatctccacactgttatatttttttcctgtgggaagatatttttcgaagtggagcagagcttgtgtgtgttccagggtatgctatatcccatagaaagcacacctcaagactgattccatgtttagcaagttatctccacattaaaactttaatttatcagtttcgtgcatatcatatcatgcacataagtgccctgaacctgaatattcctgtcctaaaaggatatacttctcattctaaatcaatatattgatattctgatttgggaaagataaagccagtctggggttttataggaatagatcagctcatcagatcctgataactcttgagtaaactggtaaaatagagttaccaaaaccacaaggctaagacctggactcctggctttacagagattcatccaatatccaccccttccaaggagagccagccagcttcacccatggtcggcttggtggtttgtttactggcctgcattatcacctacctacttgtctttattctctctgcaggtcccagaggtttgtcttttatgtcaaatttttctgtagaacttcacccagcatctagatacagtttattgacaatgaaaacaaaacaaacagacatagaacacagtgatgggaatacaggtggttattcttgagggactgcatgaagcacagttggacaaatagccagtcctctttatctgcagggatgagggcagggacagaaatcagactccctgtctgcttttactcataggagactgagtttgcttttcattgggtcctagacttccaagtcaaccctactacatccaagtcatcaaaggatgaatgagggaggagagaagggtatactttcatccctgtcctccaaaagagatatcctggaaaatgcacttttaaagtcataactatcatttgaggcccaggtaagagaacatcaataggaaacaaagcaagatggtaaaggaaaagaagagcaataagaatgcttggtgcgaagtagggtcatgtggctgtttgtctgcagcctgcctgattcatggctaactagacaaaatgttcagaccaggtcaccagtttttagatatgtaattgaatggttatctactatgggaatggtataaactaaaaatattataaaacatctctctagaaatcctgtgtcattaatacaatttaaaaagtactaactgggccaggtgcagtgggtcacacctgtaatcccagcactttggggaaggctgtggcgggcagagcacttgaggtcaggagttcaagaccagcctggccaacatagtgaaaccttgtctctactaaaagtacaaaaaaatttagctggacatggtggcgcactcttgtagtcccagctactcaagaggccaagccaggagaatcacttgaagctgggaggtggaggttgcagtgagccaagatccaccactgcactccagcctggatgacagagcgagaatccattaaaaaaaaaaagtatttattgaacacctactctgtgccaaacaccgttttactgagtggcaaacaacagtgaacacctttgtagtgaaaggcaagacagagacccagaaaaaacaaacaagggagtgtagtttgtgatactggggccaaatgaaagactcttgttataaatttgatggacttttaggggatgggaagatcacaatctgctgaaagagtcaaagaaagcttacatgttgagccaggcatttagggatggatttgatttacaaaagcagagaggaaaaggaaacatatttcatatgagattgaatagcataataatgaaaacatttacaaagtgctttacagtttgcagagcattttcgcattcatgattcagagtgaaaataagccaagcttttcagagccaagtgttgagaccaatctgacttagtagaaagtaatcattccttcttacctctctctcctgtcttccctttcctgatcagggttcacggtttcatattgacttcttaatccaaagcccttttataggggatttcttctacaaagaagtggcaaagagaatgagaaggctgcatttcttaaagaaaatgcatcttaatgcttgtatgggtgtgtgtatggtgcacgtgcatgtatatgtgtttgctaacagttggcacaagacactttcttttttttttttggtctgtttatttgagatggagtttcactctgctgcccaggctggagtgcagtggcatgatctcggctcgctgcaacctctgcctcccgggtttaagcaattctcctacctcagctcccaagtagctaggattacaggcatgcaccaccatgctggctaatttttgtattttcagtagagatgaggtttcaccatgttggccaggctggtctcaaactcctgacctcaagcaatccatctaccttggcctcccaaagtgctggtattacaggcatcagccaccacacccagccaacactttctatatgggatgaacaagacattttgtgctttataatcccagtgtagatatcttctggactttgaagaacttcccttttctagccaatcttctgtcttctccctttcttttttttttttattatactttaagttttaaggtacatgtgcacattgtgcaggttagttacatatgtatacatgtgccatgctgatgcactgcacccactaactcgtcatctagcattaggtatgtctcccaatgctatccctcccccctccccccaccccacaacagtccccagagtgtgatattccccttcctgtgtccatgtgatctcattgttcaattcccacctatgagtgagaatatgcggtgtttggttttttgttcttgtgatagtttactgagaatgatgttttccagtttcatccatgtccctacaaaggacatgaactcatcattttttatggctgcatagtattccatggtgtatatgtgccacattttcttaatccagtctatcattgttggacatttgtgttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtctccttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttccctttcttaactcaaagtagacctgttcctcctcactgtttcaccaccccgcctccctttcacacctctcctggttctgtccactcctctgcctacgtaaccaggccctactaccacccttctgttttcaggccaagccctacctccttcacaagctcttctccagttacaaatgcaactgattatcatttgcacccctcttcatctctgcagtagttcttaatttcgtggggggcatattatatacccttaagaatgtgatgaatgccttggaccctggacacatatacacaaaaaatatgtgtctaatctcaggggatcatgttcccctgaaaacattgcttttctagatcacatttgtttagaacaaaccatatacttcactgccttaaaatatacttttatatcattttgcctaatatatatcttcataattagactaaccttgaggagaaagctgttgtagaattttttggtatcctcatagaacttggttaaatgtagagcacatagcggtatttaatggaaaaggaatgaataaaccaactagggttcatctatgcaatggcatagcattcagtgataaaaataagctatcaagccacagaaagacatggaggggccttaaatgcatactgcactgtgaaacaagccaatccaaaaaggctgcatactgtgtgattccaactatgatattctggcataggcaagactatggagacatgaagaagacagtggtttcccaggatctgggggagacagaggggatgaacacgtggagcacagatgattttcaggccagtgaaactatcctgtctggtactgcaatggtggatgcatgtcattaaacatttgtcaaaactcataaaatgtacaacacaaagagtgaaccttgatgtaaactatggtcttgagttaatgataacatatcaatattggctcattgattgtcataaatgtaccacattaatgtaagatgttaatgatagaggaaactggaaggagggccaggtttatatggaaatgctgttttctgctcatttttctaaaaatgtaaaacagctcttaaaaaataaagtctattaatctaaaaaaagaagagaagtttccgattttggctgcagcctctaatgaccattgggataaagaagaggcaatgccttaatacaatgcatgtattttaactttttgaaaattgtatccgtcattgttaagctcagttaaacttgcgcttgacatgtcgacacaatgtccatttttaaatgaactaacagaattggtaagatatgctctcatgatagagactcagccaattctaatgtcaatgaaaggctccacatttaatgtacacgtttcaacatgaagaaaatccattaaaatataattagcgagttttacacataaatagaaagaaggcctacctagaccttgctgccatttaaaagagttctttcttctttgtctgtttttgtatttttcacagaagctttgaggaagagccataactacctggagcagaatgattatttggagccacagaaaatcattttagggagcagtgggtccaggttcagtgttgtgtgttcaactcggaaagaacacagttgggtggctgaccgggttacttctcccctgtggctctgcttgcattggtcattgaggtcaggcaggggtttggccacagtgttagccattggccctgcattgatcctcacatagtaacatcttgtttggttattaaagtgactgaattgttggaatgaagcattgcaaagtcttgttattccatccatcttcacaaagactataaactaacttcaccatgtagtgactcagctggttggctagaaagtaccttgtaagatggcctattctgccaacatttcctatcccaaacaaatctcccaactctcaccaactctttacattcctgtgtagtctttagggtgaggggctgggagtgggatggaggaaaaggtagacgaatgaagtaaagggtcagtgcacaggcagtaagtactgctgaccactgtaatgtccactcacagctgagatacagtgttcaaacttccctcaaaaaagccacactgccctcagagtgactccttggaccccagccatggatctggccacagcattcatttgattccatgcattacctccttgaataattataaaaattatgttttccaaatagaacaaagagatgcttcctgaaattcttctccttggaacactcatgatatgcattcaaagtgcttagcctgggggtcgccattgtgtacacacaataaatcttagtgtatcaagaattcaggcagtcatgaagctcaaatgacaagaatttttatttttattttttttaacagacagaagtcagggagggcagtcattgcttagacaatgagattcaagcaagtgctgttctaaatctctgagctctgtaggggagaagatggatgaagcaggcagcttgaagagggagacacgccagccagaaggaaaagaaagaagccggtgaagcaggaagagaagaaaacacgaaagggtaggaagatgagaaatggatgccaaggagagggagaaagagattgtcagcaagggaggcgaaccgaggagaaaacagggagattcccgcatgggtggagccaagtttccactgtgctgtgagcagaggaagccaggtgtattgttcctgaaactacgttattaactgcctaacatatggctcacaaggtacacgtggaagcgagagcaggaaacaaaatgcaagtcagctgggctaacgctgaaaaatagtgatctgtgtcagttttgagaagtgtgagaatagaaaccttctatgcaggagatcagcatctttgtctgtttcctacaccgaggctcaaagagaacatttgctcccaaaccatggtagttctgtttcagataaagttgtctcataccaaccataattcatgttcctgatcgtgaccctgaagcacaagaacccaaggaagcttcggaattttcaaagaaaaatgaattacgtagagtggtgtgaccagcaaatgcagtttgaattttaagtgtgtattctaattttttagaagattctgattccgtgtgtgaaagattgaattaccctccattttctaggatgtggcccatttgccagccagtctggacctcagatcttagttctggttctgtaacttcagttgcctgccagacatttccatctgggagccctgtcctcactctgaaacattctcagaaccagcctccttctccacctgccgtcagacattagcaccattcctctcccattgtcacctttgattgtctcttctttacttccatacactgcttttttttttttttttttccgacagtctcactctgccacccagagtatagtggtgcaatccctggtcactgcagcttccacttcctgggctcaagcagtcctctcaccttagcctcccgagaagctgacaccacaggtgcacgccatcaagcccagctaattttttttttttttgagacagtctcactttgttgcccaggctggagtgtagtggcacaatctcggctcactgcaaactctgcttcccgggttcaagcaattctcctgcctcagcctcccccaagtagctgggactataggcgcacgctgccatgctggctaattttttgtattctagtagagatggggtttcagcgtgttgcccaggttggtcttgaacttctgagctcaggcaatctgcctgcctcggcctcccaagtgctaggactacaccatgcctggcctaatttttaaatttttttgtagagatgggtttttgtcatgttgctcaggctagtcttgaacttctgagctcaaaagatacacccccctttggcttcccaaagtgctggaattacaggcatgagccaccacgcccagcccaatatgctgccaaatttttcttcaaatgatttcctagttccttccttgccattcttgctgccctgaattaagcccaggtcctcatttattggcttcccacttgactccttctattttagccagcacacatgttgtagaacaacttccttaatgtggctttcacttggcttctgactcagagtgtatgaggtctcctaatttcctagggcagtaggcctggccctaccccacaagcctcattaccgttttatctgcccatatcccatcaccctctatccacatcttgttatccagtggagagtttccacttctaggttccaagccagaaatgtgtggatcattctgtcttccctcacttccttaaacaacccgtcggcaagtcccacagactggatctccagagtttccctgtagctcttttctccatgctcaccaccctagtttagggcaatgccaccctttattgagactctggaagaacctcctgacagttcctgctcccctctggccccgtcaatccattttctacacagtggcccagaatgtttaaaaatgcaaatcaggttgtatcatgcctccagtggcttctcattgcacctagggtaaaatccaagatccttatagtagcttccaaggtcctgcatggcttatcctctccctccctcctcgaagacctcaatgcacctgactgaactgatctcagcacgtttccacctctggccaggctctctacctaatgaccctcctccctgctttttgatccattccacctctcatctcctaggtcttggcttaaatatcttcagagaagcccttctggacttccttcagtagtgtcattcccacttcccgccactattcttattacctgtttatttccttcatacctttttatcatttgcaatgattgtgtttgtttcctcatcttttttctgcctcccccagacctgaagctccgaaagaccccggagtgtttgtcttgttaaccatcgtttctccagctgtccacgcaatggtcaatatgttagctattataattactattttaatattactgtttcttgatgatttcagactctttggatagaatattctcccttctatctgagagtgtttgtgaccttctcatatttcctcatgtcctctggaatcctgacctaaatttttagtcttttcctatcagttatcaattgcttacttgttgttttcatgtttaaaaactcattcaactccatccaaactttcttcttcttcttacaaaatagtttatagctaactatatttccttactctcatttgttccttccctgtattcagtgtctccccatcaatatcttttattactccagaataatttcagaaacagtttgagacagttttaaaaataatgccgctggcattttactagggatgacattaaccttatcagttagtttgagggaaatcagtatctttgcaatatcaaaactcttcctaatcaaggacagaccacatttttccatttatgtgtttttaaataaaataatgttttctttgtattggctttttaacattattgttaaattccccttcaacatttaactgtttcactacaatatgtctaaatctaggtctgttttttattaatttgggctaacatatgatgagctttgatctacaaatgcaggtcttgcttcaacttaaaaatattttcttttctaatatctttaaatagctcttctgttctttttttctctctccttcaaaactagatttctatcacctgtctttctatgtctagaccttgtttctgatagttttgatctctttgtcctttttttttcttttttgtgaggcaggttcttgctctgtcacccaggctggtgtgcagtggcacaactcagctcactgcaacctctgcctcccaggctcaaacaatccttctacctcagcctcccaagtagctgggaccacaggcacttgctaccatgcccagctaatctttgtccttttcttttgcattacagaatacagtcctatgcttagctttcttttcactgattgaattatcttccattgccagttgtaaccactgtggttgctaagtttatttacaattcttccatgtcattattattattatttgatacagagtctccttttgtcacccaggctagagtgcagtggcctgatatctgctctctgcaacctctgcctcccaggttcaagcgattcttctgcctcagcctcccaagtaggtgggactacagatgcacgccactgtgtctggctaatttttgtatttttagtagagatggggttttaccacattggccaggttggtctcaaactcctgacctcagatgatccacccaccttggcctcccaaagtgctgggattacaggtgtgagccaccacgtccagtcacattattttcttaactgtgtcaactctctcatatcactttgttggcttatctcattcttaccttttatttcatggagtctgagatttttatctgtccctccatcaaatgtagtttaaatattgttttaagtgttgttcaaatgtatttccattttctacagtaacattttttctttaaaatattcaattttaacacttcttgagtgctacgtgtatccattttctcgttacagaatagttgcataggttacacgtgatatagtttggctgcatccctaaccaaatctcatcttgaactgtagctcccataatccctacatgttgttggagggacccagtgggaggtcattgaatcatgggggtgtgttttttccattctgttctcgtgatagtgaataagtctctagagatctgatggttttataaaggccagttcccggctgttcgcagtggctcatgcctgtaattccagcactttgggaggctgaagtgggtagattacctgaggttaggagttcaagaccaacctggccaacatggtgaagccccatgtctgctgaaaatacaaaaattagctgggtgtggtggcgtgtgcctgtaatcacagctactccagaggctgaggcaggagaatcacttgaacctaggaggtggagttgcagtgagctgagatcactccactgcactccagtctgggtgacagagtgagacttggtctcaaaagaaaagaagaagaagaagaggaagaggaagaagaaagaagaaagaagaaggtggtggcagttcccctgcacatgctctcttgcctgctgccatgtaagatgtgctcctcctttgccctctgccatgattgtgatgcctccccagccatgtggaactgtgagtccaataaacctctttttctttacaaattacccagtctctggtatttcttcatagcagtatgaaaatgaactaaacagtaaattggtactggtaaagtggggtactgctgtaaatatacctgaaaatgtggaagtgactttggaactgggtaacagacagaggttggaacagtttggaaggctcagacgaagacaggaaaatatgagaaagtttggaacttcctagagacttgttgaatggctttgactaaaatgctgatagtgatatggacaataaagtacaggctgaggtggtctcagacggagatgaggaacttgttgggaactggagcaaaggtgactcttgttatgctttggcaaatagactggcagcattttgcccctgccctagagatctgtggaactttgaacttgagagagacgatttagggtatgtggtggaagaaatttctaagcagaaaagtattcaagaggaagcagagcatgaaagtttggaaaattttcagcctgatgatgcaatagaaaagaaaaacccattttctggagagaaattcaagcctgctgcagaaatttgcataagtaaggagcccaatgttagtcaccaagacaatggggaaaatgtctccagggtatgtcagagacctttgcagcagcccctcccctcacaggcccagaggtctagggggaaaaaatggtttcctgggccaggcccaggcccccactgtgtgcagcctaggaacttggtgctgtgagtcccagccactccagctgtggctaaaaggggccaaggtaccacttggacttgtggcttcagagggtgcaagtcccaaatcttagcagcttttacatggtttgagcctgcaggtgcaaaaaagtcaagaattgaggttggggaacctccacttagatttcagaggatgaatggaaatgtctggatgtccaggtggaagtttgctgcaggagcagagctctcatggagaacctctgctagggcagtgcagaaaagaaatgtgggtttggaacccccacatggagtcccctctagggcactgcctagtggagctgtgagaagaaggccaccatcctccagaccccagaatggtagatccactgacagcctgcaccatacaccaggaaaagctgcagacactcaactgggaaagcagccagaaggggggctatacccagcaaagccacagaggcagagctgcccagggctgtgggagcccaagcttgtgtcagcatgccctggatgtgagacatggagtaaaaggagatcattttgtaactttaaggtttaatgattgccctattggatttcagacttggatggggcctgtagctcctttgttttatggccaatttctcccatttgaaatggatgtatttacccaatgcctgtatccccattgtatctaggaaataactaacttgcctttgattttacaggctcataggcagaagagatttgccttgtctcagatgaaacttaggacttggacttttgggttaatgctggaataagttaagactttgtgggactgttgggaaggcatgattgtgttttaaaatgtgaggaaatgagatgtgggaggggccaggggcagaattatatggtttggctgtgtccccacccaaatctcatcttgaattgtagctcctgtgtgtcatgggagggacacagtgggaggtaattgaaacatgggggtgggtttttcctgtgctattttcatgatagtaagtctcatgagatatgatggttctataaacggcagttcccctacatatactcacttgcctgccaccatgtaagacatgcctttgctcctcctttgctttccaccataattgtgaggcctcccacccatgtgaaactgtgagtccattaaacctctttttctttataagttactcagtcttggtatttcttcatagcagtatgaaaatggactaatacaacatgtttgtttttccctcttaatatattttggaatgaggaaagatctctcttgactatgcattcccccaaaagtaatgtgaatggatttcacagcttacctgaagtcaattagaataatccttttccatcttgaattggaggatggaatgagataagttcagtgatccatcaggcagatgggtgtagcagggatcctggtggtgctgggggtgtcctaacagcaatcctgatcacagccatcagtggcgctagccaggtgccaggcctgatttggaacattgcatgtgtgtttccttgtttaatcctcacaatcactctatgaggtatatatattatcatcattcccactacatagatgaggaaactgagggctcagttaagaaagttatccaagctaataattagcagaataagcattcaaacccagactatctgactccagaattcatggtcttaacttttatgttatattgcctcacttgctcctgggcctggggctccagtgccacagcccccaaggtaggagtgcttcctgttcctcagtgggctcaacctgagggttcagtgggatggaccttccactttcatcccatgacacacaactctttgaagtgagttgaattgtgagtcttccttctagttcctccttgtcttaatatctagaatgaaagtctagaacacatccctagattttctttctctctctttccttccttctttccttccctccctccctccctcccttctttttctctttctttctttctttctttctttctttctttctttctttctttctttctttctctctctctctctctctttctttctttctttctttctttcttgtctttctttctttcttcttttttttttttgaaacagcctgctgcccaggctggagtgcagtggctcgatctcagctcactgcaacctctgcctctgggttcaagcaattctcctgcttcagcctcccgagtagctgggactacaggtgtgcaccaccatgcttagcaaatttttgctttttttttttttttttttgagatggagtctcgctctttcacccaggccagactgcagtggcgctctcttggctcactgcaagctccgcctcctgggttcacaccattctcctgcctcagcctcccaagtagctgggactacaggcgcccgccaccacgcctggctaatttttttttgtatttttagtagagacggggtttcaccatgttgaccagactggtcttgaactcctgacctcaagtgatccacctgcctcagcctcccaaaatgctgggattacaggcatgagccactgtgcctggcctatgttattttattttattttattttattttattttattttagagacagggtctcactctgtcactcagtctggagtgcagtggcacaatcttggctcactgcaatctccacttcctggattcaagtgattctcatgcctcagcctctcgagtaactgggattacaggcgcgctctaccatacccagctaatttttgtatttttagtagagacagggttttgccatgttgcccaggctggtcttgaactcctgacctcaagtgacccagccgtcttggcctcccaaagtgctgggattgcaggcatgagccaccgtgcctggcctgtttttattttggtatttttaggagtttctaggagctggggattgaacacctatgctctgttcccctttttccaggtctctccctctgccctgtctccctctctgtctcctgcttcctgaaacactcttctgccttgcctgccattctgcttcattatctccagggtctctggctgtgccctccccatcctccctctcatctgtctgcaccttgattcccccttggctccattctcagttgttcttttctgtctccgccctccttggtgacctcacacactctaaagctttcaccgccatccacactggtgtgtggtccctggcctcagcccagatgtctcccaaacttcctttgaacagtgattgtctgccgaatgcttctacctagggggttcacaaactggacagcacacactcccatatggaacactgcactggtcaccttttctcattgaatgtgccttccacttgctggggagtcatcctggattcctgcctctggtctggccactctgcagtccaactgccctccctgctgtgggcagatgatctctcccttcctcgagtcctccaaagcctccagcgccagctcttccatgtggtctcagaggtcatcagggatttgatcacttttcacctcattgaactttgctctttgctggattctgtttcctgctctgccacccaggctggagtgcagtggcacgatcatagctcactgtatccttgaattcctgggctcaagtgatcctccagcctcagcctcctccagcctcagcctcctgagcagctgtgattacagaggtgtcccaccacacctagttaattttttttttttttagatggagtctcgctctgtcaccaggctggagtgtagtggcgcaatctcggctcactgcaacctccgcctcccgggttcaagtgattctcctgcctcagcctcccaagtagctgggactacaggtgcccaccatcatgccctgctaattttttgtatttttagtagagacagggtttcaccatgttggccaggatggtctcgatctcttgacttcgtgatccacccacctcagcctcccaaagtgctgggattacaggcgtgagccaccgcgctcagccaatttttttcttttttttaaagacagggtcttgttgtgttgcccaggctggtctcaaactcttggcctcaagcgatcctcgtgcctaaacctcccatgtattttcccagctttctgcacagcttggagttccctgtgtttattttccatggccttgcccctgtctgctggtaaatggccttctggggaggggaataatctctgctctttagcatttgctgacatctgtggtgtaaatattcccatcaccgccaatctcaaactactaacatgacttcattgaatgtggagttgggtagagatgttcaatagccaccattagacagtatttccaccttacagatacaatagacctaaaacaaaccctcagccaggtgtggtagcttatacctgtaatcccagtattttgggaggctgaggcaggtggattgcttgagcccaggagattgagaccagcctaggcaacatggcaaaatcccatctctacaaaaaaaaaaaatgcaaaaattagccagatgtggtggtgcatgcctgtagtcccagatacttgggaggctgaggtaggagaatcacttgagcctgggaggcagagattgtggtgagctgagatcacaccactgccctccagcttgggtgacagagtgagaccctgtctcaaaaaaacaaaaacaaaaccctcaagggcatagataatagtaaatagtagtaaaataattagggagtgatatatttttagcatttattatctttagtattttgtattttagtatttataacctttatttttaatataatttatttaattgtaaacttacataatttaattattaataatgaccacatgtaacagcttgctggcaaaattcctgaacacttagcgagcagccctcctgagctggtttgagctagctccagcgtgctcctggctccccttcctagagatccctcatctccaccgacatctggtcaatacttatccttcccttaagtcagctctgctcacagtgggagtgtgtccctctgccactccatcactgctctccccacattgcaatgatctatttacacacctgtctcacctcctattccatgaacttcttgagggcagaggctgtgtctcatttatctttgtaatcccagtatagtgcctggaacatagtacacatttggtgaattatgatttaaagaattgatggtgccttttctgttagcactattcttttctcatctatctctatttctaatcactttgggaaatgctcttggctgcatgatgaaacagagtgccaggtcttcataaaaaaaaaaaaaaaaaagcttgttgattgggtaaactcaccaagctgactagagcagttttaagtataaattgtttactcatatactgcctgtggctatagaatgcaaattaatcactttggcaaagtgttgtattagagttctccagagagacaggaccaataggagataggtagatagatagatagatagatagatagaaccaataggagatagatgatagatagatagatagatagatagatagatgatagatagatagatagatagatagatagatagatagaaccaataggaaatagataggtagatagatagacacaaccaataggagattagatagatagatagatagatagatagatagatagatagatagacagacagaaccaacaggagatagatacataggtaaatagatgataggtagatagagatagagagttatagatatatgagaagggatttatttggggaattggctcacaaactatggaggctgagaagtcccatgataggttatctacaagctggagactcagtgatgctgacagcatggctcagtccccgtctaaaggcctcggaacctcagaaccaggggagctcatgctgtaactctcagtccgaggctgaaggcttgagaacttgagggggtctgctggtacaagttccagagtccaaaggccagagatcttggaattctgatgtccaagagcaggagaaaaagggtgtcccagctccgagagtgagtgtggattcacctgcctttttgttctatccaggtccaaagctgaatgggtggtgcccgtccatgttgagggtgaatcttctccactcagtccaccaactcacatgccagtctcttctgaaaacaccctcacagacacacccagaaagaatgcttcaccagctatctaggcatcccttgagccaatcaaggtgacacctaaaattaaccatcatagtgataatttaaggcattaaggacatcatttcatgtcctgcagctctttaagcccaggcttggtcattttcaataagtggaaattaacttttttttttttttgagacagggtctcgctctgtcacccaggctggagtacagtggtgtgatctcggctcactgcaacctctgtttcacgggctcaatcaattctccaacctcagcctcccaaatagctaggattacaggcatgagccaccaatgcctgactttttttttctttttggtagagatggggttttgccatgttgcccaggctggtctcaaacttgtgagctcaaaacaatcctcccactttggccttccaaaagggattacagaggtgagccactgtgcccggcctggaaattaccattctaagtcatctttgtgactgctgtgactgccaggaaatcagagtagtccaccaggaagagttatctcttgggctgaacagaacagtggttgagtgtctctggtgtgacaggtgctatattcgccatggggatagatgaatggaaaggaatttgtaaaggtattgacaatgttttttgagtttttaaacaggatgcttgtcattttaatgacacagactctaatttctaagcatttttagagggatgcatatttttgtatactattaactgcatagtcttctttcttagaatgcctaatttaccagacattgacagaactttagctcaagcctcactaagaagacgtagcagtgcacgctctgggattattttatacttcactaggatgacttatttatagaacagaatctttttgctttcctacaagattcaacagttctattaagcaacagcaaaagaaacagctacttctccagagcagacttcaatcttaagcaagatttatatttcaaaaataaatatttaaaagcaaatcataacagagctaaaaccaacaataccacatatacccaaactatgccagtgagtctgggtccatatcttgtaggaattatatgtttctgaaaacctagagagattttattctctccctaaagaaaagtttaaggtcttattctatccatacacacacacatcagactgaaaagcaaaatcagaagactgagttcacctgaatttaattcaaattcgaggaagtagcatttgaaatagcttattttttgactggattcaacctgaagtatattgtgatttctcaatatctccttccacagggaaacattatttcttgcctatgatgggtacaaatctatatatactctgcacatacagtcactctttgtcacacttgataatgggtcacatttgtggtgaacagatgtttcctgagagtctgagactcatgagcaaagccgtggtgtgggtaagagggatgagctgttctcactggatgcttcaaaaggggctgtgcttacaattagtctgaaagccaaattatccttattgaagaaggacaaaatggcatgggcaagctcttatctcctgtcttaggacagatgctgcttatgaaaattgtctgtacctgtctttgatgattctggactagaaatggttccctggcatgactgggtgtcttagaaaggacactgtggagttaacttctggaaggaaagtctaacatgatctgcaggctcaataacagataaagggaaaaaagaagggaaagaagacaaaaggaaaggagtttttcactctgacaagaaccacatgagtgactaaccctaaagatggaaatagaaaatgacctttggtgagggatattttctgaacattcaaagctggatttgactgctttataacatttcaaatggcatggaatgtactctgttgtgaatgagaaatgccccctttaaaatgagcaaagccttaagttagtctacatgacagtgactctggccaggtagaatatttcaaccctgcacttcctggcctgtaccctttcgagcaattgcatttcataaatttcaggagcatgcctgaagcagatggttgagacatgggaaggatcataaatccgggcctcaatgtcttccagctcccaaattcaaggctctgaaatgctggccttggcacaacttggcatccatgccatggaacagtcttccacaggtggtagttcagtatcttatgtttagttcttattgccgtccttgaaaagcagcagtatataggaatggtaaaagacctctctttttcttgtgtgccataaaaatagctagatagaaactctttccagagcaaagaaaagtaggttgaaatgttctacactttgtggttgaggctgaattccgactgagcaaatacacacaaatgaggggagacaatatcaaccccacaatgttggggtgaactcctcggtgacagatgaagaaacaaacactctcagtgcagttatcctcatatcagatgctttaccctgaaccaaacgtttttccagaaatttttttctctgttaccaaagtaatacacattcattctagatttttggaagttcagacaaacataaggaagaaaatctcctttgcttttcctgtacatgtacacgtggaaaaacgtcctttgccttgggtcgtgttttgtggattatgcctaattaaagacagtactcttcttagagaccagtatcaaaatgagttgaggggacttgcaagaaggaatgaatggaatgtattcatttctccacattcctatccccagtttttggggaaaggtggtgagcccctgtgtcttgcattgataacacgagaagtacctgagagtttcctgcgagaaatgagcagtcactgtacctcatctaaagtgctttgaagccaagcacggtgactcacgcctgtaatcccagcactttgggaggctgaggcaggtgtatcacttgaggtcaggagttcaaggccagcctggccatcatggcaaaacccggtctctactaaaaatacaaaaattagccaggtgtggtggtgggtgcctgtaatcccagctactcaggagactgaggcaggagaatcgcttgaaccggggtggcggaggttgcagtgagccaagaccatgccactgcactccagcctggacaacagagcaaaactcggtctcaaataaataaaataaaataaataaaataaaataaaataaaataaaataaaataaaatagtgctttgaatgcttgagaagaacctggtgggtcactcagttcatcctctgaggaggcgctcattcctgtttgaggataagagtggagaagaacattttggggaagccctggacctttcgtattcggcctttcagagaccttccagtactgggtcactgatgtcccttcaggatgtgagtaacctccactgactactgcagacctctgatcacttcctttagtgtaactcgctctgcacagccacaaaagatgggctgctgcctggctgaggaaacacccttctggtcaaggggctgaagaaaatctgttgtccgcttgactgaggacgacttcctgacaaatgtttcacatggaagaataggtccaggtttccataggtttgtccaaaggtttggttatgttatatcctgcttcttttgaatgataacatccatcatagagttataggctgtggtcacctgttctcggacctttggttgggtccctgaatcacatgtaactgtttttctgtaatcatcatcaaatccaccttacctgtggctctagaactcagcaactctagaacacagggctgttagttttccagatcttctttgtaactatgttaagcattaagaaatactaggttcagggatgacaggcatacaatgtgtatgtatctttttctgccaaaatgaggtgtgaatcagttagcacatttgagacctggtacccaaaacagccaggatgaatgaggtgaagaaggcacagtgggagccctcaggtgccacttcctctccactctacaaaatcagaagtctctgttgcttgcatgttatgtggatgtggttttcatttttctggcccttttggattggctttcttttggaccgtttgtgtggcattgatgctgccttcccccagcacggcctttgcttctgcctctcctaaatgaagcaccccactgtccagatggtaccatctcttcattacagaaaaatcatctaagtagaaagaagtagcgtttgagccacattgctatgtagtgttgggaggaacagtctctatcgaccctcagctcacttcctgatcaactcagcctatggctcagacaattggtttgttttccacgaaggtttaaagtgtggagtacatggttccaaccctcaccctctcactcagtttttctgggaaaattagctggcatgatacatttcagattcaaaaagctggactctgggatgccctccccaagatggcagagctttgggatgaaaacagtgtcaggtaaggagttaagtagccttatcttggcctaagttcactgaactgaccaagcttgattgtatccagttggtcaagtggacactcaacatgactttgctggaatcacaaggtggttgttgccattggaggaaagaacagatgtggaaggcctcatacaaggtgggaaaatatagttctctggagttccaatgagagagttccaaggcctcactgaattagggccttggggaaatatgacacagattctagagctgagcaacaagacaaagcatgtctaatgagaaagtgagctccccagaattggaggatttcaagcagagaccaggtacctaggtgccaggggtgctatgaaggtagaagactggactaggtgcccagagtctctgtgtggtgatcaaacttttccaaagattgtagttcttggcactgacctggagtcctcaacagcttctgcatccttggtctcaacttgggtctggtgtcctggtccctaggtggtgagctccctgagcacagggcactggtcttgtccatcatcctcccctagcacctgtctctgtgcctttcaccttaagggtgttctacaagtgtttcctaaaggggtggtggcatgctggctcctccaaccccagctgtgagctgaaatactgtctcaaatccaaactgtctacatgatactgataagaaacaggattcgaatctcaattttgctacccaaggattttgatgtaagagaatgtaaatttaaaaccaacattaggactgtgagtttgagactaaaactctggccttgctgttccatggccttaggagaagcacaggcatcaggacagatggaaagagagagagcgagacagacagacagacaaacagggtgctctgcaaagcagccagtgggcagaggagcctccatggagctcctagaacttatcttagcaattttccaagtttctaggcagcctgaccaagtaggaagaataatttggtcaattccatgaagaggttccctcttttgaaatgtatgattctaatccgcagctctttcatcaaagcaaaggcagtgaataacacagcccaaactgattttgttggtaaacaccacccaactgttttcttattagtttaccttggcaatacctctctatgatgtaattatgtgaggtttcagagccatatttacttccatcccacacacaccttatgttacctcatcttccactgccatattgagagaaaggaacacttctcagttcctgcagaaacttgaagaatcctattgggagataaggcagacattgactccaaatagttgggtggtggtgaagtgcaagtatgagaccagggcttccgtaggaggaggtcacttcagaggaggaggagaggggaagaggaaacccccaggcagccagtgaccaggaaagcagtaaagtgatggctaattattgtgaaagaaccaagttggaaacagttcacatcaatcctcagagagggttggacaattctggccaatttggtacacctgtcaaggaaagatggtgatatggtttggctctgtgtccccacccaaatctcatctcgaattgtaatccccacttgtcaagggagggatctggtgggaggtgattgcatcgtgggagcagtttctcccatgttgctgtcatgatagtgagtgagttctcatgagatctgatggttttataaggggctcttcccactttacatgctctttttctctctcctgccgccttgtgaagaaggcgcctgttttcccttctgccatgattgtaagtttcctgaggctaccccagccatgcagaactgtgaattaattgaattgcctttgtttataaattacccagtctcaagtagtatctctagagccgtgtgaaaatcggctaatacagatgggaagtcagggtctctcctgggggacagaggagcgtgcttgagacagaataggaagaaattcatacagaatcgaaagagttgctgacatgctgctgcccaaatacagcagcttcttcagacctcaggtgtcccccagaggtgccatctttgaatctaatgtgtagattcttattcagttggtctgggtagggtgtgggctttagaattttaaaggatctccctggtgcttctaatgcacaggtagggttgagaagcacactgttctcaaagagtggtcccagaccagcagcatcagcatcacctgggaaattggaagaaatgcaaattctagggccccaacccagaattactgaatcagaaactctggcaatggtgcccatcaaactgtgttgtatttaacgagttctgcaggtgattccgatatttgctgaagttgaactactgcaatagagatgtttgaatctcaggatgctcccatccctgcccctgctccctgccttccttagttctccaagaaatcctgtctctgactcccccatccaggcttggaaccctggaggcttcctcgtagggctgcgtagagcaggtggggagggcaactccacagccctagtcacctgtgagctgcgtagacaagagaattttccagcaagtagaagtcaagtgtcctggggaaggtctgatttgcagagtcagggtttagttcaatgattgggcttcctggactccctcctctccttgtccttcccaatcagttgccaagcccccagctgtttcattaagaaatatctgaatcctcctccaccgatcactgtccattttctcactagtctcatgcttcagccctacttcctagattctggtagggatctcccagtgggtctcccttgctgctgtctccccccgtcccagccccccatcagctgtctttctcgacagcacttggcgcccatcccttcctcttccaccctgcttcccatgtgagcttgacacatgcacgctgcccacctgtacatgcatgcacacgtgcctgctccacaagacgccgccagcaagtcctgtggcctgtcctgtgggcaaagtccatgatcctcagcctggtatccagagacccccctgccggcccctccctaccacttcaaccttatctctcaccatcctgcttcatgaatcttgtgctccagccaaactggtatactggtaaaaccccgataagataagcaagtaaaattagagcccataaacccggaacaggtacaggcagccacggggtgtccagaggacgcagctttagtaacttcaagtgctcaggggtgggaatgggtacactccagtctttgagttaaatagcatgaaagtgagatgatgtggagaactgaactaattactcaaggactcaagaactcactgctctctctgcacctcttcttttctttatggtatttcactcattatatccttcttagaaaatctaggttgagaaatgattttatggttatttcaataaactgatatattttatagaaaatgagccaggttcttggattatggaaacaaaccttaatttatgtcaagtgttcttgcagaaagagtggtgccacctaccttcataacctgaagagcaccattgttacctgatggcagctacctaaaacacaggcagtagtacattcattcatttcagaaacatttcgtgatcacctactgagtgacaagcaggcattctcccagtcactggggatacattgttgaaccagatataactcttcttctcaaaaagcttacatctagagtgttggtagaggcaagctcactgagtaggattggggtgctgtggcaggacacggatcgacaatggatcatctctgggaggccctggagggttccttgaggaggtggtggctactctaagtcctgaaaatgcacagaaaggagcctgccttgttaggagagggtgaaggtataggatggcacagggcctgttgtaactcaggtgggtgcaggtacaagtcagactggggttcagtacagagaccaccagtacagacagggatggaactaggatcagtaaagacagggacttggctaaatgttcaaggtacgaaggtgttggccaggctgttctctaactcctgacctcaagtgatccacctgctttggcctcccaaagtgctaggattataggtatgagccaccacgcccagcctccctcactcagttcttatttctatactgccattctaggtggagactggtaccataccacctgctgacatattcccttggaggcagctgctgccaaaacttaggattatcttctacttgagggtttaccattattgggcctgtgcctgggtcgcagtgccccctttgcagacagagtgaatatttctgatttacattgttcattggagtgtggagaattgagccttgattcaagtagaaaccacgttctcagagggtccagctgggctggtgagatgaataccacacatagacggctccaatggcttcatggagctgggggaaggctcctggtggcacatgtagagcagacccctggtagcaactcagcctcctggagagagagttgggaatactgggtcagatgccatcataccagcatctcagaggctagtccctctccatccctgatccctgaactagctactgggccttggctttttagcagagggctgcaattgccaccctccagcctgttctagtggcttgtttcctatacaggaattggtgaattgaggacatacccagaatgggaccccacctgtggcaggaatgctatatgctttccaaacctctttccttttcctcctgggctggctccatttctcagcctcctttgcaattaggggtggtcatgtttccaaagagtgtgtacaccacctccaggcctggcctgtaaaattcttcctcatatcatcttctctgttttccacttgccagctggttgtggatgatccagcagaggcatctgaggttccagtggacgacagggttacaagatggaaaaagcctgaattcctgagtcactgcatggaaggctgcctactgaacacacacatttgggctgttacatgagtgacagacacacttctgtagtgtgaagctcttgagatttgggggcccctcattacaacacttatgctattcattctttcccccaactctcttcttttgtttgtttgttttttgtttgagatgcagtctcactctgtcgcccaggctggagtgcagtggcactatcttggctcactgcaacctccgcctcccaggttcaagcgattctcctgcctcagcctccctagtaactgggattacaggtgcacgccaccatgcccggctaatttttgtatttttagtagagatgggttttcaccatgttggccaggctggtctgaaactcctgacctcaagtgatccacctgccttggcctcctaaagtgctggaattgcaggtatgagccaccactctcagcctccccaactcagctcttatttctatattgccatactaggtggagattggggccctaccacctgctgacatatttccttggaggcatctgctgccagaacttcgaattatcttctgcttgagagtttctattattgggcctgtgcctgggtcacagtgccccctttgctctgtagtgggacttcctggtcctgacaacttgcctgaaatgccatttgtgatcttgctgtcaaactctggattctaacttttgctttctgagcatgctgtctgtctccttatgcctgctcccactctcactcccagtgactaggaggtgaaaaatgactgttccaggcaccaacttgcctgaaagctctaagacttgccttaaggcagtcaagccgtctgctgactctccacttttgcaaggagaactacgtctagtcatcaacatgtagccgcatccagccatgaggaggggcgggagagatttgacaacatctcaggaagtgctaacatctgacaagctgagatcatgggtgtcataaattgatagagaggctgaaatgagaaggagataggatgggccatgtgtggttagcaacatcaagagcaacttgtagttgacaacctcattgctcatcttctgctgacacatacagccaaagtctgaatggtggcattgcttcaactcccctgctgtgtgatgggggcacctgattgatgttgacacgccaatgttgggctatcatcggaggaggtctgtattaattttaacaatgaaaatagacgggttacagttaccctaaatagcatcaagtcaccccacttcataaagcccttcaatggctttcctttccttttggaaggaagtagtgcatttttcacatggtccactgggtcttagatgtcctgaccctaccttatctctcctgtgtaggccagtcctaccctttcttctgcttaatgcctcccagccatgctggtgttttctacattcttcatgcgcacccagcacagtgccaggcaccctgtacaaattcaataaataattcttggattaatgaataagaggtcaatcaggagatggctgcaatctaatgagaaaccatggagctgatatttgggtgggtgtctctaaatctaagccctaagaaaccttgctcgttcactgttctagtgtcttcccattgcctagaacagtctcccatgcccagtagatgccaaggcatttgttgaatcaacgaaatgaagtagaatgaatggataaaaggagtagtgaccagaatgagggagacttcataggcaggaccagcagggcttgctgactaactggattttgagatgagggggctgagagaagtcaaggatgatcccaagtttctggcttggggctgaagggaggaaggtacaatttactgagacgggggagatgggatgaggttaatggagaaaggaggctgcggcaatgagtctagctttagatttttcgagtctgtagcatctgtaggctggttgtcagaggatgtccagtgggcagctggatatattggtctgaaactcaggaatgacaattgggctggagagaatagatttgggagtgaacagcctgtgatgttaacaaaagccaagtgagtggatgagattgcaatgtgataggtggtgtggttgtacaatgatgtataaaatatggtccctgccctcaagactaatacaaaatcaagatatgacatagaccttaaaactgtttatgagcccatccatatctccatagcaaccttgaagcagagcgatagctctgcccttatcacaggcaggggaaacacacagatggctgctgtctcccacaagtctcccactgcaggagatgtttcctcttccccgtgggacccacaatgagtggcacctgcaaattccactcttctagccagtccaaacccgagtcttcttccacgtctcagccatggggccgaagagagggagggggacgtcagaatcagccctttctgtccaaacccccttttctctaggtcttgtctctctacaccctccactttgccaaagccaggaaggaggtggccgtaatgaccacattgccactttcccttggtctttctgtggcacgaatgctgtacgtcgtttcctgcttcctgcaactgtccgccagtggcttcagtggaaacaatcacagacctcgtgtattgagtgctccctgtgagccagagctccactaatcaggccacacgaggaattcattttcctctcaaccatcctaggcagtgtggacagttatcaccacttcacaaatgagaaaccgaggctcagagagatcattttgggttctaagattgtctaagctagagtatggaaggggtaggatttgaacacaggtcatttgaaaacaaaaagctgcatccttaagcagtaaaataaggttcctcagctaatggtcctgttgtctgcttgctctctcttatactctttctctctctctctctctggttatatctgttgaatctttttccaggcatctctttggtattgccctgtaaggctgctcttcttggtgttggttcccccaccctcaactccgtgcttcccttctcagcactctacctgttctctgtagcccacttttatccctatggctttgccccatccacaagcaaatggctctcaaaatgaaaattatttccctacttcagatttttctcctgacctctacagatctggccatctcccgagcatcttaatctgtggggccgcaagaggcctcgtgctcagcgtgcagaacactgaagccacgatagcttcctaacacttgcttccttccccgagtccctgtcgtactgtatggcactatcatgggctcactcaacagagccggacattcaggggtgatccttgacgtccccctcttcttcatccccacactcaatcagcaaccaaatactatggattctgccttcctagtggtcttaaaaaccagccctctcttgctcatttccacatccactgccttattcaggctgtcatcccccacctagctgacccgcagcctcctggctggtcctcatgtcaggtagaaagcatccaatctgcctcctgagtgatatttctagaagccaatctgatcacgttgctgctcaattttacctcctgctctggctttccctgaccctagcatgaaagatgaacttcttggtatggcccgcagtgccttgcatatctccccgtcctccccactcaccccagtttcccatgcctttgagcaagcgtcagccatgctccctccgacaagcacatctatcctactctcttctgcttggtgaattcatctgcacagtctaagctcaaatgtcattagattcaaaccttttgccgatctcctgtcctcctgtttgtgtccgctctgtgccctgcatgtatttgtgtgccatcataactataagacggacggaacttaggtgattatatgtctatttccttatcctggaaggtgagctccttgttggagagatgtggggcttatacactgggattctcatctactgccaggtccccagtgattattcaataagtgttttctagaagaaggactgaaggaacagaggagtcctcctaacctgatctcccgctctcagaaatggaacagagtccctaaaaggatcatattgaagagactggactgcattgggggtagccaaggttttcatgcttccaaagggcccctaatatcttttgtaaggaggtgaagcagaccccaagctcataccacccgtcctctttcttccctctagccactctgcaccctggaggtaaacatcagaataaacgatatcataaccgtgggctggctcggtgaactatgagtattctaaaccaagatgtgatcttagatttagtgggaaaaaaacactgcatgtaaagccaaaagattcgggcttgagcctggcctctaggttgtgttacatgtatgacctcaggtggtcgtgggacatctctgagctccggttttatcaacctgggaatgaaaagtattggtcacttacttcctggggttgctctgaggctgagtaaagttagagaatttcttggtacttgtatggtgctgaggaagctccattgtccctttacccagcatccttcatggcaaagagaatgtgcctgctgacacctctttcagcctctgtttcagcctctgcctcagtccttgccagagacgtcaggcttagcacagagcagctgggagccttcagcagagaaggaaggcaccacttagacatctgcacgggcagtttttaaacatagggaacatgaaggaaataccacagaatttatggagtgaaagctttaaaaagaaacacaagtctgaagtcaaaacagttgactcaattctaggggagatgtctgcctggaagtaggagtgggggaaaaagacttggagtgagtggagacagggtaagcaaagctctgtggggagccctacaaagtggggcaagtgggcacctccccgcatggctcgagacggaaagtcggtcctgcctgtacacagggtagcacttaccagcattttggaaacacacatctttgggcccagctgttccacttttaagaatgtcgcttgagatagcctcatgcaagggcacaataatatatacaaggatgtccactgaagcctcattagaagttgagaaaacttggaaacaactcgaatgctgtttagcagaggataggctaaacaaattacaacacgtctgtacagtggactgaagcagcaaacggcgttatgtctctaaatatgaacaggaaacatattcattatacaataagtgagaaagaccagttgcaggatggcacaggtatgatgatcttgtttccataaaaactaaaaatatacatatgcctgtgcatgcatggaaaaatacaagaggataggaattaatttgtgaccagagtttgtcagtgggagttgggattataggatattttctgtacagttgtgtagagttgattttttcttttctttctttttcttttccttttcttttttttttttttttttgagacagagtcttgccgtatcatccaggctgaagtgcaatggcgtgatcttggctcactgcaccctctgcctcctgggttcaaatgattctcctgcctcagcctccaaagtagctgggattacaggcacctgccatcatgcctggcaaatttttgtatttttagtagagacagggttttgccatgttggtcagctggtcttgaactcctaacctctggtgatccacctgcctcggcctcccaaaatgctgcgattacagacatgagccactgcgcccagcctgagttgatttttttttaatagacatattagtaaaagaaaaatatacagaaaatagtgaaattacgggaaatatggcaactgtctgaccttcatcctagaaaaaccctgatcagtgtccctgtattgcatcacaggtaccaaaattgtaatacatccttcatcatgctactgtcccagtaaaaaccccgagcatctctcatttcttcccttccactccatcctggctaatttactgtccacaattcacagagtattgtctccactctgcgcagccacagaatgggtgtggtaacgtctccatggcatttatggtttctacaaatcacaaatcacatatgaagggctccaagaatattagaggaatgagccagttaactcagcgcccatgggggagctggcaactccccaagaaagctggacatctccaagctggccaccaacattctatagcctctccatgagcagggtgggagctgtgctgggtgcacagtgccatgtccacaggttgatgtgaggggcacgttctaaatcaagtgcctgagaagggcttcggagacctagatcctatccctaaacaactatgggacagtgtaccggtcactttccctttctgggtttctgttttcacctctgtaaaaaagagtaaggcttggtcagtgtttctcaaagcactctccttggaaaactacatctgggatatgttataaatgtccctgaagaggcctttgtggtaaaatacacttgagaaatgcagctctctgcatcgtgctcttggagatttccaatgcatattagcaggttagagtctctgaggtctggcagtaaataaacttacttatcaatgcttataccagcaattctcatgtttatttcaccttggcatcctttaagatattttttttctgagcatcttggttatacatacactgagttaagtgttatccacagtcactgctcgctccctgaatccgtgaccacgatgagtcaccctccatgccaccccctccatgctgccgggccatcatcctgcagtgttcctgtggctgaacatggattatttcaggtgacccctggaaaaaacgaagctctgttttgtgagagagaatgggttagcctctcagtacagatcccgatggaatgggatgaaggagaggtagcctactgaaaaaggagaggggtggggagtctaaaagggcttgaaatgcagccaggagcagccagatggggtggtgcagttgggggacactaagtaggagtgacatggagggacactaataagcagggaactacagaggaataattttcataatacgtctgttaaaaacagggaggcagggcaaatggtcagaaggaaaggaaggttcttggcacctgtgcggttcactatcttatttgtggctgtaactcatctcttcccctggatttaaataccaaatttatgttgatggcttccacgtttgaatataatctttcgaggaagagcatgggctttagagtcatacagcccatgcctcagtttcttcctctgtaacttggggctaaccataagatttacccgctaggtgtgtgtatgaggattaaatgagttgacacataggaaagctcctagaataactagtgtgtagtaagcactcaaatgacatgatcatgatcaattgttattattcatattttcagccatcagtgctctctggctcgacacctccactcagatgtctccagggcatctcaggcttaacaaaactgaatcagaattcttgattttcccaacaatacctcacctttcccagactccctgtttcaatgaatggcacctgatatacctgtagctcaagtttggaacctgagggtcaggtgtggtcctcctttccccttccctttcatatgcaccccaccaggaacttctgcagagcatgaacccacccccaaaatatatttcaagtccatctacttcttcccacctccctctctcctctagccaagcatcccttctctctgggtgaaggcagcagccttctgtgtgccctccctgtcttttctctcactcctttccagggaatctgcacctgtgaccacagccttctgtaacaaatgtacctgtgaccatcctaagacctgtgggggcacagaaaaggaagcccatagctacccctgctggcttttggtgtccatttgcatgaagtgtctttttccacccctttactttaagtttacatgagtccttatgtgtcaggtgagtctcctgaaggcagcagatagttagttggtgagttcttatccattctgcagttctgtatcttttaagtgcagcatttaggccatttacattcagtgttaatattgaaatgtgaggtaccattgcattcatcgggctctttgttgcctgtgtacttctttgtttgttttttgcttttgttttttaacttgtatttttgttttataggtcctgtgtgatttatgctttaaagaggttctgttttgatgtgtttccaggatttgtttcaagatttagaactccttttaccagttcttgtagtggtggcttggtaatgacgaattctctcaggatttgtttgtctgaaaatgactgtatctttccttcatatatggtgcttagtttcactggatacaaaattcttggctgataattggtttgttgaggagccggaagacagggccccaatcccttccagcttgtaggttttctgctgagaaatctgctgttcatctgattggttttcctttacaggttacctggttcttctgtctcacagctcttaagattctttcctttgtctcaactctggataacctgatgacaatgtgctgaggcaaagatctttttacaatgaatttcccatgtgttctttgtacttcttgtatttggatgtctaggtctctagatggctgcagaagttttccttgattcttcccccaaatatgttttccaagcttttagaattctcttcttcctcaggaacaccaattattcttaggtttggtcatttaacataatcccagacttcttggaggctttgttcatattttcttattcttttttctttgtctttgttgaattgggttaatttgaagaccttgtctttgagctctgattttctttcttctacttgttcaattctattgctgagactttccagagcatttcacatttctaaaagtgtgtccaaagtttcctgaattttcaattattttttctttaagctatttcattgaatatttctcccattcaatattgggggattgtgttgggagaggagggtctccctttcccacttccgcaaatggggcactcacagtatttggagtgtcttctgggtcctgcaggagcagtctggttccttcagagagtctgtgggtccttttgggattgctggttttttcttgcagttgatctggagctaaaattcaccatggaagcctccagatgctgctctgtctgaagctgcaatctagtcctgccacccagccactatgatcccctccatctctctgtccactttagtcagataagctcaaagctagaacaaaggacccatatatgagcctacggatctgccttcaaacacttgagaagccctccaactcaccatgagaacactgaccccaatcgggatctttgctttgctccaacagccagacactcagacaggtcctcagacccagcaactaatggacttggtgggatggttgtcctcaaagcagccagcattttgatcaggctggcgtctggtcctgtatttttctgggatattcagaatctcttgacatgtatcttcacttaattgtgaatttaaaaaattatagatggatgtagatatagatatagatatagacatagagatagatatagatagacattttggagaagagtctctctttgaagacttcctctcagagtacaagtccgtggttacaaccattttgtttctcagcaaacatggggaagtttgcttttcttctctgaggaagttaatataaatgtttattgacagtgcagtcatcaaggaataaagttgctgattcattcctttacactgaaaccctttgttgtgccctcctcttccttcctctttatagggagacactctgagaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtaagtgcagccagccctagggactgtgacagcgtcagccgtctcaccctggagccttgctggtgccatggcggggtatgtgggagtgtgtttttcttcttttctaatctagcgggagtgagtattaacacagcttcagaattaaaagcaaacagccaggttaatcttttgctaaaatgcatgagattgaagtgtcaggaaaggctggtgattcagtgactgagaacgctacacataattaagtttgaaagagatggaaaaagaaacaaattggaaaggcattaggtttgggtagaagcatttccttgaaccccgtcatatctcctcacctcatttttctaaaatcctctgtccttgttggatttacagtgaattcagcctcttggttcatattacattcaaaacaaaacaagacgtaggagctgtttggcaaatgtgggcctctttgcaggaagtcattgagggggatttctgtagggttaaggacaaagtggtagatctaatttctcatagttgatagagggagatggattctgatgaacatagtgtgtgcagctcctacaaaatttgagaccctgaaaggatctcaaacttgaactccgagttgctcccctgtggttttgttaattcaacagcaaattttcctaaggctgactctggtgtctgtaggtcgaaggcctcataatatgctacatttatgcatattcgccctgtcagttaaacttattagagttacccattcaatcaaaagcacctggatttagatggctctggcttttgagggcaaagtgagtggaaaaaataatggaggactggagtccgaacagaattttaatttatgttttcagtagtaataaagccttctctagattaataactgggaaagcactttgaaaagcatcaagcattatgcaaatgtgaggtattattcttttggaatttgcatagctgagagtggaattcacgtttgatgttctatgatgatgaaattacttcttggaaattggctctgaaacccagcctcagtcccagtgctgtttttctttttaactggtttaattttttttttgaacttttttatctcattgtagcttaccttggattgaaactggccacatgtaaaaccaagagcaaatggtagctccttccctacccccagcccccaataatccatctcaatgtgtttttatgctccgggaagcccgaagcacagtgtctgacatgcagaaagtgcttagtcgatgtcagccactataattaaccatctatcatctatgtaacctaaaagaaaataagtctttagtggtttaggtttatttttaatttcttactaatgtgcttattcatattaatctcatcaatagctatgctctgactgtggttctcaaagcggacacttttttacacttttgtttcagtctttgttgtgtctgagcctccagctcagtgcctgccatgtaggaacaccacaccattcagcagggcagctatgtgtttgctgtctattcttgggccatattaataacctggttcaaagatgcagagattaagataaatgtaccaagcagaagtggtaaacaggaagtgagagctgacttctatttgttattgcaaaaatatttattaacctgttaatgtgtgcccagtctggaggaggccctggtacaaggtcaggaagcaggagatctggagaaggtgcccaaggcaggggagacacagaggttctgggggtgagctggatgtctagagaggatactgcaggaggagcagaggcagcaggagagaggtcacggccctggctctggtgcttttgggtccatcccttgattcagtgcaaggggaaccacccttgggctttcaacccttctgttccgggtgagactctagtcagccactaagcaacagccaccagcttgaatgaggcaaggcccccttcctgcttcattgtcttgaaaggatatgtgtggaagagacaggggtgcttttcctccagtgagaggattcacaggcaaggaaagatggaggtgtagagacacttgcaggagaaactggcagggggagtggattaaacattgcagcacattagtctttgctttaagtgttacatgtgccatccagccaggtgagatggcagcagagaacctaaaccctgagaaggtgaaatcaaatgggctgggcgcggtggctcatgcctgtaatcccagcactttgggaggccaaggcagacagatcacttgaggtcagaagttcgagaccagcctggccaacatggtgaaactccatctctactaaaaatacaaaaattagctgggcatggcagcaggtgtctgtaatcccagctacttgggaggctgaggcaggagaatcgcttcaacctgggaggcacaggctgcagtgatctgagatcatgccacttccctccagcctgggtgacaaagaaagactctgtttcaaacaaaacaaaacaaaacaaaacagaaggatgggaggatggagggaatcatggtggacaggaggcaggactagactgcagctccagacaaagcagcatctggaagcttccatggtgaattttagctccagatcaactgcaagaataaatcagcaattctgaggggacccacagaccctctgaaggaagcggattgctcctgtagggcccagaagacaccccaaatactgtgagtgccccaactgcggaagtgggaaagggagaccctcctctcccaacacactcccccaatttgagtgggagaaatattcaatgaaatagatagcttaaagaaaaaacaatagaaaattcaggaaactttggacacacttttagaaatgtgaaatgctctggaaagtctcagcaatagaacaagtagaagaaggaaattcagagctcaaagacaaggtctttgaattaactgaatccaacaaagacaaagaaaaaaaataaaaaaatatgaacaaagcctccaagaagtctgggattatgttaaatgaccaaacctaagaataattggtgttcctgaggaagaagagaattctaaaagcttgcaaaacatatttgggggaataatcaaggaaaagttccccagtctagctagagacctagacatccaaatacaagaagcacaaagaacacgtgggaaattcatcgcaaaaagatctttgcctaggcacattgtcatcaggttatccagagttgagacaaaggaaagaatcttaagagttgtgagacagaagaaccaggtaacctataaaggaaaacctatcagatgaactgaagatttctcagctgaaaccctacaagctagaagggattggggccctgtcttccagcttctcaaacaaatcaattatcagccaagaatgttgtatccagtgaaactaagcatcatgtatgaaggaaagatacagtcgttttcagacaaacaaatgctgagagaattgccattactaggccaccactacaagaactggtaaaaggagctccaaatcttgaaacaaatcctggaaacacatcaaaacagaacctctttaaagcataaatcacacaggacccataaaacaaaaatacgagctaaaaagcaaaagcaaaaaacaacaacaacaaaaaaaaccaaagtacagaggcaacaaagagcccaatgaatgcaatggtacctcacatttcaatactaacactgaatgtaaatggcctaaatgctccacttaaaagatacagaactgcagaatggataagaactcaccaaccaactatctgctgccttcaggagactcacctaacacataaggactcacataaacttaaaggggtagaaaaaggcatttcatgcaaatggacaccaaaagcgagtagagcaacggtagctattctcatatcagacaaaacaaatcgtaaagcaacagcagttaaaagagacaaagaggggccgggcgtggtggctcatgcctgtaatctcagcactttggatcacaaggtcaggagttcgtgaccagtgtggccaacacagtgaaaccccgtctctactaaaaatacaaaaaaaaaaaaaaaaaaaaaaaaaattagaggggtgtggtggtaggtgcctgtagtcccagctacttgggaggctgaggcaggcgaatcacttaaatctgggaggtggaggttgcagtgagctgagattgcaccactgcactctagcctgtgtgacacagcaagactctttctcaaaaaaataaaaaaaagagagagacaaagagggacattatagaatggtaaaaggccttgtccaacagtaaaatatcacagtcttaaacatatatgcacctaaaactggagcttccaaatttacaaaacaattaaaataggcctaagaaatgtggtagacagcaacacaataatagtggcagatttcaatattccaccgacagcaccagacaggttagcaagacagaaagtcagcaaagaaacaatggatttaaactataccttggaacaaatggacctaacagatatatacagaacatttcatccaataaccgcagaatacacattctattcaacatcatatggaactttctccaagatcgaccatatgataggccataaaacaagcctcaataaatttaagaaaattgaaattgtatcaagcactctctcagaccacaacagaataaaactggaaatcatctccaaaaggaactttcaaaaccatgcaaacacatggaaattgttaaataacctgcttctgaatgagcattgggtaaaaaacaaaatcaagatggaaattaaaaaattcttctaactgaatgacaataatgacaaaacctatcaaaacctctgggatatagctaaggcagtgctaagaggaaagttcatagccctaaacacctacatcaaaaagtctgaaagagcacaaacggacaatctaaggtcacacctcaaggaactagagaaatagaaacaaactgaacccaaacccagtagaagaaaggaaataaccaagatcagagcagaactaaatgaaattgaaacacatacacacacacaaaataaaagataaattaaacaaaaaactggttctttgaaaagataaataaaattgatagaccattagcaagattaaccaagaaaggaagagagaaaacccaaataacgtcactgagaaatgcaacaggaggtattacaactgacaccactaaaatacaaaagatcattcaaggctactatgaacacctttacgcacataaactaaaaaacctagttgagatggataaattcctggaaaaatacaatcctcctagcttaaatcaggaagcattagataccctgaacagaccaatacaagcagtgagattgaaatggtaattaaaaaattaccaacaaaaaaaagtccaggaccataaggattcacagcagaatttaccagacattcaaagaagaattggtaccaatacttttgacactattccacaagacagagaaagaaggaaccctccctaactcattctatgaagccagtatcaccccaataccaaaactaggaaaggacacaaccaaaaaagaaaactacagaccaatatccttgatgaacatagatactaaaattctttttttttttttttttctgagacagagtcttgctctgtcgcccaggctggagtgcagtggcgcgatctcggctcactgcaagctctgcctcccgggttcatgccattctcctgcctcagcctccggagtagctggcactacaggtgcccgccaccacgctggctaattttttgtattttttttagtagagatggggtttcaccatgttagccaggattatcttgatctcctgacctcgtggtccacccacctcggcctcccaaagtgctgggatttcaggcgtgagccaacacgcctggccaatactaaaattcttaatgaaatactagctaaccaaatccaacaacatatcaaaaagataatccaccatgatcaagttggtttcataacagagatgaagggatggtttaacatacaaaagtcaataaatgtgatacgccacataaacaaaattaaaagcaaaaatcatgtgataatagatgcagaaaaagcatttgacaaaatctggcatccctttatgattaaaattcttagcaaagtcagcatacaagggacataccttaatgtaataaaagccatctatcacaaacccacagccaacctaatactgaatggggaaaagttgaaagcattccctctgagaattggaacaagacaaggatgtccactctcaccactcctcttcaacatagtactggaagtcctagccagagcaatcagacaagagaaagaaataaagggcatctgaattgctaaagaggaagtcaaactgtcactgtttgctgacaatacaatcgtttaccttgaaaaccctcaggcctcctccagaaagctcctagaactgataaaagaattcagtagtttccagatgcaagattaacatccacacatcagtagctctcctatacaccaacagtgaccaagcagagaatcaaatcaagaagtcaaccccttttacaatagctgcaaaaataaataaataaataaataaataaataaataaataaataaataaataaaatacttaggaacatacctaaccaaagagttgaaaagcctctacagggaaaactacaaaatgctgctgaaagaaatcatagatgacacaaacaaatggaaacacattccatgttcatggatgagtagaatcagtattgtgaaaatgatcatactgccaaaagcaatctacaaattcaatgcagtctgcatcaaaataccaccatcattcttcacagaattagaaaaaacaattctaaaattcatacagaactgaaaaagagcctgcatagctaaagcaagactaagcaaaaagaacaaatctggaggcctcacattaccttatttcaaactatactataagcccatcatcacccaaacagcatggtactggtataaaaataggcacatagaccaatggaaccaaatagagaaccacaaataaacccaaatacttagtcaactgatcttcaacaaagcaaacaaaaacataaagtgaggaaaggacacctttatcaacaaatggtactgggataattggctagccacatgtaggagaatgaaactggattctcatttctcactttattcaaaaatcaacccaagatgagttaaagacttaaacctaagacctgaaactatacaaattctaggtataacactgtaacaacccttctagacattggcttaggcaaggatttcatgaccaaaaacccgaaagcaaatgcaataaaaacaaagataaagagccgggacctaattaaactaaagagcttctgcatagcaaaaggaacagtcagcagagtaaacagacaacccagagtgggaagaaatcttcacaatctatacatctgaccaaggactcacattcagactctacaatgaactcaaacaaatcagtaagaaaaaaacaatcccatcaaaaagtgggctaagaacatgaatagacagttctcaaaagaagatatataaatgaccaacaaacatgaaaaaatgctcaacaacactaacgaccagggaaatgcaaatcaaaaccacaatgcaataccacattacttctgcaagaatggccataatcaaaaaataagaaaacagtagatgttggcgaggatgtggtgatcagggaacacttccaccctgctggtggggatgtaaactagtacagccactatggaaaacagtgtagggattccctaaagaaccaaaagtagaactacctaccatttgatccagcaattccgctactgggtatctacccaaaggaaaagaagtctttatttgaaaaagatacttgaatatgcatgttcatagcagcacaatccacaattgcaaaatcatggaaccaacccaaatgcccatcaatcaacaagtggataaagaaactgtggtatatgtatatgatggaatactatgcagccataaaaaggaacgacttaacagcatttgcagtgacctggatgagattggagactattattctaagtgaaataactcaggaatggaaaaccaaacaccgtatgttctcactgatacgtgggatctaagctatgaggatccaaaggcataagaatgatacaatggactttggggacttggagggaagtatgagaggtaggcaagggataaaagattgcaaatatggtgcagtgtgtactatttgggtgatgggtgcaccaaaatctcagaaatcaccactaaagaacttactcatgtaaccaaatgccacctgtgccccaacaacttatggaaaaataaaaaaacaaaaacaaaacaaaacaaaaaagcaaaaggcacaccaaggttgcttcttgtgctctcaaccagcctgtgagttctctaagggtgagggccaggtctcctatctcattacagttctggaatcttctgccaatggcagggatgctctgctagcatgtggttgaaggtggtaaagtcaagaagtccacaaccatcagccccgccccaggactcactgtgggtctcctgctccttcagcgggccccctgtcgctctctcccccacaaaccctaaggcctcctccagaaagctcctagaactgataaaagaattcagcagtttcttttatcctgggctggggtcagagcgacgctgtctgggtgctgtgaatggtcctttgttgctgcatgaggcctcctctttccttcaactccaagctcaggggtgcttcctcagggaagtgttttctgtttccaaaggcactgaggagccccctctcagcattgcttttatcccatctctgtccctcacaatgcctggcacatagttggtgcctaacaaatgctgactgaaggctaattccaacctctaagctctgcctggtgctttcttcctgtggttcttctcttggccttcacagttccatacagatctaaattctcttgcccatgtgacccactccctttcctgaaagcttgctgtgttttcagtttgtgtcaatttgccatgcactgttccagttgttgaagatggactgtttttgtatcctttcttatcctgtagagcagacaccatgccatgtacttaatgcacacttattaattattaggtgtatgcgtgaatttggaaaaaagacaaaaaaaatctttcatttaaaaagacactgttttaaactaggcacagtacactttgatcgttttcccgaaaccgcgttggacaccatttttccatgatgatcatttgatttaaaccgaccagtgtgtggctgagctctgtgaactggggcatcaggggatcagggctgcaccaccagggctggagatggagctggggatagagactgtattagctggaagtacatggagcacatgctaagacgattaacacacaagataacacattttaaaaactaattttttcccatataaaatggtttaaaattcttacttctggaggagatttgatggacaagaaatgagttgtacgagttgaacgttgctcgaggcaaccgtaagtcctagcgtatttaatctttcaagcaacacctaaggactggcagctgggttcctgtggggaggataaagattgctttattctttaagatccagtgtaaagaaatagcccagatagcaatagtggatttctttctgggatggggttgtgggtgatttcttttcccttcttttagtctttctgcatcttttgtatttctttaatgagtgtgaatatttagcaaaaaagagaaattttactaaaaagagtgggaaactgctcccttctagtggtgaaggggaaagcagtttcatgctttaggcgtgaggtttcaggactgtagtctaattatttcttccagtggagtagaatgtctgaaaggatttggagtaacagggctgatgaagcggcaaggaaggtgagtagctatctaggcaagtatgtgaacacagcctggaagggcttgtagtaccaagctgctcttaaagctcaggtaccaagacccagaggtacataatcaattcgacatcaaaaataggaattcaggctgggtgtggtggcttatgcccaaaatcccagggctttgggagggcaaagtgggaggatcacttgagcccaggagtttgagaccagcctgggcaacaaagagagaccctgcttctaccaaaaaaaaaaaaaaaaaaacaaatcaaaaattagccaggtgtggtggtgcgagtctgtaatctcagctacttgggaggctgaggtcggaggatctcttgagcccaggaggttgaggatacaatgagctgtgattgcaccactacactcgcactccagcctgggtgacagggcaagatcctgtctgtagtcccagctacttgggaggctgaggcaggagaatcacttgaacccgggaggcagaggttgcaatgagccgagatcacaccactgcactccagcctgggcaacaagagtgaaactctgtctcaaaaaaaaaaaaaaaaaagagatttcagatagagagtgagttagtgttctgatcaagtctcattctaagaccagtttaaattgaaatgtgattggtgattattaagatttaagactatcacagattattaagacttaagtttaccactatgcgtggaagttcctttcccagagagtttcttctacatgtaagaactggactctaattctagacccacatctactccagactatatttagaaggcaccattgggatggaatatgggagccaagatgagaaatctgaagaggaagaagccatgtaggtattccctggcacaatgggaggtgagctccggaaaaggcatcccgcctccagcatgtggggactgaagatcaatttgcccaccatttcccaacttcggttcctaaaagtgtttaggaaattaagtctaaatcaagcccttcttggagattcatagaatatcaaaggccctgaaaggttctttaataaagaaacctgttcagctttatttaacccagtgttttcgcagcgtctttgctaaagtactgctgcatatggccgtggtgggttgggcaactagacccgctgagatggtcccttgaaaacggcggtcggatgcattggtagctgcacaaccagtggaaatggaggggccacaaaacggaggaataagacattcaaattgcccctttgcaagctctgaggttccagggttgacgtattgtttccttcagggcacagaaaatatggagtctagcgaacagaagcagggcccatgcgtaggggtggtccaggtttacaccaaagaaaatgagtactactcacagctgtctggcaaggtggcaagagagcgcctcggaggtcgtgagtgtccctcaccatccataggaatgccacaaaagcccttgctgccaggcatgagcagctggtacagaaggccaccgagtgccttcccgatctggactccgtgacttctatgcccactggcgctcttgcatgggtcagtctgtgctgccgctcaggaaaagcaagtcaggtgccataccagcgacccaatggcggctgctgcttcttctgcctgggcacctcatcatccccagcagtagttcctaggtgtgagcgtggcaaggagcccagaaatacagaagcagcgtttaggggcctcacggtagcttcatgcctgactcttttctctcctcttccggcctggcctctaggcctttctggatcgccagccagtcagactctacttcgagaagcagaaggtcttgggctgggtcttgaaatgcagggaagaattgacttggcagaggagaggaaagagaaaatttcaggtggggaagtaccccaggcaaagacaacattagtgtttgtaacatttgctggaacaaaacattaggagtgtgaataatggacacagtttagaaatacattttaaaggcatggataattttcagtgcctccaagcatctagagagggatacatctatttcccttttttttttttttatctttttgtatttttgtctaggatatgatgggtacttcgatttaataactcagtgatgagcttggagataaaattgagcctgctgtgaaaactaggtctgtggcttccttgaggaccatttctacagaatattattttttttgttttctctctcttaaatggttatacacaatatccctatccttctcctcactttattgattttccagaatgagagtacgaggtatgactataaagtaacgtgactgattattttagcatacactccaatacttatacagccaaatgaattttatgaccttcggaggcattttcctgataggctaaacccttactgcagatatgccactatcagaaaacacattcttagcactttttgtgggaatggcacttggtgcttagatgtggtcctttgaaagccctcaacgcaacacatctttgtggagaatagattgattttttttaaaaaacagtccatattttggcaaatagatgattaaacagagtaatattatttgcaattttaaaaatgtgattataaaacaatacacagcttgcagaagaggtgtatgaaccagttctggaagcctgggaattttgctgaggggccacgctcactggcatacgagttggtttttggttttggttttgttttttaaagaaaacaatagcaacagtcttaatatttatggtcataccttctctcgtctagtaaggaattcaggcttctggtagcatctgttttgggggcagagatgaaagaagaatcttatttgttgtataaacaaagcaaaacatcagattgatgtgtgtccattactgagctgcgtgagtgggtgctcagcgatgccttcccgggaaggaagtgactctcccagaaataaaatgattgaatgaactcttcccctaaccctagtgccataataacaacaaacctaacaactatcgcttgccactgaagggaagtacgcggtctatgggaaccctggtagccttatatggacttgttttttggttgccggaataacatgcatctggacatgggaatgagactggcgagaaagggagggggcagatgttcacactggtattcattggtgcttcaattactaagagccacatctttcctggtttaccagaaataggtgctgttgcacaacttcctggtggatagggtaggggggtgttagctgataggggagttccctggagccctcgactctctctgttgctttcagcctcagccctcagtgcagagtttggccctggcccgcgctgtggggccctcctaaacctcccctatgtccttgcaaaggtgtgcttcttaggtttcgcttgagcagtcagccagttcctcaacacaatctcagaaagaggccggccccttttttcccctcgaagatatctagaaaaaactgtgtcagagatgatctgaaagcaaagccaagctctaccaatagtggcttccaccaatgccttgtttccctgagcactgcacacagaccccctgggagagccagcgccataccccgaaaccagcagctgcctccacattctgatctgaaaggtgccctaaagtcctcgcatgtgcttccctccttcctgcactgacatgcctgttccctccaagctgcacagcgcagtccctgttgcctgaatgctctcccttcttggtttaactgaactcctgcctaaccttcaaaatcttgtctaaatgtcactcttccataaaggtctcctccatcaggccagccctcaaccagccctgcctcctgtggacttgcttcctatctctctggctatctcggcacttactactttactttatttatttatttatttatttatttatttatttatttatttagagatggagtctcactctgtcatccaggctggagtgcagtggcatagtctcagctcactgcaacctccgcctcccgggttcaagtgattctcctgcctcagcctcctgagtagctggggctacaggtgcgtgccaccacacccagctaatttttgtatctttagtagaggtggggtttcatcatgttggccagtctggtctcgaactcctgacctcaggtgatccgcccacctcggcctcacaaagtgctgggattacaggcatgagccacagtgcccggcccactttattttatagcttatgcatgtgacctatcttcttggcttgactgtaagtccctaagaggagggcccacatcttaagccagtgagtgccctctacatagtagctgctcagtaaatgctaatgatcatgattatgcctctggtaaccgagatagcagcactgtttccaaatgattactgtgacaatgtgtgtgtgtgtgtgcatgcctgtgtatggaagagggtagaatcagtctccccctaattgcacactagtggtagtgtgttcttagcacctggcagaatgccttgcacaaggcttattgaaaagggaaataaatcttgattcatgcaatcgtcgaatgctgaaggttttctaggctgtgagctggttctacctcattggtgtgctatggataacattcccatgaattcagatagatagaggaattgccccatttgaaattgaagagcaagactgtaaaaggaggggatgatggaatgcaggacccagccacttagaatacgtggtacatgggggtatatagagcactcaaagtctgagtggggtatcctgacaccagactaggggacaggaggcatccaacccccagcagaggcattgaagaacagacactttctccttcactgttctattgagcacaaatccccacagtttgaagcaatggtatctcaactcttccctaccatccactgttgatgtgatttttccccatagatcctatgttctgttgtcccagcaacaatgtatatttaagtaatgattgattaattttcccattttaattattcaaaggcaagctaattggaaaactctgccagttgagaatagctgatcaatgagataaccagcattagtgtaccaaattataattccactccaaagcaaagaaactcgacattttccttaacctgcaccaccatcgcgttgtcaataaatgcacgatttacattaggctctttgaaatattgaaaatatctcatgtaccctcttcctaccttcacaaatcagtaggcacctgggaaccccaggctgtaaagcagtgaagagggagtgtagtcagttgtacatttaaggattttaactccatccgtacacagagagtgagcaaaattggtagcatcatctcatgatctaagagcgtacctaaggagataattgggaggttctcaggagaagtgtggcattgtggaaatcagccaggcctttacagtgtagggacagacacacctctttccctgggtgtccttgggccagccactccctccttgctcatttcctcattggtgagagagggctgggacacctgcctctcagcattggcacattttcccccagccccccaggctatgctgggaatcagcctcacatctttcttggctctcaccctaatgttaaccctccacagtctggccagtcttgactcccaagtgttcctctctctatctgctttgcttctgctgcagttgaggacttcaaaatcactccttggctggaaatagccttcccacgggtctccctgccttctatcttgtgctcccctaatttgtcctgcaactgcagccaccggctcactgctcctctgcataaaaccctttcctggtcctcctgtctaaggaagtgagtgttcctggcctggctcctgaagccccctctgacctggtcccctgcccctctgcaggtttaactcccctcgcttctcacctggtgcctggctcccaggtgctcacagctcctcccacacaccatgcagttcagtgccaatttctttccttctacttgcatgtccttcccccttcatttgggtgagaacttctccaggagcctcttctgcatctcctaggttcttgccccaatgtacctggtaccttccctctctctcatcacttacctggctccccaagggcaggattggtccttcctcatctttagctgagcactcagcattgtgccaggggcactcaacacacttctgttgagtaataggcacgcagttacttgttgaaccaaactgcgttagaagagatgatctataggattttgtgtggcatatgcattgttctttgccgctatgggtatcatcatagagaatttccattaatttctggccgtgtgccactgcaaccagctttcaccctgacttgtcatataacaaaatatcattaaattgaactctagtttttttttttttttttttagacagggtcttactctgttgcccaggctggagtacagtggcacaatcacagctcactgcagcctcaacctccccaggctcggggaattctcccaccccagccccatgagtagctgggactacaagcgagcactaccaccccaggctattttttgtatttttttgtagagacggggtttctccatgttgcccaggctgggaactctggatcttaataaaatatttttttctttagaagtcaggctaggctgggctgtgggttgaagttcatctctgtgctatttatgaaggaagggattgctaaccaaaatcattgtgcaaaggtgacagctcaaccaatttaggaaaataaactactcccgagcacttcggcagcttgctagtttatcaacgatcccttgaaaacgcactaaaaacacttcactctttctgcctttccacactttctataatggcccagggcttaggctttggaatcagatctcctggattcaaactctggctagccttgtgaccttaagcaatagatgtcaggtctccgtgtctcagtttccccatgtgtaaaatagggatactaatagtacctacctcttagcatgttgggaggattacatgagtaagaacataaggtggacttagagcagtgcatggcacagctcagggtcaataaacattagctcttagtgttatctgataactgcacgcttatattcaacaaaaactgcatagacgctgggcagctagatcttggtttttattttgtttatctagttattttgtaaacctcattctgaattctcacctgatccccaggaatgcactgcagtgaaaagtgaggagaggcgtacttcaaacaagtgacctcattttgaataatcctggacttataccactaggtagcttttgaccttgaacaagtaaaattaggttttaaaaatgcgtatcagacttagtaagctgaagtgtcttcgggggtgttggggatggtcaccaatggtgtggtggggacagagccatagtgcggcaggtttagaaatgatggggaaggagggcagatgaaaagaagactgtgggcttttctttgaagaaggtcagagatgtcagccacctctctgggcttgatcacttttccatacggtcaagcggagatagtcattctctccctgtctccttgaaagggagtatgagggtttgtgagcaataacccttacaccaacatatattgctattagtccattgatggcatctgtttacctctcagttgtaggtgcttcaaaattaaagaaaatctatttcttgaaaagtgcacaataaatcaagctttaaactcaatttgttttccagaaatttttcaaattttcccatgacaaaatttacatttattttctgattttaacagtaagagtaccattctaattttcatctggtctttgcttcattggttgacatttgccttgcccttggacttgagaacttgaagtatcaatgaggcatagcacatcagtaaataagccccgctaagccatactctattctcgcctgttgaccagatcttttgtttcctgctcactctcatccaagcccttacccacatcattttcaatgatggtgtcactgcaaatgtttctttgcaggttcaattctctcctatcataaaacaaacaactgagccagccaactaaccaaccaaccaaccaaccaaccaatcaaccaaccaactcactaaccgcctcttctttgactccaccccaggcaccactccacttatccttctcttcccagcctagtgacttgaaagaggactttgtatttgctcactttctcacctcctatttacccccgacccctgcaataaggtctctgttccattctctactgaaacggctttcttcaaggccaccattaagtctctagtacctaaactgaattaacagtttctaatccttctctttctttggcactttgcaatatttgttgtttgtttgtttgtttgttttgaaataggatcttgctctgtcacccatgctgaagtgcagtggtgcaatcatagctcactgcagcctcaaacttctgacctcaagtgatcctttcacctcagcctctcaagtagctagaactatagacatgtgccaccatgcccagttaatttttaaattttttgtagagtgaggtcttgctatatttcccaggctggtctcaagctcttggcctcaagtgaccctcctacctcagcctcccaagtagctgggactataggtgcatgcaaccatccctggctaattttatgttttacttatttatttatttatttatttgtaaagacaggattttgctatgttgcccaggctggtcttaaacgcctgaggtcaaatgatcctcccacctcggccttccaaagtactgggattacaggcatgagccaccatgcctggccgctttgcaacatttgattctgttaattttgggtatatgtcaaagctgtcagttacgtaggggtagaaaaaaagttgtgcatcattgattataatgccagggccccattttacagatgtgaatatggaggtccagagaagttatgtgatctgatgtgtattagtcagctactgttgcaataatgctgtgtaacaaaccaccccaagctcattggcaaatgacaatgtttatttttctcatggtctgtatgttcactggagtagctctgttccagtctgacagtggggtttagatctgctccacatgtttgtaatgggacccaggctgaagagaatattagggaagtgctgctcctgacaggtcacagggatgcaagaaatgtaaaatgaaacagtaatatctcttgaggcctcaacctggaagctgctaagataatttctgcccacattctattggctaagcaatccacatgcccaaggttaacattaatggggcagggaagaagactctgtccactgtagcgggaggcactgcacagtcatggagcaaggggcattgatgtagaattttgatacagatggggcatgaagcatcaggagcagtgattcactctacctcatgctccaagattacacagctggattctgatctttggcaaaatagaatctaggggccacaagtcacaagacaaaataaaaccataacaaaaaaataaataaatgaacaaaaacttaacgtgaatggacatattaacttttattgtaagtgaaaacagtgactctctgggggaaaaaaaacaacaggccaggcatgatggcttacacctataattcttttgggaggctcactttgggaggctgaggtaggaggatcacttgagcacaggaattctcgagaccagcctgggcaatataggaagtctccgtctctacagaaaatacaacaattagccaggtgcggtgacatgcatctgtggtcccagctactcaagaggctggggtgagaggatcagttgagcccaggatgtggatgttgtagtgagccaagatcgcaccactgcacttccaacagcaaagaccctgttcccccaaaaaaaacacaaaaaacaaaaaacaacaaaaaaaaaacaacccaccaaaaaacagaaacaacagatagtgatgcagaattttcccactgagacactgacatggtgggtcatggtgatcttgcttatgaagtgataacctagcttcaagagtgttgaagcagggtccagagctcagtgtaggggccaggttggtcctgggccgaacctggggacgtacctaggaatttctagccaaataagcaatagagggaagggtctgactgatgacggagcatgagcacactctaggaagggcaaagaattgatctgggggatgggatggggcggggccctaagatttcaactccaccctggaaaagcaggacttaggggaggcatgtctgaagttcagaagaccaggggaaacctgaatgcagaaagcgcagcttgttcaccatgtcctgaaatacagcaaccaggggacactcttgtagattgtgagctgtattgcttaggacaaattcattgttctatgctgggcagtaaatttatggatgttgttatgccaagaaaggaatatggctgaaaacataaattgctccagaattgttttaaatattctcatgggtgctggaagtcctctgggttattaaggaaaaaatttgtttatttcttgcccttccggaaaccaccctttggtgctggctagtggctgtcagaagaaagggtgtatccatgtatcacaagggctattacacatcgtgaatttaacttgagttctcaaagataaaaagagacacttgtcttgcctccacgctccttctcgtcctgcacatttgtccactcacctccagtaagttgctctggaatctgaacagggaggtttcttgcaatccagaatcagccacaaaatcccatttccttttttcctataaaaaagatgtgctgactgaaacaactaaaatatagactagttagtgtaataacaataagtagcaaaaacaaaatagaaaaacaaagcacaacatgaaaaaagaagtttttgaattagtgtcttctttcatcaaggtcagtttctctccatctcacatcctctgtgaccctagggtggtgtggaagatccttccccacccacacccacacatggggtattatttgggccttttccagggacttctgtcagttctgatggtctttgcactgggctgagtagtgtcccctcgcccccaaattcatgtccattaaaacctctgaatgtgacctgatttggaaatagggtctttacagcggtaatcaagttaagatgaggtcctactggatgacggtggtccctaatccagtgactggcatccttataagaagagtgaaatttggatgctgagatggacagagggaggacgacatgtagatatagtcacacaggcgagaacactgtgatgaccaaggcggagattagagggatgcatctacaagccaaagaccatggattgccagcaactaccaggagatggacagaggcaaggaaggagctcccttcgtgtcttcagagggagcatggccctgctgatgtcttgacctcagaattctgaactccagaatgatgagaggataatttctgttgttttaagccacccggtttgtggcaatttgttagagaagccctgggtaactagtctggtctccttgctcccgttggtcttactgagccaaagcatcccattggccttactgagccaaagcatcccattgcatcatgtttgttactgtaaccctcaaatctttttcttgacctaactcttagcaagtttagccactggcctttgatcatctcttagctgcaataatcttcacttgacagacaagccagaggcctggctggaggctcaggcccttcattcagacagctcaggaggcctggactgtggctgggccagttcctgtggccgggctctaagtctcagtttccccatctgtataatgcacacaacagggatgttggtagagattacaggacatgatgtttataaagtgtgtttataattttattttgtgggtcagtacaatgcctgacccatagcaagtgcttaataataaatgttagctattattaaacatacagttttctgaaatctttaaatccatttttatccaccccagggtgaagtttccctgatttttcttttccagtaaaagcatggcagatcctatctactctcttagtgatgcacaatgacatctgggctagtgcctgacacagagtaggcactaaatatatttttatggaataaagaatggaacaactacattgtttcaatatctaatcaaaggaggaaatagcttacagattttatgaggcttagtaaccagcttgatacactcaaggtgaaactttggaaaaggatgtaatttcaccacatttgttcacaatagggcacaggtgatgtggtagacagcctccaagagggccctctggatccttgccctggaattcacacccttgcatagctccctcccccattgtaccagggtcagttagcatgaccagtggaatacagcagaggtgatggtgttatcacttccaagattagattattggagactggggtttccatcttgggctcgctctctcccttggattgcttactttggggaagtcagcagccatgttgagcagccctatagggagaggctcatatggcaaagccagctacagctccataagcaagcatggacaccattctccagcttgaccctgaacccaaagcacctagctgatctgctcgcagactcctgaccctcagaatctgtgagataatgaatgtttgttgtcttcagtcacttaggtctgggggcaatttgtgacacagcagtagataactaatataggtgctgagataggaatggctgggaccaggcagggtcaggactgaggactctaataatggaagggattataagttgcagggagcaggcaagaggccaaacccagaaaagtggtctgttcggaaggtcaggcaggttctgtgggtctccacctgtggctgtgttccagaacccagagaggtgagagccagaagcaaacacactgaggaacaacgggcactgagattcagggctcttggactagaactcttgccttttgactttgtcctgtacaatttccagctagacccacaattgatcattatagctaagagatgatcaaaggtcagtggctaaacttgctaagaattaggtcaagacaaagatctgggggattacaggaacaaacatgatgcaaggggattataaatatttttttgaaactcttaacaatattcttttgttactttgagttacccaagctctttaaactgtctgccaagctcaaaggcaaaattggtatttcccaggccttttggacgggtcatagtgcaatagaaaggtggaaatattggctgggtttatgaagacataacttcttatccaattggcaaacattttttaaatgcctactcggctgggtacaaaagaacctagaattattctgagcacccactaccagtactcaatgcccctgtgtaccaaccttggctactccaatacacacacacacacacacacacacacacacacacacacacacacacacacacagttggccaaagaagcaacctgtctgctctgcacaagccaggtcttcactttactgaagccccagctgacccctctgggctcaaactttactgaagtgaagacctggtctgtgcagaggagataatgacagatttatctgtccttatttcaagtcttgaagccctgttgacttagtggctaatctgatcaactgatttgaaccctggggatagcgtcctgtaagatggcatctgccttttcacaggggactcagagccctcaacccacagacttgaacaaacaggggcttttcgcatcccccgtcttacagataggttggattctgggcaactggctgctctgcaaatgtaaagtgagaaacagtagggcctggtaatggtgagcacagactccagagccagacagcctgggttcgaatctcagctgtgctactcactagcagtgtgaccttgggccagttacttaatctctctgagcctcagtgttcccatctgcaaaacggagataataataacagcatgttccacacagaatttggggaggagtaaatgagctcatgtgtgggaagcactcagccgggctcctggctcacaggaagcatcctgtaactgtttccttttattacgcaggatccagaggcaggggcagccccagctgacccctctgggctctaatttaactatctgttggggttcaccggaggcagatgtccctctttcaccacaagtctcaggggttctttaaggacttcataaaaacaaaggattaactgcagatgactaagcccacatgatggaaacagaatcaggtacagtaaataatgaacgtagacaggattagattcctacaaacaatacattgtgttctcctgctcttcattggcaatcatccccagtagggaatcagtggaactctttgagtggccaaggaaaacatctccatgtgcccaggatagcctgggtgggctcctggaggaggcaacccttgagcagaaagccgaagagcaatctggcctttgcaaatggagaaagagtggatgcatcagcagagaggagagtgggctgggacaagggtgagagaaggaagcaagcacctaggcccaaaatttaagaaggccctcactctcagggttgtacaagagcaggggtggcacttgtacagccctgagagtgaggacctccttaaattttgtaccctaggtttgttcttgcctctcctttgtcttggccctagagaaaagcctgggaaaaagcccagaacggtgaaacgacatggcgtaactaggaacgtgtgagtcatgcaagattgcccaagcctaatttagggacagagatgacttacagtgaggctagcagtcaagctgtggccggatcaccaaagaccctaggtgccaaataaaggaggttagtgcttgaactgaaagtgacagggagccaaggaagaattctgagcagggctgcaacatgatgagatttgcatatgagcaagcttcttctggcattggtgtggaggactgattggaggatgataggagaagctagaggctgggaggccagttcaggaccctactgaaaactctatgcccaagggagagacgacgacctgatatagggcagtgccagttaggagtaagaatgaagaactcactcaagacatgtgttgaaggcagagttgacagaacttggtgattgactgcagatgaggatcaaaggaaagacccaaagatagcatgaagtttcaaagatggtcatcaatttagaagccaagggggtttattagacaagataacaagcatgtgaaggcagtgatttcagcttccccaagtccaaggtaaacccttagttctcctgttttctgtaggataagctctctggaggctaggatgtatcttattcatttttgtatgatatctactctgtaagtatctttgaactgcattaagtggctttcacacctccgcatcctgctcattggctttcaagtggccttaggggtgttactattgtttgaatgtttgtctcctccaaaaatcatgttgaaatttaatccccgatgtggtagtgttgagaggtgaggcctgtaagaggtgactgggtcatgagggcaaagctatcataaatggactctgtgcagagtccccaccagcaagaaggccctcaccagatgcaactccttaaccttggacttctcagcttccataactgtaagaaataaattctttttctttataaattatctaggttcaggtattgtgttataagcaacagaaaacaaactaagacaggtatcaaagtccttttaaagatggctgtgtagctgggatcagaccaacacagcaatgtgttcaaactcccattctaaacacacagaacctggggctctgacttggccccacggtcttgagttgaagcctgaagtgtgactggatgtcaggcgtgggctgccctggggctttgggaagtagtgaaagggataaggtgaaggtcaagcagagtgggggatgtcaggaggctggggaggcttgggctgccaggtgaagtgggcctcatgaaagacaatttgagatcagaatgtcagacagagagcaggctagaaggcagctggcttctgagctgcagcctagaaaggctgattcagcagtgctaggaggaagtgggaggttttgtcgtcccagaagccatatctggagcaaggggaagtactaagaccacagggtagcatttggagccatacactgggactaacttcctctgacctaggcaacgacagactgcccctgtggtcaaccagagcccccagatccttttctgtgagctacaatgaagccaggcctcattcttcttgaacttgagaagtttagaaaatatctgctttgccttcactagcctccattttcataaaaataaagcgagtgaaaaaagcaagtctgagcgctttgaaacattaattaaagacaccacagtttccttatttaactgagggttgctacctcatctgggattattagcaaagcagagagcctttgttgtgctcgacaaagtgattaattcagactcgaggtgaattttggctttctcaacttcttttgatgtgctaagatcccccaatgaggacaacgtcatcaattacttaagccattaccttgagatcacaattatcggggaggcccagtctactaattggcagacagagagacagaaatggactacagggttgtggcttcaacccttaattgttctagggggagcgagagtcctttaaaatgttttgtggcaatgctcctgctaatctggggtgatcgagttgtttttccaccaggcaaaatgcagcctgggtgacctgcgtctctagaaccaagaaactgcctgtgattccactgacttggcgttctcatgggccaggacacagaactcagaactgagggatgagtgtgtcaatggaagagggatgaggttcataaaattggaaaggagagctttatttctcataaagggttgcggccttcgggtggccattccgacaggctaggaagatattttgatggaggggaaaagggaatgggaatttatgcagagcagggaggccaaatatacatattcaataagctatgggaggagtcatgaatatttatgaaaggagaaacatgtgcatgcgcaattgagcgtcatgcgccttcatgggtcccatgtagaaaaaatggcagccttagcataatctgagggtggagttttcgagcctctgacttcaaaaagtgaagcaaaggacaggaaaaccctcactgagcatcctccatacaatggccagaatcactccataatcggtggtctcgtatcaggcaaaagaaaggggcagcatcaggtggcaggttgatgtcagcggtggaggcttttaacatcagacgctttcagggcgttatggcgtcaacaccaatggaggctttgaaaaggccgctttctatttagcccttaggggagaaagcataatcatggctagtgagggaggggtagaaggagtgtgtctgactccccatcccatcatggccaagaactcagttttcaagtttactctggggaccccttggccaagagatggtccattcagtcagttgggggcttaggattttatttttagtttacaagttctagaagcaaacatcctactcaagaggcaaattctccagcccctggaagctgtctttgggcttccgtgggatgctacatctgggcttactgtcccctgacacataaggaattcaaggaccagatacaagaggctgctttttacattttaaaatatataatcatataatattctgtttaaatagatttatctttgttcatttaactaagccattactctttttttttctctccatcctataaaagagtttttgggggaaggttttatgctgcatggatatatgtcattggtttttctggtgaaaggtggaggaactttgtctggttaaatttagtcaaataaccaatacttaaacaaacaaaagccacccctgaagtgtttcataaatatcagtcacttcaagagttttatgatgtacgtcagttgctttgttctgttttcacaatagaaacacacgttgtgtgtgttttcggatggtggcactactgtttgctgtaccttcatcattcttctttaattctcactgggacagaagggcaagacactttcccagggtcagaatcctgggattggctggctggattttcttttcttcttaatttttttttttttttttaagagacagggtctctctctgtcacccaagctggagtgcagtggcttgatcatagcttactgcagcctctaattcctgggctcaagtgatcctcctgcctcagcctcccaagtaggtgggtctacaggcacacaccaccacacctggcaatttttaaaaattttttttgtagaggtggggtcttgctatgttgcccaggctggtctcgaactcttggcctcaagcaattctcctgccttggccccccaaaacactgggattatgggtgtgagctaccacgcctggccttgggctgaattttcttgggggtgggatgggcattttaaagcactcttgagaaagtagaacacactccattttaaggcagtttctttgcagtgcttcttcgtacacatcaaccctatgctcactctgccccatggcctccaggtgacccatctgttccaaggcagcagcctttccagtgccttcacctgctatggtgccacaacatggctctcgtttattgtgccagctttgacacctctgttctcagtttaatgatttttctggggatgggtccttcttggagggtcctgctttgtttttgtttttttccagattaactttgggggacataataagtggagaccatttatcgttttttaaggctcaacaaatatccaatagtcagacagaagagtgatcaaaatagaaagcatgtatttaaactgggactgacaggtgacaggggatgcctcttagccacaatgatcataatgtaaatgcttaattaactgtttgtcagtagccattgaatgtctgtctggtccactaggctgtaagtgccacagagcaagggcatgtaggcatggtccctgcagcatcctggtacccggaactcagcactcccccagcaccatgcttggtatctgctctctggccatggttttgaactatcagctgagcccaagcaaccttgcagaccacattttgattatgtcttcctcggaccatccttgagagtcacgtcttcttggcagtgtcccatagactgtgaatggtgagtgagatcactttagaaggtacacggactttaaaaatctttcattataaagcatttatttattttttaatttttaattttaattttttattttgagaaggagttttgctctcgttgcccaggctggagtgcaatggcgtgatcttggctcaccacaacctccccctcctgggttcaagtgactcacctgcctcagcctcctgagtagctgggattacaggcatgcgccagaattaaccatgcccggttaattttgtatttttaatagaggtggagtttctccatgttggtcaggctggtctcaaactcccaacctcaggtgatccgcctgcctctgcctcccaaagtgctgggattacaggcgtgagccaccgtgcccggcccaaagcattcattttttatcgttagttttttttttttttttttttgagacggagtctcactctgtcaccccaggctggctggagtgcagtggcatgatctctgttcactgcaagctccgcctcccgggttcacaccattcttctgccttagcctcccaagtagctgggactacaggcgcccaccaacacacctggctaattttttgtatttttagtagagacagggtttcactgtgttagccaggatggtctcaatcttcttacctcgtgatccgcccacctcagcctcctaaagtgctgggattacaggcataagccaccgtgcctggcctatcattagtttttaatttatgtaagtgatactgattttcacttatgatcacgacataaaatttccttttaaaatgaattcatttcaatttatctaaaagaaattgggaaataagtaaatgtacaggcaacttgcagatatggccaaaattataaaggggctatacaaataactgaatttagaagattaaggccttaatactcgttgagacttactgactcaactggctttcttgccctgaaaagttaggataaaaatggagaagttagttaactctctgaattacaataaccatcaactagatacctttttaaaagaattgtaatactttctttataaaacgttatctttggccaggcatggtggctcacacctgtaatcccagcactttgggaggccgaggtgggtggatcacttgaggttaggagttcgagaccagcctggccaacatggtaaaaccctacctctactaaaaatacaaaaattagctgagcacaatagtgcacgcctgtagtcctagctatccgggaggctgaggcatgaggcttgaacctgggaggtggaggttgcagtgaactgagattgtgccactgcactccagcctggacaacagaggaagactctgtctcaaaaacaacaacaacaaaactaaagaatatgtattcttggctgtttcagtggtagggctaccaaagcctggttcagtgctgcccaaggcagaggctgggtactgggtgagctctcggctggccttcccccaccccaccccctgcaactgtaccatgtactgttcagttctgtagaaacaggaagctcagggtaactcacagtccccaccccagacacttcttcttttcaggcacacttcaaaataaaatcaggatctacatacactataagttggcgtggtagctgaatattggccccctaaaatgtcgatgtcctagcctctggaacttgtgaatgcaaccttagatggcagaactgattttgaagatgtgattaagttgaagatcatgaaaggggttaagtattctggattgtttgggtgggccctaaatgtaatcatgaggtccttataaaaaggacacaggagttgtcagagcgagagaaggcagtgtgaggactggaagcagaactggaaggttatgaccatgacccagggagacaagaaggggacaccccctgccatctccagaaggaaccagccctgtggacaccctgcctgtaaaccagtgaggttgattttggacttctggcctccagagctgtcagagaataaatttgtgttgttttaaatccctcagcttgtggctacttgttataacaaaaatagaaaattaatacagttgggaaatataagtttacctaaaaatattccttcgcagccgggggcggtggctcatgcctgtaatcccggcactttgggaggctgaggtgggcggatcacctgaggtcaggagttcgagaccagcctggttaatatggtgaaaccccgtctctactaaaaacacaaaaaatagctgggcgtggtggcacatgcctgtaatcccagctacttgggaggctgaggcaggagaattgcttgagcccgggaggcgaaggttgcagtgagctgagatcatgccattgtactccagcctgggcaacaagagtgaaactctgtctcaaaaaaaaaaaaaaaaattcttcacttctgacaggattctgcatttgatctattatgtaagacacttactatacatatagacagggtctcgctctgttgcccaggctggagtgcagtggtgcgatcatagctcactgtaaccttgaactccagggctcaagcagtcctcctgcctcagtctcccaagtagttagtactacaggcatgcaccaccacacctggctaatttttttttctttttagaattttttttttttttttttggatctcactttgttgcccaggctggtctgaactcctgacctcaagtgatccttgacctcctttgccttggcctcccaaagtgctaggattacaggagcgagccactgtgcctggcctgtttaaaataattctaatggcaaaggattcaattaacaagtctcaaaatggatgtaagttttgcacaggtattcacatggctgaagtaccaaacatggtatcatgaattaagtgcgtaacatctgacaacggtaacacatgctatttttgtattattgtgaactcatggattcaaaatatatttgatgtgttttggtccattgcaattattattttatggagcaaattgtccatgtatcagtcttgctggcctgaagtcaaggtgtcaggcaggctggttccttctgggggatccaggggaatattggtttcttgcctccttggttcacggttgctttactttaatctctgcttccaggcatcacgttgcccaaagtaaatgaggtggggatgtataatcctccaactgggagggacagtcatgtcttaacccattatgcaatctactgtgtctcaagtgtttctgacttgagaagttggtggattgtggttgcaatggtgatgtagagatgattgggagacaacagatttagtgggtaaattaaaatcagatttagattaactgtaaaatgcctaacagacattcaaagcatccatcaagttggaagttgggtaaggaggactggagctcagtggagaaaatggaactagagttaaagatgtggaattattgacttttagatggtattgaagtgatgggactcaacataaggaaaggagccagcaaagacagtgaggagcaatctttgaggcaggaggagtggtatcatggaaagagggaagagagtgcttcaggaaggaggaatgttcatctctatcaaaatcctactgaaggatcagtaaagaaataatgggattgataagatcaaagtcatcaatgatcttgacaagggcagccccaaggaagctgtgggtacagaagcttagttggagtggggggaggagagactaagggcacagaaggggaggaagccatctagacaatgctttcaaggaaacttactgggaaggaatgaagaaaaataaggcaatggccaaatccaaggagtttgccttttttcctttaagatggaagacactggaatatgtatgctgataggaatgatccagtagaaatggagaaatcaatgcaacaggaaggaacaataattgagaataatgagtaaggacaaggagcaaaactaacaagattggctttagataggtaaagaatccctctgtctctctctttctcatcacaatcatcagttcattagtatatgttattaatacacttttggtttctaagcagcctgcctttgttctcagcatattgtctacatgttctcatgttgtgctttatccacaaagtcttagcctaggggacagaaagggacagtaagtagggttagtgaataacggcacttgtctgaaatgtagctgacctggttttaactctgactcaattgcttagcagcaccttgggtacattatttacctctctaagcttttatttcctaatcagtaatataagaatggtatttatttctatccttatgtgattgttggagggcttgtacaagacagtatataaaaagtactaagcatagtgcctgagacacaggaaactaaaaactattgtaaattataataatagtaatgattgtgtaactcttgtatgtcaatatacatgtataatatatttttcttgtgcagtgacaaagttattgtcaggctaatgactgcaatgactatgtctttgtggtacctacattattggtgaaagaactgaacaccagccagatatttatgtatttattgagtagtcttctattttttttccagaggggtaaagattataagcggttccttaggcaacaaattataatggctgtcattcactaaatcttgtatatagggtgggacagaattgaaaaaacaataggaaggtcttgtaactccaacatatctgttctcctgaggtttgcatgtgtacatcttatagcacattgatattcagaagtttcctattggaatgcaactatcagacaataaaaccactacattaaaaatgtacagaatgcagataaagaactacttagaggaagatttatagctttaaatgcgttcattgaaaacatgtgaactaaactaataacttaagaagttaaaagaaaacaacaaggaacaaagtctcaacccaaagaaaatagaaggaagtccataatcaaaatatgagcataaatcaatgaactagaaaacaacaaaaatcagaaatgatcaacaaagaaaaagttggtgctttcaaaagataaataaaatagataaacccatagcacgactaatcaagaacaacttttccaggcaagctaggagtagaaggaaatatcttcaacccaataaaggatatctatgaaaactctaaagcaaaacctcacacttaattttgaaacattagctgcattcctgcagaatcaagaacaagaaaaggatgcttactctttctgcttcctttttgtactagagattttagccaatgtaataagaaaagaaaatgagaagtcagacaaaaggattaaaaagaaagagaatggactgatattatttgcataaaacataattatcagcataggaaatcaaagaaattccacatgtaaaccaataaaactaattagaaagtccagaaggatcattgattacaacgctggcattaaaaaaaaaaaaaggtgctcctatacatgagcaacaccaaaacaaatgtacgtaaatagcaaaaagatactcttctctgcacaaaatcataaaatgttactgaaggacagagaaaataaaatcaacagagagatacaacacattcatatatgagacaaattgatgttgtaataatgttggtatgttctaaattaatgtatacatttaatgcaattccagaaaaatccaaatagcattttctcatcaaatcagactaattctaaaattaatatgaaaaagtaagttataaaaatgtattatatggtaaaaggaatttgagtaagaaaaaaagacaaaaaagagaataaaaagaagtaatatataaaaaagagaaaaaaacaaagagtgtgatttagagttataataattaaaatagtgaagcataagctagacaaatggatcagaatagatccaagcacctatactactgaggagcatgatagaagtgacattatgaatcagtgggaaaaagggagcagtgcagcaggcacaacatccctttgctaaccccttggagggatgtaatcagctgtgggacaggattattttaccagggtcccactgagataccgattctgttgagccacctctcattgtagaatctggctcaacacaccctctgatgattgatttggcttctcaagtacctggaaaggaggtactctaggaaggagatgtccgattcttattgcttggaaaaaaaatactcactattataaatttgtaaatgaacagtctcgtttgcaggttgtattttagggcatagcctagttactactgatacgtgagtgagtgtgcatcagatgatttccagccctgagggcaaactgagattgaggtcttaagggaatggagagggggctgaacatgaggatgaggatgccagggtggacactaggtgctaaaagggaaaccgagaagatctcacgtgtaaaatctgtattgcaccatttccccaccaacccttcaggaacatctgccttgaggcgtgatttaagcagtttcaatccttacagtttctcttgtgggtgtgggtgagaaatgggacaaggataaagggaatggaatttacagtcaactaacaaggctgtggttagttattagctaagtcaatgaaaactattcagatttatctgcttatcttcctcttcacacccagatatgtgcgtggagtcagcttgcagtacctatcaatgactgctcattttccaactaatttttaaatcagttagtggagcacaattctgcctgccacctagataaaccatactgtgggaatgagggggagggaggaagaagaaggaggaggaggaggaggaagaggaggaggaggaagaggaggaggaggaagaggaggaggaggaagaggaggaggaggaagaggaggaggaggaagaggaggaggaggaagaggaggaggaggaggaagaggaggaggaggaggaagaggaggaggaggaagaggaggaggaagggagggagggaaggaagaaggaagggaggaaggaaggaaggaaagaaggaaggaagggagggagggagggaggggggaaaggaagaaggaaggagggagggaggaaggaaggagggagggagggaaggaggaaggagggagggaggaaggaaggaaagagggagggaaggaagggaagaagggaagaaagttagttaataatgtcaaaaattgggaaatatttttgagaatgaagaagaaatgataggaaaatgtgttttctctctctagtaagaaaatagatgcagacatcaaaatacattgatgtagcttacaaattagaaaaaagttttatgagagcatttggtgcaaaggatataccaacggtaggactagctgggacaaactttatggaaagcaattagatattacataccagtgtttaaaaccagtgactcatggatctcaggttaagaaaatcttcatgcacaaagtgtgggaaaacctctgcgcagaaatgctaactgtagcagcataactcaaagtagctaaaatatagaaaacacgctaagtatttgacaataagaatggtttagtaaattataatatgtatataagagcactattaagcagccataaaaatgatatttataaaggattaataacatggagatgtttttccttatgttaaatgaaaaaagtagaaatctggataaatagaagtagagaaataagccaggcacagtggctcttgcctgtaatcatggcactttgggaggctgaggcaggcagatcgcttgagcccaggagtttgagaccagcctgggcaacatagtgagaccctgtttctaaaaaaaaaaaaaaaaaaaattagccacctgtggttgcgcacacctgtagtcccagctacttcggaggctgaggtgagaggatcacttgagcctgagaggtagaggctacggtgagctgaaatcacaccactgcactccagcttgggcaacagagtgagaatgctaaaaaaaagaaaaagaagaaaaagtagagacataggaaaaatatagagagagaatgtaatagcaaacatataaaaaatacacagtgaaaaaaaccaagagaatgacaatataaagagagtaggctttctccctgatagttctagcttttgtgcccaaatttctgtgaagcacttcaaaatgtgtcttggaaagccagcaaacctcacaccctgcttccatttcttaacaaaacgttttgaaaaggcaattatttaaggatctgtttctaataaagcttccgatgtggccatgatgtttaatggaattgctggcaaagcccatgagggcatgcgtgttgaaaccatagagtaaccatggcaaagggcctctcttctccaatgtgcaggacactgggttacctggcaccgctgggcttcacctgttcttggagcatcacaagtttttacccctggagaagcgctatttgccaagggaatctttcaccatttcaaatacatccactgaagtttttgaaagcagtgcaccaagtaggaattctttggtagtgacagtgaggatgtaatgaccgagcggaggggccggctggacccttctcctgcacaccacaggagaagccaattcctggaggtagataatttctgttttcttttgttccaaacctcagtcagtttgaccatctccttaatatgtgattcatcaaaataccaatttatcagaagtggcttctttggctaaacaatgggctaagcacccatgttgaatccatcaagagaaggttttaggctgggcacggtggttcacacactttggaatccccacactttggaaggccaaggcaggcggatcgcctgaggtcaggagttcaagaccagcctggccaacagggtgaaaccccgtctctactaaaatacaaaaattagcctggcgtggtgggcgcctgtaatcctggctactcaggaggctgaggcaggagaatcgcttgagcccaggaagaggaggttgcagtgaactgagattgtgccactgcactccagcctgggtgacagagtgagactctgcctcgaaaataaataataaataaataaataaataaataaataaataaagagaaagccttgaggaagataaaatacaggaaattttccagcctttacaaattgaacctgattttgagaatgatccagtggcccgatttattttgagaatggacagtaaattgtaccgctggcacagcagtatttgtgtcctgtagcgtttaatgacctcgttggttgtgaaaataaaaccgaaagatgctgtctaaagctatatatactttctgttgtcgttttccaacttaagtatccttgatgtaaacaatgacaggtgtccataaccataattgtgggaaacatttgcattaattcacatcaaaggaaacccattgtaaacatcagaacatggtgatcgtctgatcattgcgtattacctgctttacacagtagcatccctggcctcctgcacttttttaaatggcacaggacttaataacacaatttgacataaaaggattttttttacaatgacaatttttaaagttacagcaagatatttaaaaacaacttttcattgaccctgtaagactcactcataagtatccctagtgtaccacttaacctagggctgccatatcaaagtactacaaacttgagtggctggaaactccagaatttatttatttatttatttatttatttattcattttttgagacggggttttgctctgttgcccaggctggagtgtactggtacaaaagtagctcattgtagcctcaaactcctgagctcaagtgatcctcccatcccagccttccaagtagctgggactataggtgtgtgccaccacacctggctaatattttttttttttttttttttttgagacagggtcttgcttcatcatcccagctggagcgcagtggcacaatcttggctcactgcaacttccacctcctgggttcaagcgattctcgtgccttagcctcccgagtagttgggattacaagcctgcctggttaccttttgtatttttttttttagtagagatgaggttttgccatgttggccaggctgatctcaaactcctgacctcaagtgatctgcctgccttggctccccgaagtgctgggattacaggcacgagccaccacgaccaggctcacccggctaatttttttacactttgtagaggtgagggtcttgctgtgttgcccaggctggtctcaaactcctgggctcaaataattgtcctaccttggccttccaaagtgctaggtttataggcatgagccaccacacccagaccaccagaaatttattgtgtcacagttctgggccaggagcctgaaattgaggtgtctgcagggctatgttccctatgaaatctgtaggggagaatccttccttgcctcttcctagcttctagtggttggctgactatctttgacataccttggcttgcagtggcctgacaccaatctctgctttcatagtcactcggcactttcctgtgaatctctgtcttcacatggccatcttctcataaggacaccagtcatattggattgaggggcccctgtacttcagtatgactttatttatttatttttttgagacagagtctcactctgtcacccaggctggagtgcagtggtacaatcttggctcactgcaacctcctcctcccaggttcaagagattctcttatcttagcctcccgatttgctaggattacaggcatgcaacactacccctggctatttttttgcatttttagtagagatggggtttcaccatatgggctaggctggtcttgagctcctggcctcaagtgatctgcctgcctcagcctcccaaagtgctgggattacaggcatcagcagccgtgcctggcctatatgacttcatcttaactaattacatttgcagtgaccctatttccaagtcacattctgagattaggacttctggaggttaggacttcaacttatctttttggtggtgatacaattcaacccattacaactggggttcattgattttgggttaagaacgtgttgagacagtcagagggcagcaaggggaccctgagaccagagggtatgaaacaagagtgcagagaaggaagtggtagggagacaaatggaacccatgttgctattttgcccataaatttggtggcaatgatctctccctgcagatttgggtgcaggaacttgagttactgatggcaatatttggccagtttccagctgaagatgctcaagttccagatttgagtcgaggctacaaatgctcaagttccagatttgagtcgaggctgcaaagggaagtttgtggtggtgtccaggacactctgctgatgccatgtgtttgaaaatgtctgaattttgtgcatagacacactagcagtattttcataagtggagttacataattagggcatggacttgcataataattagcatgtgtaattaggcacagacttcttgtcctttagacaatcaagacatctaattacaaaattaagatgtaattatgtggtccaaggtctacatctttttttctacccattagagattacttttagaaaataattcaaaaaagctgatgaagaaatgaacatagacacgaatttgaggatgttaaagaaagtgttaagtgggctggtaagtttcctttggtctttcctctctgttgtaaggggaattatttaaaacattatggtccacttgaaagaataacttttaccaactgtgctgtcaaccttcggtactcacactaatgaagaggagtgttggtatgactaatccttggcgttcacgtgtggctcttgagtgtggtttgtaatcacacttgaacatggacctaaatgtgacgtactgggaattcattcaaacctattaatggagccatacggtggaaatcttaggataacttgggatagaggacatcctgccttcccgttctgccctggttctcccttgtgaccactttaaaaatcgactcatttggccaggtgtggtggcttatgcctttaatcccagcactttgggaggccaaggcaggaggaccgcttgaggccaggagttaagaccaacctggacaatatagggagaccctgtctctacaaagaatctgaaatactagttgggagtggtggcacatacctgtagtcccagctacttgggaagctgaggcaggagaatcacttgagcccaggagttttaggctgcagtgagcctccactgcactccagcctgggtgacagaaataaataaagaaataaatagcacattgctcagaataatgcaaaccagcacttaagctgtgtttcctttccctgaatatttgagtatttttattttaagtactccttattgactgcaggtgggaaagatcaaagagtatagcaaatactctgtcctttgaaaaagagtgattcttatagcagtaatagtttgagtttcaatacacacagaaagctagattgtactgatagtctccatgtttttccttgcccttaaattgtgatttggctgatctctgcgtgatgctaaacaaccagtttgactcattaattttgctgaactaactgaacttttgacctaattggctgctggttagggatcagagccatatgtgcaggtttttctaagccagttctgactttagctgtgttatccctctgttcctataaactgttgaaataccatagtaattccaatgttttgacagccacactgcacttctcagactgccgctttctcctgggaagtggcacagaaatctgtcggaccacgcttcctgatttttggttaagaaaatatgcttcccatatggttgcgggccgagaaaacaaagacttaaagaggttgtaagcatttggtgataggtcttctcctcatggcgccttccctccgttcctatttttactattctctgtaaggccagggaatgtgatgagggacaaattatgtgtgtggcagggaggggttagtcttgaccatgaaaatacacacatttgcacagggagcttttgccattgttagtttttttaccttgccttctgagcaattgctcgtgatagatttagaggcaaaggaaaggaattggagagagtggcatttttaaaacaatctattaagaggaattctaggtcagagaggggcagttggactacatcatctgtaaggcatctccagctcagaggtttcaggattcgttgatctccagcaggtcactcaacaggaggttgactggactcctattctactcactcaactctaggcctccaattttttggttcttagatgtggtgactggaaacctattcttttgcctttacttccagagagctcagtaattctagttcctaatagagcctaaagcatgagtgcaacttcatttctcagcttttgaaatctgcttttccctccaggtactccacatcagcattctcaagactggagaagttaggcctcagacatcccaagccttctcctttcattggaaacttgacatttttccgccaggtaagggctgtcttccattggcttccatcataaaatatgctgagggccaggcacagtggctcatggctgtaatcccagcactttgggaggccgaagcgtgtggatcacctgaggtcaggagttcgagaccagcctgaccaacatggtgaaaccccgtctctactaaatacaaaaaattagctgggcatggtggctcatgcctgtaatcccagctacttgggaggctgaggcaggagaatcacttgaacccaggaggtggaggttgcactgagccgagattgcaccattgcactttagcctgggcaacaagagcaaaaatctgtctcaaaaaataaaataaaatgaaataaaataaagtaaaatatgctgagcccaggacaggctttctgcatgaaacattggtcttgtccaggtccccacaccttgagcagtaaaggtgttctgtgatgccatgagccctcctctacttatatgaattgttatgtgatggcaagaatccatctcttatcactatcaatatgtattgagtcctgtcatccattcactcacccatttcccccaaaccccatatattgtatgtctaaatacgtcagaccctagagtgtagaagaagaggttacttgtgccctcaagtgcactgtcaaatgatggcatgcaacaccagatgagatacaccctagcactaaatagggtggtatagacggtagctgtaatcttctgtcagaggagagggtgatctgtcagggctaaaatcatcctaaggaacttcctgaagaaggaggtccttcagggcctgtggacatagagacgagggtacacacaccaggtgggtggcactatttatgtgagtgtaccaacgtgagaatgacagcacaggttgaccagcagcctggactgactagaggccaaatgctaaggtgcactgggcaatgcagttgggtgagagaaaggggcactagatgcttacagggtaggaaggcacgtgaagaactatttgtgtgttaacatttttgaggacagggacattgaaatggacaacactctgcaagggagaagaacataggttagagctgtagaacccaactgttgctgaagtccaggggtgaagccacgatggctcggtctggtcggtgatgagagtgaatagagatggataattgggagcaaaatgaagaactcttgtgacaaattagtgtagagaattcaaggcaaagtgagtcaaacataagcctaagctttgagccaggggaacagggagaatggctatgggttgacagaaataaaacgttgggtgggggagtggttcagggagaagacaagttttattttaagtatgttgcttgggatttgccagagtgacatgccagtggaaatggccaacagacatttgtagatataggtcaggactttatggtctacggttattttttctcacattgggttttctcagaagccagatggcttattctgctaagtcacggggacactgactccagacccaacgccaggagccggaacaccctgcatgggaagaaccaccaagccaaacaaaggcaggaagactaaatttgggacaatcctgataatatcccttcaacatctctagaatttcccccatccctacctccggaaaggctggcccttggcactagatagaaaagaaagctgctctttctgtccttttctgcccccaccttctcaattatttcttttccattcctttctgtgtccatcaccttttccatgatttgtcattgttgtttctgtcttcctagcatttttaaacaccttctcctctcatctctctctctggggtgggcggttcacaacttttaagctcacaaacaacagtctcaatgaggcttcctgttagccccttgaaacaagtgtgaagaaattttaaagtgtcaagatagaacaacaaaccagatcggaaagctaaagaaaatgcatttcacacatttctggggggaaatgatcagttgtattccgtggaataattaatttggtattaacattctgaggaaaacggcgtagctgtcgacatgaggagaacgctgtgctcccgcctctggagagcctccacatatgctcctttgcagcccgccatcctcacagctacaagccctgccaagttctttctagaacatagtaatttcgctgactatttttatattcatatatactttccttgatatatggcaagcttacgctgcagaattcagtagatttcatgagaaaggcatgtgtttccatgcaggacatccacactcctaacccccaactttccaccttcattccaccccttatgtatccaccccatactccattctcacaacacaaatctaccatttgccaccccccacacccaccccaactcatgagtattttcaggtctagtccattcccaccacacaatggatctagcattttccacccctccgtcaacccagctacacttctttcccattataaaatgtgtctagccaggcacagtggctcatacctgtaatcccagcactttgggaggccaaggcaggcagatgacctgaggtcaggagttccagaccagcctggccaacatggtgaaatcctgtctttattaaaaatacaaaaattagctgggtgtggtggcacatgcctgtaatcccagctactcaggaggctgagacaggagaatcgcttgaatccgggaggtggaggttgcaacgagctgagatcacaccactgcactccagcctgggtggcagagcaaaactctgtctcgaaaaaacaaacaaaacaacaacaacaacaaagtgtctagcattttgtcttatatatcttaaacatgttgaatttaattaaagtttaactcgaatggatcatgataattcagaatttgtgataattttgatagactcagtagaagttacatatagtggcagtaaaaagggctatatgataatgctaaatcaaatttcagagggcaatgttatagttgagaaagcaaactttttgaatattttagcagcaagtatacataagtagtttaagaactggtgatctctcctgtccaagacttttacatggcaattttttttaaagccttttgtttattccaatgtttcaaagtacctgaaagcaatataacttccattcttttttattgtttctgtaattgtattcttgctgttccaaattgtttactgaataagtttgaataattggaattttgcttaatcttattcttactatagtgctgtgtttccttcagggtttttgggaaagccaaatggagctcagaaagctgtatggacctctgtgtgggtaagaaggaaactcaacgtttctattatgtacgatattttctattatgtacgatattttgattttcacgtgttgaactgatatagaagaaatgccaagattaggaatgttgtatgtgtttctatttttcaaagggcccacaaagagggagtcctgcagtacagacaaggcttctagagaagaccctggggttgcccacggggggactctgctggcctgaaagagtaccactttccagcctttgcagccttgctgggctgggcacagcatcatctcccgttgctgtgctgaggggtgttgccacgggatgtggtggcctctttgcctcagagcacaaactgtccaacttgccttgacagtgcacagcaggtcttaccccatgagcatatctgaaccttactcagactcgggtccttcagcccatggggaaagtgtgctgccagcaacatgaccgtgtaatttatcacccaatccagttcccttttgaaagtgaaaggaagtgctattaataattaccccaggataaccttatcacctaagactatcccggatatgctggggcatatggtcaccctagttcttggccgtgtaaagtaatatagcccttctctttattttctgaatttctcctttgtatgctcctttgtttctaaaattccagattctggtgagcaaacccacgttcagaccacttactctattcaagatttaacaggcttgaattgtattgattctcaacatgtgtctttccacactgaagtcctaatcattttagttggttttcacgcagcttctcttcagccactgagcgatttttttgcagcttttcgtagacctctgggtcagcgatcacttttgtaggtgcattaaagttctcctgtgttgccgacgtacattccaatgggctccagtgatttgggggtcctatctccatagtattcatgatgtctgttctcctgatacccatttttgaaagggattggcttgtcctctttatggaaatggcccctcctaggaagcccacagttttggtcaagttcttctacctactttttggtttgctacgtggtcctgaaaaagtaataaattaagatgttaagatgctctctgtattagtcattgctgcataatggactaccccaaaactcagtgacataagcaacaatttatgatttatcatgtgtctaagggtcagctggagttggctggcctaagctgcacttggctggatggctccgctggacttctgggtgtatctgctggggaggacctcatgtggggcaccaaggctctgcatgtctctcatcctctttggaagtgtaagctcggctggcaggttctcatggtaagggcaaagactcaagagagcaagcctgatggtgcaagaacattatacatttctgctgaatcatttcagcttataccctattggttaaaccaagtcacacggctaaacccaagatgtgggcaggagggcactgtggccactttgaggccaaagcaagacacctggcccagcctgacattgatggagcagggaggtgtactcctcggatggacgagcggggaggcaaggcgtgtctttaaataacaagcaaccctgcttcactccctaagatctctttcaacttggccttcacttactttttcatttttgctttttggtgcatagcttcttgctttaagcgtgataggtgctcgataaaggctcaagaaattgaactgtctacatttctcttaccgttgtgtggttctattgctttttgtttttgttttttgttgttgttgttgtttgtttgttttgcaatagagtcttgctctgtcgcccaggctggagtgcagtggcatgatctcagctcactgcaacctctgcctcctgagctcaagcgatgctcctgcctcagcctcctgggcagctgggattacaggcgcccgccaccatgcctggctaatttttgtattcttagtagagacgggattttgccatgttagccaggctagtctcaaactcctgacctcaagtgatccacccatcttggcctcccaaagtgctgggattacaagtatgagccactgcacccagtctattgctttttttttttttttttttgagacggagtctcgctctgtcgcccaggctggagtgcagtggcgcgatctcggctcaccagtctattgctttttaaaggttctcattccagctctttctttcaaacagtctcattctgcagctgagttggcaatgacttggagactgtctcatatgcctctgagacacagcactgactcagaatgacagtgccttcaccagaatcagaaaaagtcctgactgagtttgaattctaggaaccacttttcttgagtgtttcttgtacagatatccaaagtagagcctttgggtatttaaaaataatttgtaaatgccaaattaagagtttaaagggcactgtatgaactagttgtgtgtgtgtgagagagagagagagagagagaaggagagagagagagagaatgacagagaaaaagagagagagagaaaaggagagagaaagagacagagaaagagatagaaagagatagagagagatagaagagggggagagagagagagagaggagagagagaggtggagcgaattggtttccttgacaacaggatatccaatcaactttttcctccaactttaactgagttaacacaatttatccttttcatttcaagaaaacctaaatcatagagaatgatttcaaatgaggttatagagatcaagattgcagtatcatctccattctttgttcccacttctagtgaaaaggaaaaaagaaaggtgatggcataatttcttcctataaagctatcaacttttctcctttggaaaaaaaaagatgagccataaaacactgacttctttttaaatgtgtctactcccagatttagaggcaatatggtggcggtgtaaaaatgaaagggttgaaccaatctaaatcgaatgtcttttctaactctaaatgttattttcttactgcttaaattttagcaacatagtttcactcattgggaatggactatgctcaatgaacagcaaagacccttcttgcagagaacaatttaatttaaattacattagtttttattttattttttattttacttttattactaggaaatataatcaatcccagcttggtcttcttaaaaattgaaataatagattgattcattatttgacaagtgaaatgccacactctacactgttgatgccgtgtagagatgtattgggcctttagatgacagcttggcactgaatgttgggagaaaaatggacagggcaaatctcctcactgctcgagactggaaagccaactatgatggcaatgtatatttattatctggttgtcaccctagcaattcaagagtttgaggctcaaaactggaaattgactccttactcaattcccctcccactccctaccatggggacaatagggctggagaaggtttccatcaagatgggcagacaacatcaatgtttatcattaccaccaacactgccaccaccaccaccatcaccaccaccatcatcgagaacaaaatatcttcaccaagtgtctacttatgtagcctgctttgccaggttctgtgtaaataaaactacacacggtgtctctgccttctttgaacttgaatgtaaagcaggaggactggcgtggatacctatacagctattagtcgtggtggtacgtgataaaaaactctcctgaattgcacagcaacctggccatgtaacacaaagaaggcaaggctttattgctttagataaccttcatcaattaatgattacttgttatctccttcaggctgagaatgagccccaagttggatttatattccttcccaaactctgtaagaacagaatcaacattatcgtcatacattggtgattgaatatggtttatattcaatatataccaatattgaatataaatatatattgatatatattcaatatatcctgtttggatagagattatatcccctccaatttgtagctggactttgtaacccagtagatgataaacctttattaattacttatagttaagtaagaataaatatttacacagtgccctaagttcaggtcattagcaactcctaaaggccgccattcaaagctccttttccctttatctcattttgtgtgtgtgtgtgtgtgtgtgtgtgtgtgtgtgtgtgtgtgtgttttgttttgttttgccttttgaggcagagtcttgctctgtcatgcaggctggagtgcagtggcacgatctcagctcatggcaacctccacctccgaggttcaagtgattctctggtgcctcagccaaccaagttgctgggaatacaggcatgtgccatcacgcccagcaaatttttgtatttttggtaaagacggggcttcaacatgtcggccaggctggtctcaactcctgacctcaagtgatccaactccctcggcctgccaaaatgtgggaattacaggcgtgagtcaccatatccagcctatctcattgtcttttaaatgcttgctctatagttctgcttttacttagccttatccccgtttcttcttcccccaacatcactttagttttgatcttggctccctcttgttgaacttgacttttacacttcctggcatccatcagctatgccgctccattttggtaagtggcacctgcatccctggatcccttcatgatgccagccttgttgcataacctcatatactcccatcagagcatcaagttgtaggtaggtaagcatgaactttgtacataattcataaagtacaaatgagtataagaaaaaagtacacttgctcccaccctggggcccatctgctccttcacagaggcaacctctcttaaaaatttctttatagtcaaatggatcatatatgatacatgctgttctttaccttgctttgttcattaatggtatttgggaaattgtcccattttgcttcattcattcttgttaaattaggtagtgtttttaaggatttccttgtatgaatgtatcctaatttttaaaacaagttctcaattgataaacatctcttacttttacaaacaccatcgcagtgaagattttcatatacacatcattgatgtctggggtaagtatgcaagataaattcctagaaatggaattattaggtcaaagatggtctatgtttttaatttcgataaatatgactaaatttctctttctagggtttatgtcagtttagattcccataaatatgcatatgtccctcccatacttgtcattaaaatgtgtggtcacaattttaaatctttaccatttgatggtatattgctgcagtttcgatgtgcatttctctaattatgagcaagtttgagcatcttttcatatgtttaaaatgcaatgtattttgttttctgagggatcctttgccacttctctgttgggttattgatcttttcccactttatttgtagaagctctttgcatattaaagaaagtagccttttatatgccttaaatagtttctcctctttatcattgtctttgactttgcttatcatatatttcttccaatcagaaaacatttgtttttgtgttgttgactttaattgattttaacagtgtctacattttgcatcttactcagaaaggttttctccaccaaggatattttttcataaactttcatttttctagtttctttaaattttatttttaaaatatagaatgtttgatatatcaggaatttatttggaagatggagttagggacacaccctttttccccccctccaggagggtagagttccatctggaaattcatccttttccaaatgatttgaaatgtcacttttatcatttattaattcctaggtgtatttctgatttctctattctgttgtactgcttaatcacaagccagggctgcactgaatatcctcgtttggatgtcacgtttgtagcttcttgtacctagctgcagtagggtgttctaagaacatctttgtaagtatcaaagcctgaagcaatctatctcccagggaaccttaggtcccatactgaaaaaaaaaatcaatttagcaaataaataagcctttggtataaagggcctgacacttagcttcaaagttcacaccacaggagggggaggtgtctcatatgcctccaagttggaggtttttagcaccatttttaaaatttaattagctagcatgcatgaactaatagcaccttgtcaccaggcagtgaggaagttgagaactttgggatacataaggaaaagcatgtggcatcagcaatcaaaataacaaggtcgtttcaacactttttaaagctcagcttccatggtgccatccattaggagagtctgtgttctggaagtgactaaggtgtgaacacttttcgtgtaattgctcttaaccatcatgtttatgtactatttagatggggttgaagaacagcatagagatggtttactttaatactggcagatggctatgtgagacttcctggcctaccatcatggatcaagaacaacgggaattgaagggctctgaaagactcacctgttggacatgtttgttctttgacttagaagatatgagacatctgaatacactgggcttgaacatgtggctgaggatagggtagggtggaaactattgctgatttgtccaagaaaagacaagtacttagacttaaattgggcagctgacacctggagatggcacttgtttttaaactggactgagctcagtagaatcatagatgttgaagaaaggtggaaattaagccaccgttgtggaagagcttcccagacactgatgctaaggagtcaaactttaggtttttgctgctgataaaagtgcaagcctcagtatgaggctcatttactaaatgtttgacccaaaaatgtggctcaattctaagaggaattgatgaaaatgaaaatatacatagtatattgagaaaacacaatacccttgaaacagtggaattaagcacagaagtcctgaattattctaacatctctggccatgaggccaaactgtgggcaatatttgggtcccctagcttggtgaaagctggctttcatgaaagcgttgaaagcaaagctgtgcattgccgttcccaataatgtgaatctgaaagcaaaattcatgtgagaccatcatgatggtctgtaggtcataattattgagcatcattcagtgagtgaaatatcaatattctcactggtcaaaatagcttaatcatgaacactaagcctgtaagagcaccttttttaaatgattggaattcactaaactgcattattgcattttaggggggccattattctctaaaagtgaatgccctgacatagtgtgctgatgttttaggaggcctttgagaataggaagaaagttgtccacaggacaactatcaccaagccaagcacactgcccagtaggtggaattatcaaaggaacaattgtccacagataaataagtggcttagaccaaagagacagaggaatttgatttgagtcccacttttcttgaatgaaccattaatagactcttcacccttacctgccaccagcatgatctcgttataccaaatagtgtattgctacaaagcttccatgctttcttatgatttaagaccaccttctttcccagtcttgatccaaagacccttctgaagtttacctaattttctggacttctaacttcttctttcagcccatttattttataccagttcatttccccccatcctctttctataacagcatatgggtgatggttgctgcatattttaatgactactgctatctaagtctttgtgacccaccctcataaagatcaagaacctgtattaattccctcttctttgggtagaaacatccaacagggcatgatagcttacagtagaaatctgcagttaaaatcccagcttcaactttctttctctctactgcttgttaccttaatggatttaggccaatcacttcccctctccagctttagttctcttagatgtaaaatgtgggatttggactaggtcggtgattttgacactgtttaatcatgaacctcagtaaataatatattaaccacattgttatctaatacacacacatacatttgaaataaaagttttacagaagaacaccttattcacagtataagaaccactttgatctattctattgtattgtattctatctgtaaaaaataaaacatttacaagttggtcacagcccattaaattgatttcatgaccactagtgagtcaaaatcagcaatttgagaagcaaagggccagatgatatctgaagtcctttccagttgtaaactggatgactacaagccaatgagacagcccctatcagtgtgcatcagaaaattgttagaggccattgtgtttgcctctttgtggtttaagattctgagaaacctctgtcaaagtcagtaaaagcccaccgttcacagctgaaaccgaactccagtggaagcacttctcctgcagagaccagctcccgcacctgactgtgggcccaggctgggcacctcccacccagtagcaccttcttgttctttaaaatcacaagttcaactattattgaaattatttccaagccttaactcggaatcatgctaagaagctaacacaaatatattaattgaccatttaagacatctctctgtaagatttttgcattgggtgtaaatatctaagtaattcatgtggatatcttctcccaggtaggtgtggccagctgattacttattcccagggagctggagcagcaggaaggaatggcctggaaactggaaataatcccatttgccggggtaagctagctgtggaaaactgaccaggctgtgggtaccgagagagcagcttcctgctaaacttcctgctgtgggtgaagggcagcgtttaaagagtaagatggtgctccccattccagcaaacactggccacagtggacagtccaggagagagctgtgcaccaggaaggtgtcagctggacagtagtcaagcgtccagtaaagcagcgatgaggaggctgtcagtggacaccagggccccactagtgggtggttcaggaacctgagaagcccccggccctgagaaaggagtctaggtagtacagcagggtctcagcggtgagggctctgaggatgaaccaggaattgacattcagttctaagattcacagcatcatgtgaggcccaggaccagaagccagacctaatctccgatatcagtcagggtggacaggtccatcatggttggaacagatccatgctggagaggcaccgagtctcacgatgtgtggctggaggttgttcctgcttctggggccagggctgggcctgcagatgagggacagagcacctggctagaaaggagagaggactgcagcggctggagcgtcagccacagatttttaattttgctttccttgatattcacatccaaaatctaccatggagaactgtatatcacgttcaaggtggaagggaactaactcattcctcattagtaactatcaaatatggcatcagtaccttctttatcctgtaagtgacagctctgcacagatgtgttcccaatcgatagaatgtctcaattaaagttgcataaaagctctattttgagctaatatcttcaaataataaattccacatttaattgaagcgtacctgcaacaaatccaagttgttcaacccaaaatgcataatagagtatgtaaaacagtcatgaatcactgtgacatttgtcaaggcattctcccatctggaagcaggtccagaaagcacatggctgtatgcatatatcttttgtcaagaactttgcacagacagtctcaaaaagtgcacacatttacccaattcttagggctcttcactctgattgagaatgcaaatagcattcctattctatctaaaaagaagaaagacaagccatctttgatttcaaaatttaaaagaaattattactaaatttgaagaagcaatgagttcccaattcacttagagcttaaagttcctctttcatcactattttgtgagcagaggaactttttccaaacaagttcttagaaatccttgcttgattaaaaaccagttctaaatcttgttactcacatagggcaaaaggtaaaggaatctaaatgtctaaaaccaaattaactccagatactagtgtgaactttcaagcaaaaaaagtcacacaccaccgcatacacgtttgaaattctactaaattttgaatgtttgacgttagcctttaaactggaacatattcttctttcttccttaggatctttaaatcttttaaagtttgggttgtttactatgcattctaattactcctgatcactcttatgtgtaacatttctatagctatgcacacaaagtaattccttagcaaggccccaccaagttttatgatgcctgcttgcctagggcagataatataaacttaactacgaaaataagttctttgattattcttcgtatctcaagaccgtgctcctaacaacctctcctccatctcaccctcaagctgcaagaattttgcaacccactctatgaagtttttccaccctgagtaaggctgtcagtttattggcctatttataaaggtctgactctctgacatgttctccaggctccccacattaaccactaaggaggcactctttgcagatgaatttttttttttttttttttttttttggcctcggcttaaagaggaacctattaacctttgcccggaatctatggctggtgaatggcttgtcatagcatgttagtttgatgaggcaattgtggtcttttttgttaaaacaccccccagcacctcttgatactacttggcctactggagatgtgggcatccaggattgaatcaaaactactgcacttcacaacagagctactgcaggaaggaaatccaggtactccctggcttgtgccacctccatcttttccgtggctaatgtaatgcctagtgcatattcaccacaaagaggcaactgttgaatggctcttccatttgcctttgaagattgcttgtaactcttcaagttcacttcttcatctcactgccagaccacagcttgagactgatgattgacatggccactaggttcttcccaaagactccagcctaaagattgttagctgcttcccccaaaggcttagccttctctgctagagttttggttctttggagcatcccatgagcaagaagcctcagctctttgtcctcctctgtgtaggagcccacaaggatgctttatctccaatctggaatggacacttagcatcctgagttctgccctgctcaaaatccatacctgttcatgagtaccagggcttcagggcccgagaacccacagctaacacccataggagaaaggtttcatatgagtaggtgggatgggttttcatgcctctacaacctggccagcaggaggaacactgtgacccatggtttcagaattgatggtctcccacttctcggttagatctaggtattgagaataacctgaaggacatttggctggaggacattatttttattgtgttaaaatatgcatcacacaaaatgtactctcctatttttcattgtatagatcagttgcattaagtaccttcacattgtcgtgcagctatcatcatcgttcacatccagaatttttttcatcttgcaaagctgaaactttgtcctcattaaacattaactctcccttccctcctcccccaggccctgacaaccaccattttaccttctgtctctacaaatttgactactctaagtacctcaataaagtggaatcatatggtatttttccttttgtaactggtttatttcacttaatataatatcctcaaggttaatccatgttgtagcacatgggagaactactgcctttttaaggctgagtaatattccattgtaagcctattctgccttttgtttattcgtttgtttgtagatggcggagtgtgttacttccagcattgagctaatgtgaataatgttacttgaatatggatgtggaaatacctctttgagaccctgcttttagttcttttgggtatatatgcagaggtggaattgccagatcacagagtaaatctatttttagctctttgaagaccgtcatactgttttccatagtgaccataccatttcacctttggaggacatcttatagcaatgctttgttgtccccttttcaccacgattatgtggccattacttcttgttttcaaaccttgagagtgagctcaggttaaatttacacttccctttgtgccctggatcccaactggtcaaggtgaaccacacatttctaattggaatgtatgaccccagtgactttgcctgtaacttccttttggctaggccagtaagcgcatttttaaccaaaccgaccccattatcaacaaatgcttgcactgcacgataaattcagtttgctttaataaattcccagtagtcctcacccagagctccttctcctcttatctcactccttgctgccaaaccctttacaatttatgtgtctgcctttcggttctgccttcagccccctccaagtttcctctttcccaccagctcactgtggcctttgtgtctcacataaattttgtcttctgtgtctgaaactcttactgacttctgcttccttgttccctgggtctacactgttccttctcttcctggaactgacccttcgatctctgggcttcctaccttgagtaatttgtcaaaatcctgttcttgcaattggtggcttctcaatttttttcctctgggtttttttcccacagtctttccactatatcacagggcatacactcctgcttcatgactgttcatgacatattgaattcccctcttgtaccccacagtctctgcactgagtgtgtgctcattgggaaaggttagctcacattatacctatccaaaaaaggagaggtggcaggtggcctgtggagaagagtgtatccaggcacatatgcatgggagaaagttcagaggttttggctgagatagaaagaagaagagtagaggccaaatgtgtgctaggaaaatgtgatgtttggggcacaagtagagaggacaaccttggcagtggcagatgagagagaacctcaggactggtgctaaggaggtgggttatttaaagaaagttgtgcaggtatagagtggagaaggggtgcagggggaggatggaattgagttaaaaaaaaaaactagcaaaaaacattctgatagcacaggtgagagagataagagtgatttagattatcagaaatggaaggaaaagaaggagaattttatagagaaagtgtcctgtagtggccgggtgtggtgactcgtgcctgtaattctagcacattgggaggccgaggtggggagattgcttgagcccaggagtttgagacagcctgggcaatatagtgaaaccacatctctacaaaaaataccaaaattagctgggtgtggtggcatgtgcgcctgttgtcccaagtactttggaggctgagataggaggatcgcttgagccaggaaggcagaggctgcagtgagctgagatcatgtcactgtaatcctgtcgaaaaaaaaggaaaaaaaaaaaagaaaagaaaatgtcctaaaaatgcagcaagtcattgattgtaacaagtaagagatgagtcaacattaatcactgaggctgacttcaaatgctggagacaacatggtgattccaccataattaagaggttgaacagggcaaagacaaaatagttttatctttttcttaatccgttggagcttgtcctcatcctcatgtgttcaagctgttataacaaagtgccatagactgggtggcttatgaataacagaaatttatttctcatagttgtggggactgggaagtccaagatcaaggaaccaacagattcattgtctggtgagggctcactttctggttcatagatggtgccttctcactgcaccctcccgtggtggaagaggtgaaagagctccctagggcctcctttataagagcactaatcctgttcaagagggctctgccctcatgacccatttgtcccccaaagaccccaccttctaatactgtcatctgggggtttaagatttcaacatatgaatctgttggggggatggatacaaacattcagaccatggcagagctgctaaggagacattgggtgcaaggtgacttaggaatgaagcactcagaggatcaggaagctgcattaggaaggagagaggaatgggagctccagggtaggcctggaatccggaatctccacctcccaccctccaacaatcgaatggggtgtttcccgcagtgtgtccttgagaccatcgtttccactgacagtaataattgttacatggggaatagcaaaaggaacacaggtctcttcagtgtagaaagactccgaacctttcatgcagcaatgtccttcgacaatctccaagtgagaaatttaggatgcagtcttttttttttttttttttttttgagacagagtctcgttttgtcgcccaggctggagtgctgtggcgcgatctccgctcactgcaagctccgccttccgggttcacaccattctcctgcctcagcctcccgagtagctgggactacaggcgcccgccactgcgcccggctaattttttgtatttttaggagagacggggtttcaccttgttagccaggatggtctcgatctcctgacctcgtgatccacccgcctcggcctcccaaagtgctgggattacaggcgtgagccaccgcgcccggccaggatgcagtctttatttgaccacagaacatttttccccccagagtatttcttgggactaggatatggagaacaggctttgagagaaaacactgatctaataaataccagcattttactcctaaagaattccccataaaagacaaccattaatagaaatagtttacttcaccattgtgaattatcaacattacaaccagtaattactaattacctccattttgagttgatgttttgggggatgtttttatcctgcagtgctatggagaggctgggaacgcactgctgcctgtgttgcttgtttatttatttccttttattcccagtgttctctcattccccttcccatccccaatagtcaaccattccaattgtgtttaatgtgtttttttttcacatgttcttgcaaattgtgcattatcatttcgtggatattatccttagtttatgccaatagtactgccgtagatctcattctattccttagttttttcatttagcactgtgctttcaaggtccagcacagagttcccattgagtctgctgcttcccatggctgcctgacatgccacggatgcctgtacctacttcacctgtccactgtcccaggaggagatacccagtggccctcagcaagcaaccctgcagtgggcatccttttatgggacctctacggacctgtgggagaactctatgggctatccatcttgccctatgattataatatatatatatttatttatttatatatatatatttgttccctaaggccacttacatattaattgctaataatctgaaagtgttttccagcactcagtgtggatcatgtccctccaatatagtatctcccatggccatcccaataacatccctgagagtttggccgggctagttgcattatcctcaatcatacagaaacatgagtgactagaatgaaaagggcgtgtggctagtaagaggtgtgagcagagttgcacaggttctttttattaatccaaagctctttccattccactgcctcttcttgctgtttcttcaacattccaaacagtcctgccttaggacgtttgccataacaatacgtaacataattatttgttggttgacctgctttcctggtagaatgcaaacttcacgagggtagggacttgctctcttgtttgtgctgctatttccagtgcctagaatggtgactgacacataatagatgctcagtaaatatctgttgcgtgaacagaagaatcatctctaagtacatgtctttcatgtcagatttgtctccaaggaaacttcaaacaggaaggtcttgctatttggctaatttgggtaatggtactattttactggagacaaataaaaggaattagggggagagtctcatattaaaatagagggttggataaggggagtttatactctttccccatcagtggcttttatgctctatcaattcagtagttagcccatcaaagtaaaaaattgaattacactgtgtaaggccaccttgggatccaaaagataaaagagaagataagggacatgttctcctgatacactagctgggctccactcacccaagtcattaattggagtcttattgggctactgcctcatatcctactcccgaagagctgatacctcccataacctcattcttagggtcagctggccgtaccagaaagagcactggattaggagccagatctgggttctggtcttagctcagctatccctactgatgggactagaatgaatgagtcatttatcattttcttccctttaaaaaatacttgaggccaggctcagtggctcaccgctgtaatcccagcactttgggaggccgaggcgggtggatcatgaggtcaggagttcgagaccagcctgaccaacatggcgaaaccccgtctgtactaaaaaaatacaaaaattagcctagtatggtgccgcgcacctgtaatcccagctactcaggaggctgaggcaggagaatagcttgaacctgggaggcggaggttgcagtgagctgagatcatgccactgcactccagcctgggcgacagagtgagactctgtctcagaaacaaaacaaacaacaacaacaacaacaaaacaaaacaaacaaaaaaacttgagcacctacctatctcacaggtctgacatgagactcaaaggagctctcagagccctcccagggcagactgtccaagtatcagggattccaactgggattccactgctccttggtgttcttgtagccagcctgcatcttggggagtctgccgaattcagaagccccatacctcaccagctcggggtgagcttcttgagtcctgcacatgggtcctctcaccctcatgtctccagggactcctccgcctgggtaaggggagacagcacacatcatccagtcctctcccctctttgggcctcattttcctagctatgaaatgagggggttgggctagaatgatcatcttgaagcttccctccatctctaaagtattatgatcagtgctttattattttttccctgcctctgatttctctcccactgtgtctgaaattcttttgccattaaattttctcttctttcagagttgcatatctgggctttttatacctagtcctggacagcacattcttcccatggcactgggcttcctcccctggcctcactgtcttttcaggagtgacattagctttttcccagaccgtgtattcctgttctaagcccacacatcatttggggagagatgattttgccatgtactctcacaaatatatgtcctgcacatattctatggaatagacacacacacacacacacacacacacacacacacacacacacacagctcccttcaatacccccgaatatacatgcctgggcataacgtgtgggcaaaaatattcagggacagccaaatgactattttaatgttcctttgtccctgcagggccatcgaactatttatttagtagcttgatgctgtttgcatcaacaactttgccttataggctgttcttcatgtttatgattcttactgtgaaaaaaattgcttgcctaacatctgttctgaatttgttttttctttatttttatttatctgttccccattgaattacatttgcaccaagaacagtaacttgaattgtaatcttcagtgtccttcaggatttctgcacacttcaatacatctcttaattactctttttttattgttatgagatatacatatatacccatgctcacactggcagattggtttgtagcttacctctgcctgtccccctctggggactaagttttattaactgaataaattagatgggtgggtatattcaatagagtagggaggtttatcattacaggtttctttcagatatttttcccccttgctgcccagttctctcctttagccatagctctgttttggagaaagctttattgtagcttgacagagtcataactcaccaggatgagaaggaccacttcatcttatagatgaagaagctgagggccaggggggaggctatcttcctgcctgcttccagaaagcgtggagaatagctgccccagcgccattcttgagaggtagagcacagcttgaccctgcctctccaggctgccaagcctgggggctttccttagcagcaggaggcctcctgggactaccgtgccaccacccacgcaccacaccattgctgcagacccagtcctttgcagagcaagcattttgcatgttttccatgggtgtggctgggttggggtggttagaaaagtgtgcagaagatggtgtgggagaagggcagggcatggagaatcacagtggggtctcttcatgcttgtggactctcctggtggagctggttctctggcctccctcaggctggctcgtgtgactggagccctcattaaccccctgctctcaccacttagaaaccaacccagggaccaaccaagcatattcccagcagtaggcaagaagatccctaaagaagggaagtgagacctgcgtttattcccctgatacttgggaaatctagcagatatagagacagtgacccaggtatccaagggattggtccaaattcaccatcctgtaactcgaaatgcaatgctctttctaccatcggttctccattctttctggaaggtgtgtcccccttcttccttttgccctttcccacactctttgggggtctatgtccatgtcttccaatggcacaaagtcagaggggatggtttccccatgtcttgaagtgctcactgctggccctgctccagatgttgtccactcaacagacatttcagtctttgctacgtgtacagcatggagctcatggcagtgggagagactacccatcccctccagaaaatgtatcattcatgtctcttttcccaaagaaagctgacatctaatttaggagaaaaacccagacatgggccaagttgctcaagaatgccaggtagtatagtggctgacttctacaagagaaggacaggacacccagaaagaaacccagaagaacaggaaacccagaaagaacaggaaacaggattctgggtagaatcatggaccagtgaaggcagagaaggcttctaggaggaagtaggtcttgaagaatgaataagggggaggtgagggcaaagaatgttccactcagtaaaaacagccagagaaaagcccttgaggtgggaatggttgggggaatggaagttgtggctggagagagggacacagatggattggccagtcatcatcacacactggaaagccttcgttgccaggcgaagacatgtttgttatccttttgttacccttgctaatggcctgtaagctgcttaaagccatgtcttgcaggtcagtttctagagatggggtttgaggggcaagatgtttactagggatcagtgaagggaaggaggagaaagctgtcagtcatcccccagtaggacaaaatgccacctctctgtgttcctactcagcccggccactggatgtgggctttaccaggaagggggtgaccccagtgacatggatctcagcagctgaggctggccctgaaggagctaacagctggaggctccctgctgaccacagtctcggctgctggacagcaagtccttcccagaagggggatctggacgacatgtcttgatgtcatcacatcatgggaactctagttcaaatgaagtttttggcagaatcaccaggttgaagtgggaggtgatctgagggttctgtatgctgagcttccccacagaggactctttgccccgctagacctgagactggctggggccagccacaaaggcaggcccatggctgatggagccaacagggcacctctgcagggggcacctctccagggtggtaggagtgaaatagagcaggccccaagttttagaaaatgaccaggggctgggtgaattttggaagcaagataaatgtggataaagagaaaaaaggattctgaggtttcaagtctggcttcagagttgaaagctccttctgccaggaggagtaatagggaagccaagaggataaaatgatttcccagtcctggaaaggcagcttaaaaccatccttccacttgctcttaagggtgaggcgctctgctagcttctcagggatgcacggacagataagatgggctttgtcttgagagaacttgcagagcgatcaggagcttatcaataaacagagggtgatgcaggtcagtagaggaaaggaccaggtgccacagaaactacaaggagcgaagggtccatgaagccttcacaaagaggggcaggtgacccgactgtctgaagttttccaaactaacaagagggcagccggcactttagagggtaaatacttgcaaagaggcagagcagggggaatactgcacatctggggaaccataaataactttttcacagcaagaatgaaaggctgtggttcccaaactgtgtgctgagacaccccagggtgccacagtgaactcacaggggcttcctgggctatggtattttacacattcgtgacaaatacagcaacatctgtcaggcactgtaggaactgctttcagtttatgtgtattatttcttcaaatgtccactaacttgctagaacatgtatacttataaagttgtttgaacttatctacttagaaatgagactgtggggttcttcttttggcctggggagcgctacgaagacattactgagtcactaagggcaccgtgaactgagaacgtttggaaacacaggtataagaggaatggggtgaggagagaagtcaggagctcctgaagggcccctgcttggttacaagtgaagaagcttaaacttgcttcaaatgatggagaaccactagagatttatagggaatagaacgacacagtcagcttctgttttacaaaggtgattggccttggcgggagggttggtttggagacagagagcttcactgggagctcctcagtggtccaggcgagagagacagggcctgaagccagttggcattagacgttggagctggaatacagcacactgcgttgacatcatggaattcccactgcatgcttaacaccataatgaacactagacatcaaagataagaagacaagatgtgtttccaccactcacaaacgagcagaaagacagtcaggaaaaaaattacaattactagagaaccactaggagtcaaccaggcaagaaaagaggagccgttccaggcaaggcagggggaacagcatgtgcaaaggcatgggagtgagagatcatggagggtttcagtcggtatgatcaggattggctcttggcggtggggtggggagggggaccgggggcaggcaggcggggggaataaggaggcacaaggccaaagaacaaggcagggagcagggtgtgaaggacatcatgtgccacatgctaaagacttggcaaaccattgaagggtgttcagtaaagaagcagcatactcagatttgcactttaccaagtcctaggtggataagtggagttggggcccacatgtggacaagcagcaggtcagaatgatggagacagaaacctctgagtgggaggtccaaagtctggccaggaagaggaccagggattgtaccagcctgaaaagggcaaaagaaagttgctgaacaggctctacaaactcctgaaaggggaggggctgagaaagcgctggttcggtccattgatctctgcagggctctgtgaattcagggtggaccccaggcatgagtactctgagggtaacatgggcagatgttgcctgaccctgctcagagtgacagacaggagccctgggaaagcaactccagactccatggcctatgactgtgtcactggctcctcaagaaaactctccctggtagctgagtctgctctgtcattcagctgactcaagcctcttgctctaatgacagacgggagagctgacccaaaagggaaagacactccatgagccaagcagggacagagccccaggactctggggaccctgctttctccatggcaccctgtggaccatccagccccggaggagcgcctgtgagtcaaatgcccaggtactcccagcactggacttctccttaactttctctgaactttctggaagttgagcatctcagacactcacaactgtgatctgcagtagcgtctacccctttcctcactgagcctcctgccgcttccacatggacattccatggcaaaggtcagacttgagggtaggacagcagctaccctgttagcatcctcagcctgctgggaaataaaactgtcacggagacaagaagttctcagatgcttggcatttagcagttgtcagaggagctgaaagccctcatcagttctacctgaaaatcagaagtttcccaacgtgcatggcttttttttttttttttttttttttttttttttgagacagagtcttgctcttgtcacccaggctggaaagcaatggcgcaatttttgtacttttagtagagacggggtttcgccatgttggccaggctggtctcaaaatcctgacctcaggtgatccgcaagtgctgggattacaggcgtgagccactacgcccggcctgtgcatgcctttctgttccttctgctgatgtggggggtgttgggctcctgtcaggggcctcctgatgccccgttggggcacttcctcgctcagcttcctcgtccctgacaaagtggcagcagcagggtgtggcccatggaaggtgaccatgaccagcattttcattaaactttactgttcggacaaactattctcatctgacctcataacggtctctttaatcataggaacagtttcaagaaggttgatttgctcaaggtgatacagctgttaaattacaggacaaagccttgagcccaagttcctaagactctctgacacctgcaactgtggcactgccagccgccactctgcctctgacagtctcgggggaccaatccagtgacaaattctccctctcctttttttttttcattgcagaagtcacatgcgctcattataaaacactgaacgttcaaggaatagataagatgaaaaggacagtgccccataatttcctgctccagatctatgccctgtaagccaggggtctgacacagagtatgtgctcaataaatgctttctgaagggactagttaatagaaagaccgactataatttattaacagagctccccatactattttacaatgtgcttttccatttggctgggtcatttggacattttttcatgtcggtgcctgtaggtgaccccctgcccaccaccaccaggaacagtctatagctcggtcacccctaacaggggcaggccttctggaacaaggccaggcagcccccaggctaatcccaacagtctattctacttaagttcccagaaggcggctgtgaactattttggtttaactgactggtcagtttcaaaaaagagagaaaaccactaattaaacaagtcaaacaagtggttatttttgtctacacaatacttcactgatttgcctacattttctcttcaaccaggtgctttggagttgaataagtgaattcttaattgcatagctaaatgtagatgaataactggttaagaatttcttgcccggaaaggagtctatatgtaagtttggattagagtgaaccaaggccttacctctttaattgggctgggggttttctggtccattaagcaagaatatgctctaaatctccacctttgaaagccacagtctgcacagctgggagcctgcctgctttcccttgcacacctacccagcactggagcgggttcaaagacaggccacccgagctaagagcagtcactggaatagatgacagcatgctcaccaccaaggacctgggctggggtcaagtccctgtcttgggcaagtgactttgcctctctaagtctcagtttcttattctgaaaagtggataaaataatgtcctcatccattttctatgagaattacatgaggaaatacaggcaatgcacttagaatgaagcctggtcaatagtaaaccctcaaaataaatgctaacgattgttgttaatctcaaaggtttgagaagaatctacaacctctgcaaatatttcactagtatgagaagtttctttgcaccctataggaagtagacctaaaattcaaacaccccatactttaatttcctttcaaatttgtaggaattataggatttacagttccagtaaactacagagataacttagttttcactcccatatttcagccatggcccagagagtttcagaaatttgcgcctggaacggatttctgtgtgagtggtatggctggatgaacccggatcccacctgctaagctgttgcatattaatctccaggacccatgccacctcagggagcaggaagacactgcctcacattcacacctttgtgcaataccaagatcaggcccttctagggaagtaagctttgagaggcagaatggcactgggaattcacaaggttgagaagaaaaaggggcaccatactagttaggacttcctgatttcaaattatgggaaacccaacacaaactaactttagcacaaactaactaatgtaagctaggaggatggaatgaagagctgcaggaggaaagtttggactctatattgtgctttgtaggcagtctgtctatctgaaatctctgctggtctctattagctccttctgcagaccggctctctccatgtggtacaaaaatggctgccatcagccctagattaatatattctcagtttagcagctccaggagaaagtcagagcttttcaccccagcatccatgtagaaatcccaatgaaggatccataccggcctggagtgggtcatgtgtccaccccttggaccagtcactgttgccaaggagatgagatactaggattggccatgcctgggtggtgagcccaccaccatgaccagaggggcagggttctatcactgagagctccttcagaactgcatggaatgcgagggtggttcctcaagatgtagtgggcagacaaaagcaggtgagccatcccagacacccaaaacgaaagctatgtgtgcctaggacacacttcccttacattttttctccattcaaggtcttttcaggagctcctcaaactacagatgagagtttttgtaaatataaattcacaagattacacaatttacatgtaaaatgggaccagttttctcacgagattcataaaccagctctgaagcaattctaaaggaattgttgcaaaattgtttttagcattagcaatattactacaaaaaaaaaaaaaaaagaagcaggaagactcccaaggtgactacttggaaggacaactttcatttgaaagtagaagtattattttgttcctttaaaaaaatctagattatgcgtaagattattatgataactaaatcaatacaaatatattaccaaaagttgcgtgtgccctacagtgtaattgctttccttttagatctaagaatttagggaaatgagaatgggtgtgaactttggttaaatatagagcaggttttcacccaatcagattgggtccacaatctgtcaatcacatcaggatcccctgggagcttgttaaaataggaggtgcttgggtcccaccccagagactctggtctggtaggtctgggtagggccaggcattattatttctgaatgctccgcagttggttttgacaagccctcgaggctggaaaccatggccctaggacagcatttctcagagtatggaaagagtcctcttgcatcagaatctgagagctggttaaaatcagattcctgggccctacccaggcctgctagattagtcttggtagggagcttggctgtgaatttagagtttattaagctccccagtgactttttaaaaatttttaattttgaaataattatagatggacaggaagttgaaaaaaatatgtatggggaagtcctatgttcccattacccagcttcccccaatggtaacctcttgcgtgactatagtacgttatcaaaaccaggagaatgaccctggtatgacccacagtgcttatcatattttttccaggtttatatgcactcgtgtgtgtgtgtgtgtgtgtagttctatgcagttttatcacctttgtagatctgtgtaacccccaccacagccaagataaagactatcctatgaccataagctctctagaactacccctgtatagccacatgcacccatcaccacccccatccctaacccctggcaaccactaatgtgttctccatctctataattttatttcaagaatgttatgtaaacagaatcatacagcatgtaatctaatgatatttgttttttcagtcacaaaattcccttgagattcatccaaatttgtgcatgtaacaatagcttgttcttttttaaattgctgcatagtattccgttgtatagatgtactacagtttgtttacccatctacccaatgaagaacatttgaattgttttcagtttttgcctattacaaacaaagctgctgtaaacattcatgtacatgtgttctgtgaatgtaagttttcacgtctctgggacagatgttcaagagtgcaattgctgggtcatagcataagtatgtggttagttttataagaaatcgccaaagcggctttatggttttaccttcacatcagcaacttataaatgatccactttctccacatgtttgccagcctttgatgttatcactattcttttaaaattttagcctttctgatagatgtgaaatgatatctcattgtggttttaatttgaacttcaccaatggctaataatgttaaacatcttttcatgtgtttacttggcatctgtatatcctctgtagtgaaatgtctgttcatgtcttttgcccattttctattttatttttccataagttattgggggtacaggtagtatttggttacatgagtaagttctttagtggtgatttctgagattttggtgcacccatcacctgagcagtacacactgcaccatatttgtgtcttttatccctcaccctcctcccactctccccaacccccaagtccccaaagtccattgtatcattcgtatgcctttgtgtcctcatagcttagttcccacatatcagtgagaacataggatgtttggtttcccattcctgagttgcttcactcagaataatactctccagtctcatccaagtcactgcaaatgctgttatgtcattccttttaatggcagcatagtattccaccatacatatataccacagtttctttatccactcattgactgatggacatttgggttggttccatgattttgcaatcgtgagttgtgctgctatgaacatgccatgcaagtatcttttttgaataatgacttcttttcctctgggtagatacccagtagtgggattgctggatcaaatggtagttctacttttagttctttaaggaaactccacactgttttccatactggctgtactagtttacagtcccaccagcagggtagaagtgctccctgatcactgcatccacgccaacatctactgtttttttaattattattttttgattatagccatttttgcaggagtaaggttgtatcacattgcagttttgatcggcatttccctgatcatcagtgatgctgagcattttttcatttgtttattggccatttgtgtatcttcttttgagaattgtctattcaggtccttagcccactttttgatgggattgtttgtttttttcttactgatttttttgagttcattgtagattctggatattagtcctttgtcagatatatagattgtgaagattttctcctactctgcgggttgtctgttgactctgttgactgttccttttaccgtacaaaagctctttactttaattaggtcccagctatttatctttgtttttgttgcatttgcttttgggttcttggtcacgaaatccttgtctaaaccaatgtctagaaaggtttttctaatattatcttctagaatttttatagtttcaggtcttaggtttaagtctttaatccatcttgagtgaatttttgtatgagagatgaagatccagtttattctcctacatgtggctagccaattatcccagcatcgtttattgaaagggtgtcctttccctacttcatgtttttgtttgctttgtcgaagatcagttggttgtaagtatttgagtttatttctgggttctctattctcttccattggtctatatgcctgtttttataccagtatcatgctgttttggtagctatggccttatagtatagtttgaaatcagatagtgagatacctccagatttgttctttttgcttagtcttgctttggctatgcaggctcttttttggttccatatgcattttagaattcttttttctaattctgtgaagaatgatggtggcattttgatggggattgcattgaatttgtagattgcttttggcagtatgatcattttcacaatattgattcgacccatccatgagcatgggatgtgtttccatttgtttgtttcatctatgatttctttcagcagtgttttgtagttttccttgtagagttctttccactccttggttaggtatattcctaagtatttttatttttttgcagctattgtaaaaggggttgagttcttgatttgattctctgcttggtcattgttggtgtatagaagagctactgattggtgtacattaatcttgtatctggaaactttgctgaattttttttatcagttccaggacctttctggaggagtccttagggttttcaaggtaaacgattgtattgtcagcagtgacagtttgacttcctctttagcgatacggatgctctcctttctttcttccttccttccttcattccctccctccctacctttctttctctttctctctttctctctttctctctttctttctttctttctttctttctttctttctttctttctttctttctttctttctttctttctttctctctctctctctctctttctctttctccctctctctctctctctctttctttctcttgtctgattgttctggctaggacttccagtactatgttgaagaggagtggtgggagtgggcatccttgtcttgttccagttccgagagggaatgctttcagcttttccccattcagtattatgttggctgtgtgtttgttatagatggcctttattacattaaggtatgtcccttgtatgccgattttgctgagagttttaatcataaggggatgctagattttgttgaatactttttctgcatctattgagattatcatgtgatttttgtttttaattctgtttatgtggtgtatcacatttattgacttgcgtatattaaaccatccctgcatccctgttatgaaacccacctgatgttcgtggattatctttttgatatgttgttggatttggttagctagtattttgttaaggattttagcatctatgttcatcaaggatatcggtctgtagttttctttttcggttgcatcctttcctggttttggttttagggtgatgctggcttcatagaatgagttagggagggttccttctttctctatcttgtggaatagtgtgaaaagtattggtaccaattcttctttgaatgtctggtagaattctgctgtgaatccagatgcaagtccttagtcaggtaggtagtttgcaaatattgtctcctagcctgtagcatgtcttttcatcttcttaacagtgtctttgaaagggcaaaaatttttaattttgatcaagttcaactttttgatttttgtcctttatggattatgttttagtgtcaagtctaagaactttttgccaagctctaattttcaaagattttttttttacttttctaaaagttttatagtttcacattctacatttaattctgtagtccattttgagttcattttttgcataaggtatgaggttcatattttgcctatggatgccaattactctagcatcttttttttttttctcactctgtctcccagtctgtagtgcagtggcttgatcttggatcactgcaacctccaccttccaggttcaagcaattctcctgcctcagcctcctgagtagctggcactacaggtatgtgccaccatgcccagatagttatttgtatttttagtacagatggggtttaccatgttggccaggatggtctcaaactcctgatctcaagttatccacctgcctcggcctcccaaagtgctggaattacaggcgcgatccactatgcctggcctactctagcatcttttgttgaaaaacctacccttcctgcattgaattgcttttgtatctttgtcaaaattatcagttgagcatatatatgtgggtctacttctgggttctctattttgtcccattgatctatgtgtttgtctttctgccaataccacacagtcttgacgactacagccaagttttgggatctcgtagactgattcctcccactttattcttttttcaaaattgatttagttattttaagttctttgcctttccatataagttttggaataagtttgtctacacctacaaatattcttgctgagactttgattggaattgcattaaactgatatgccagttttgggagaattgatatttttacattgtggagtcttccaatccatgaacatgatatgtttctccacttagttcttcttttatttctttcatcaacattgtaaatggcaatgtgctttcatttggtttacacatgttcattgttagcatgtagaaatgctattgacttttttttgtatgttgatctggaatcctgcaaccttgctgaactcacttattagttctaagattgtttttaaattttttagtagtttctctgtagatatcatgtcatctcaaaatagggacaattttatttattccttttcagtctatatgcttttcatttattttcttgccttattgcactggctagaacttccaatactatgtcaaacaagagtagtgaaagaggacatccttgccttgttccccatcttaaggaaaagcattcagtctttcacattaagtatgacattagctgtaaggtttttgtagatgccctttatcaagttgaggaactcctctctattcctgagagtgtttatcatgaacaagtgctggattttgtcaaatgctttctcatgtcaactgatataatcacataattttttatttttcaggcagttaatatggtgaattatattgattgttttgaaaatattgaatcagccttggacacctagaataaataccacttggttttgatatataagtctttttatatagtgctagatttgatttgttgaagatttttgtgtttaaggtcatgagagatactggtctatacttttcttgtagtatctttggctggttttggtatcagagtaaacctgtcctcataaattgagttgtgaagtgttccctcctcttttatcttctggaagatattgtaaaattagtgttaattcttcttttaatatttggtagaattcttcattgagaattctacattagagaattgtactctctaagtacattgagtaccacatcatagggtggtgtaatttttgcttcaaccatcaagtatgatttaagagactccaaggtatcctggcctggagatgtgtttttcaggaaattttaaattatgaattcaaataaaaaatatgaataattaaattttgaaatttaattaaaattattagtagttttgtggttgtaagattattcagattgcccacttcatcttgattgagctttaatagtttgtaattttcatagaattggtcaatttctttctagtttttaaatatattagtctaaagttgtttgtagtagacccttatccttttagtagctgcagtgtttgtagtgatatcccatttcattcctgatgttggtgttttgtgtcttctctcttttatctttgttagtcttgttcgaggtttatccattttattgatattttccaaagaaccagtttttcgttcatcagtttttctgtggtttttgttttcaggttcatagagttctgcacttttttttttattatttcctttcctgtgcttgataaggttctttgttcttctttttctagtttcttgagatgggagcatagacgattcatttaagatctttcctcttttctaaagtagcatttagtgctatcaatttctctctccacattgctttagctgcagccacacattttgatatattgttatctagtcattacattatattcaccattatagtagtgtatttgttctcttttattccttctgctccttgtttcatttttcttacctttttgtggataacttgaacatttttcagaattccattttggcttatcataattttaaaatagtttttcttagttcttgtgtaaatacacatatataatttatcacaatctatgagtatgaatgccttaccattttgagtgatatgtagaaatcttacttccattttggaccttttagcctccttacttttaaaatataattgtcttaagtatatcttctaagtgcattgagtaccacatcatatggtggtgaaatttttgcttcaaccatcaagaatgatttaagagactcctgagaaggatagtctattatttttatccatttcattgtcctttcctttctgaagttccaaactttcttctgttatcatctccctttcctttctgtttggagaacatccttcagccattctttaagggtaaatatgtgagtgacaaaatctcttagttttccttcatcagagaatgccattatttccacttttctcctgaaggatactttcaccaaatagatgacttgtgattgacagctatttcctttcagcacttgaaaaatgtgccacttccttctggcttccatggttcctgataaaaaaaacctgctgtcctttgaactggtgttccctatagataatacattatttctctctggctgttttcaagatgtttttctttcttttttagttttcagaagtttaactatgaggtatcttggcatggatttccttgggttcatctgagttgagattcactcagcttcttgaatatgtaggtttatgtcttttgcaaaattcagaaattttcagctgttatttcttcaagccaaggtgacttttaagcacattgtatatttgagaaacattgctctggaggggggttgagagatccaaggacttctcaaattgtatgcagaatgctgttaagtgtccacagctttcattagattctcaaaagactccatgaccctcaccatacattttataaaagaattggtttatggccttattgagttgttttttgttttcttggttaaaatcagtaaaagcaaacaaacaaacacaaaaagtagttagtattcttttctttctttgtaccacatctgttgaattcctgtttctcaaagattttcctgacaattttggaaaatacgatgactcaggtaaatgttttccaagtgcctaatatgtgccagacaaatatttttattgttttccatagttaatgagaaggagaagaatttaaaacaattaatatcatttgggtttatgaaaagttcttggtaaataagtgctagagtaaaattggctgcttttcagtgtgactttcccctttaaaatctgttccttactgctctgagctggatacaccagcgatcaaattacatccctgaaagtataatttcatacaccgaaaacatgtcattacacagtgggccgcttgtcatcactctggcttgctttgcacagttggtagtccggcactcacggttcccccaagcaggcttgtccctggctcaactgctctagctgattcctccagccagcagaccctcacctcctttgtcaccccttattcctggactaacttttgctcatcttccagaactcagcttgggaagcaccacctctgggaagccttcagtctcttttctccaagcattgagttgagtgtgcctccagggtcactcatgcctgccagaacatcacgctgtatattaattgcctaattgtctctcctgtcagatagtcagacccttggaaactgtgactgggtcttgatttgctttcgtgcccccagtacttttgtaagtataatatgacatgtgtttacgcactatctccagttagagttcacgccaccagctgactgactgactgagcctttcatccatattttcattaatgtcattaagtatctgttgagggctgggcacagaggttcatgcctgtaatcccagcactttgggaggccgaggtgggcggatcacttgaggtcaggagttcaagaccagcccagccaacaaggtgaaacgctgtctctactaaaaatacaaaacttagctgggcatggtgatgggcgcctgtaatcccagctactcaggaggctgaggcagaagaatcgcttgaacccgggagggggaggttgcagtgagctgagatagcaccactgcagtacagcctggacaaaagagcaagactccatcacaaaaataaaaataaaattttaaaaagtacctgttgagctcctttatatataggtgtggcgaccagatattcagttcttcccaagcaggtttaatctttcctcacaagcatctgtttattaattcactttagactttttctgagaattggtataaaggttattggtcttttgctagaattcctatctttccgttttggggaaatatggataacaccgacctctgccattttccttctttgtcttactactggatcttatgaaccctttattattacatttacatgtatagctctgtctttcctattaggctgtaataagctccttgggcagggagtgtatcttattcaacccagagtctccagggaccggtgcaaggtggcattccatgagtgctggtggaaagaaatttgatgttagatcatcacagctatatggttgcttatgattggaacatatgtttcctcatcgtctccatacctttacttcctagttatcttttatccctcattctaagctaccgtgaactcttttttggaaaggagaaatgggtaatgcaacacattttaatgcattttttattcctcccaggtactatcttggtcgtcggatgtttattgttatttctgagccagacatgatcaagcaggtgttggttgagaacttcagtaactttaccaacagaatggtacgtagttttctttccgcatatagatggatggggaattgttctcagatggagacactgcatgtcagatccaatggggatgcaatcaggcctctgatcaggtttatgtcagttccactcaaaactaagctcctcagtgaactcggtttttcaaaagagatctatgggactggtacaaaagagtaacatttacatttaagaaatgcttcaagaaagctaaagctcaagggaagctgaggctattaaaaatgctaaaaccaagagggttttctaaagctgggttcaaagccgggggaatccagagggcacaggccaagtgactgacggagaatgagctaggctaataaatattagttggaaagcaaaattttgaggttcttgcacttacatctttcccagaaagtataagagtattaaggctggaaagggaagtcaagcaaaattaggagagaaatttgtcccctagtaagagaaggaaactttaagagggctcctttacattaggtcaagtctccagcctacatgcatgtacatatccctttgtttttggaaagtaaatgtcctactatttatctttgatgagaaatcccaaaggatgggcgaggtgacagaaaatggcagagatcaggccaggcacagtggctcatacctgtagtccccacactttgggaggccaaggagggtggattgcttgagttcaggagttcgagaccagcctggccaacttggcgaaactctgtccctacaaaattacaaaaattagccgggtgtggtggcacacatctgtagtcccagctacttgggaggctgagacatgagaattgcttgaacgcttgaatctgggaggctgggagtgggaggggctccagtgagctgagatcgcgccactgcactccagcctgggcgacagagacgctgtctcaaaaaaattaaataaataaataaaagaaataaagaatgaaaaaatggcagatatcagtgctaaccattttccaaaaatagggagataggcattctagcagagaagaccagtaacctttacgttgattcttggaaaaagtctaaagtgaattaataaacatgtttgtgagaactcagagaatcaccttgccaaccatttttggggggttccaattagacctcacttttcattcttttagggaagtacgtattcattcttttgttgattatgtggcaaactttttcatacctaccatatgccaggcactgtgtaggtgctgactgtaaagagacagtgtccctcgaggaactctcggtttagtgagggaggcagacaaggaaagggaccagcacaatgcagtgtggtgagtgctcctgaggtggggagcccaggccaccaggatgcagacagaggaaagcttattgggtgtgaggtgcttggggctgagtcttaaagaaattagagaaagtccccctgcctgtgttccgaactaggtgagccatccagagtgtgtccttgtcatcgcaagagcttatgagatgagtacaattatcatctctattttatagacaaagaaactaaggttcagagaggctaaatgatcaaccctggtaacatggcttaacacgaggaagagcagggattcatgtgccatctctcaacttaagtctagagctctttttactgccaaagctgtgacagctgcctcagtgacatttcaggatgtcaaggttgagtggagtaattggccactcacccaaaatttgctcatcttcttccagccccagagcatcatgcccaactccagacatcacgtggcctctagagggatgtggcctggagggaggcggctggcctgctacctccatcccttcaggatggccgaaggaattgcagaagtttaactgcttctctgctgcctctagattctctttcccaaacactgcattgctatctcctcgctcaaagtcccctggaagccgtctgtcaagaaactgattctgattattaaatgcagctgtagcttgttgctccatcagcctcagcaaggagtgctgattaaagaagttggagaagccaataagtcaaagtgcacggaccaccaagccacatcctggcaagcagtaaaggtactcccaggagcctgtcatagcacttgagactgtctgagcccctaagccatgagacggcacttgccaactggtgtctccatatttcctcccatgataccaggacatgtgaccctgagagctgacctagaagaggtcaatgatttggcctgctaggggcagacatactcaatgcacatgtccaagcaaggaggacacaataatattgccctcagctttgatcaatttatcctccaagccatttgtctgccgtttctaatttctttcaccatcccctcacccacccctccacgcagactaggtccagtgccccaaactccagagtagagttccaattttcgtcctcttccactcagcacaggattaagccttcaggactaagttcaagttccctagacgatatttaagggcccttgtgtcttagatccattgtgtgtgctccaccctgtctctcactgctccccaatacaaatcgtcactccagcctctccctgctcaccctcacctgctctggagagacctgacctctgccttgctcacgctgacactgcctcagaattgaaggcagtgtaacagtggggctcatattgattatgacgtgagcttgagcacatatctttttttttttttttttggagacacggtcttgctctgtcacccaggctggagttcagtggtgtgatcagagctcactgcagcctcaaactcctgggcccaagtgatcctcccacctcagcctcctaggtagctgggactgcatgtgtgtgccaccatgcctggctaattttaaaaaaaaaaaatttggcagagatgggggtcttactatgtcgccaaggttagtctcgagctcctggcctcaggtgatcctctcaccttggcctcccaaattgttgggattatagccctgagccactgtacctggccacatttcttaacttaaaaaagagctggggcagctctttttaaaaatatccatggaaagtggagctgaatcaacatgactcagcagaaatggtcacaaccagtggcagaacttcttattcttggcctcctctcaaggcctggagttgggggatatgatccaccttactgggctgtcataaagccacatgggatcatgcatataacctctccctctacacagtacttggcaggtgacacattactgcttctcacaagaaaaccctccacctcttccacacccatccaaactcttgctgttcttcaagacactcctcagatactgcctcctccaggaagccttccctgcctccatccacatgcacttttccccttccctgaactctggcagcgctcaccatgtgtgtcactcgttgtcacagttgatccccttgtgccttccagtatttacagtgaaggaggatatggctttcactctagcttgattattagctctttaaggccaagaactgtatcttgtattttttttaaaccccatgacataaacacatattgactcttcagcatccaatatattcttgttccaactgaatggaatttccatcaacttgacattcctcccagaagaatgaggtattacttgaacctggagttgcaatatagtcttcttcgtctcggtcattcacaaacacgtaaaaagacccatcatagataagatctccaggaaatcccagtgtttatagttttccatctgggaatgcatccacttatgtgtagctttgtttatggtctttaagccaattccatatcgatggtaaaacaacccttagtgactcaattttttaaaaaacagtctttaaagtgggattttctcacaggtttttgaaagtcaaattaaattgggttctgtggttccctcttatccatatgcttatttatctgctcaaagaactcaaggagattagtgagacgtgatttctccttactgacaccacgttgccttccctctaataggccatgtttacttaagcgttcagcaattcagctttattatacattcactcggtaaacattaaatgcttactccatgcaggctgctaccaaacggtcccttgtgatacagaaaatacctcggcatattagtttgataaattaagtgaaaaggaatttaaataatgcatgctctcattctccaacagggagagcccatgtctgctcacaaattcaggcttgagttacgttgagttttgtccctggacagcctggtggagaagggccctgatttgggaagctggatttagctctgaaatttgacatgagccgtaagcatcccatgagggatccatagagcatattcactggaggtgggggtgatgcaacagggagctccctgacatacaacaacattgaacaaatgtgtgaattcaaatatcatcctgtgaaatattcttttccaaactccagaacactggctggagcagactgtgggttggatccggagcggcagttcttaatgtcatgctttcccattcacagtttttgggcctctggagtctgtgcaatgtctctgcttcatcttgctcattttccacgtggaccttgtaggtctctatcaatgtcctcagtgcttcctgaaactgctccatgatggtgcaaccacagcttatcattaaacccaaatcaatcttcttggcacttatagaagctcagtcgtcctggtacatcaggactcggatgtttctatttagatattttcaatgagctcttctttgctgtcaggtacggtacctaatgaaaccatagggcagctcttttttaaatatctgtggaaaatggagctgagtccacatgactcagcagaaatggtcacaaccagaggcagaacttcttgttcttggcctcctatcaaggcctagagttagggagctgtgggaagggtgataagaggtaagccagtctttggcccatgttagcttggtctggtcagataggcatgtcagggatgtgtcaaaacactaagcctagtgctttggagatgtgggttctggtctggagtggcagtatggagtgccatctctcaggtcctcatgagcaacacagaggtcacctctccaggcacaggtcgagccacaccactgacacacaagagtcacgtccaaagccatgtgatggacgtggtgggtggttttatcccgaaccatcaatacccggcaccctggctgccccaggttcagcctctcaggggctgcttcactcgctctccacacagctgtgaacattgcaggatgagtcactgtgaaaccacaaactccttggcattggtgaagatgactaaagttataggcaaattagtcactggaaaccttcctgtcctctgtatctgcagcagcctcctatcgaaggaagaaaagagtatgttggctcattgcagagctaattggcaaggaaagctcaattcagggctacaggtgagtcagacgcccttgtgcgggggccacagggacccgcctgctggcatccattgaggagagaggggcccttggcagacttgccataaaaccgccccccttgaactcattcctacacctgtaaccactgacagtttttgaaaactgttcacctggagttcctggttctctttctcttaaatcaaacattgagtaaatgaagacactcagatgttcaaacatgtgcatcaagattttacttgtgagagtggttgccatgcatgacctagggaagctctcatggcttcagtcaaaccttgccaactttttttagctgtgcatttcttgagaaaggtcaactcacattacgggtctacagctctgagcaagggagaagttcttcctgaaagcacaaacagactacagagggcagtgaaaccagaaacacaggtgtgcaacctcatttgcctgcccccgtctctattttgaggcctctttgttttatgtgacctccgtctccttctctgccgcaatcttcttcttataacacccactttcttcttttaatttccccctcttctaagccatagcccagtggtatggcgaaaggtctttgctgtgcataggaaaccctccaatctgaactggaagcttcctgttgcaggatgggctgccccattggaattcccaggtgacagtcgcaatgggatgcctgtcccctgcaggtctcccatttcacctgcttttctaatgtctggacatggctaagtcctagaaaagccagatccatggcattacatttaatcagtacaacacactgagcttcgtttccaacatggtagctaagttttaattctaacatctttaaaagtactgagtgtcttgtgatgccttgggaacacaggaatagtgttaagtggtgttgattctcaatgctcaaatgtacttctctctgccttgcagagatttttctaaaatttcaagaccttgttgaaaatgatttcatatttttgtgtcttactagactcttggttcagcaggaagctatctttatatatttttttaacaaaaagaaattagtaaaagcttgctctgatatttatgccatatttccctaacttttgtcgtggcagaagtagaaataagtgtgtaaaccaggagattaatatctacaatttaggcatgagaatagagaaataaaccataaaatcaattcttatctctcaatggatatattccagaacattccatggaaatcaagtgactaagtcctgatcctccctgtctttctccgccccaatctccttcttatgacattccctttcttcttcccattttccctcttctaagccatagctcagtagtatggtgaaatgtctttgattttagtttaaagaaatgaaatcagattccagatttgctacctcttattagttgtgtggccttcagacaatcctttaacctcctgattctcaatttcctcctgtgtaaaatacattagactagctaatccctaaggtctgtttggtgcccagttcacgtgaccgttggcagccacagggagccacggagtcccaccagcgtcccatagagccacttggagcttcaggtacaaggaacaagcccctcttaggccccctcaggaaaatttattctcgcagccaagcatgtcaagtgcaatatcaggaacacccttgtccttcttgaacactgcttctggccagaaactctgctgagatctgttggagagtttcctgcaaagataagagttaacaagcccccagattcccttccccgctcaggaggggccctcactgtcagctttggggctgatagaagcacagttccaagcgcctggcttcctcctcctccccagtggataaaatgctggaactccgtcaggcaggactgccataattagaagaggcccctttccagcagctgaagctgactaggcagatagagcccaaatttgtttttagccaccacatgcccctgagctgacccctcaagctgtggacacatctcacaacctcacccggaggccattctctcaggccagtcacactctcccacagagagagcgaagatgatgtcaaatctatggccaccttctaccagcagagggaatgaatgaaaactgacatgtagaagagtaagaccactactgttttcatttttggtattttttttttacattttaatttttttatactctatttttagtaaaagggacacctttactatttcaaaccaccaaaatataagccctatttggttcaaatctttgtacagccagatagcaatagatataaattgacaatggcctcaagtatagaatttggggttatacaagtgacagaattcttgagtctcagttgattataatataatgaggggacagtgccaggtctttcacgtctccaggtgggaaggggacaagttgcacgatggctgtcctcatctgtgcctggttgtgtgagaattagaaacaacgtttgtaacagtggtacctagtctttgtgaccgtggtcctctttttgatattaatatttttgcagactagttggcataaacaagttggctctctgtactcacattacaaccactgaggtataacactatctcttggagtccttagaagcacctcgctctgttcagctggcctctcagccttgtgtggctgtttcagaactgttgatcatctgtcaagtcatcccagagatcatctagatcttgagtccatttcttgcatgttccagaacacaagaaaacatttgtggctatagcttcatattctatcatgcctttcatccctttctcccgataatacatgaacccggttacagcagaaatgcattccatgcatttgcaacactctggaaggagccagtggttcttgtgtggctttaccaggccagtcgagaatcactgggctggtgcatgagaaaccttcagtaagtggctgctgtcttcatgcacccatggaatgccgaggtgttggttttcttcaataacctgctcctcagggcagtgtttcctaattgctggagaatgacccaagagttgatgaaataatatgaaaagtactgtgtttgctgtaagatggacaagtattggtgatataggccaccccactcccaccctccattctttgtcttgatagttccagtcccagtacagcacctggcacacagtagttgctccatcattattcacagcataatcacagacaccattcagagcagagcttgtacagccctaaacataaagtgcagcaaacccagctcaagatcattgaagctagcagccattcagctcctgctgtgggatggccagggagggtcagagactgtggtcttgacacattctgtgtggggttcatccacatcttcctaaatgcccaaggcatggctatttgaagcagagcaagtaaagacaacgaggggtccctctgctgggttttctgtccccctctggctgccagcactaatctagcctttgaagaggggcagaaggggcaaagttaaaccacactttcctctcttacctgttgtcacccctctaatgacttttcactttctctgctcaccttctccttcctgcctcttttagaaatgggaaacaaagggcccataggccctaaaaggggccaccctttgaaggaggagacatgaccacaaatgtcaccctttgatatcctaatgggatccatgttaaaaaaggaagtttttaacctggtctcagaggacacttgcaagagatgccaaggaaggcagtgtgatcatcccaagtcaagcagcctaacgtgagcctgtgagagagaaactgcaatccacccgcaacgtgtggtcatcaaagggcggcaaccccagttaccagcttgagattaaaaacccaaattaaaacagggccaaaggattcctgtcagctcttaacacctctcttaaaatgtgaccactgtctgaaaaccattgtttggctgatgaggtctaacttcattacacatcacagtaggacactccttcctgagaccaggcactgctcccatgagtgcagtaggacagacctcctctgttcctgacgatgataccccaatacagcccgacaagcgtgtgctcaatgaaggttcccagatctttttaatgcgactttttgcaggtcaggttgcttccatcacatgcactgaacaaccaaattttaaacctaaatatgaaaccttgtagttacatctgttgattttcgtcttgttagtgttcatccagcattcaagtctgtcgaaattaaatgtttattattccttagtatttttttaaattgaagtcacttccatacacaaaccttgagtgtaaagctcaatgtattattgtctatgtattcccctatgtgacaccacccagatcaagacacaaacatttccaacactccagagggttccctcatgcctcttctcagtcaacccatccctaccatccagaggaaaccactcctctgacatcaatttgtatagatttctcttttcctgctgttgaacttcatgtaaatgtaaacttacagtatgtatccttttgttctggcatcttttgctcaacataatgtctgtaagagtcatccataccacgtatttagattaatatagccaggtgtggtggctcagtcctgtaattttgcactttgggaggctgaggcaggaagattgcttgagcccaggagttcgagactggcctgggcaacaaagtgagacccctgtctctacaaaaaaaaatttttaaattagccaggccccgtggtgtgtgcctgtggtcccaggtactcaggagactgagggaagaggatgccttgagcccaggaatttgaggctatagtgagctatgatcgtgccactgcactgcagcctggggacagagcaagatcgtgaacatagtttgcatttttcattgctatgtagcattccaatgtatagaaacaccacaatctattcctctgtcaataaacatataggtttccagttttttgctattatgaattaggttgttatatcaacaggcatttatgaacacctaggagcagcatcgctagcccacgagagtaggtgcatggtgggtttttgtacatactgccaaacagttttccaaaggggttgagccaatctatactcccataaagtggagttctagttgttccagccttagccagcactttcatcttgccattatttttcactgtaactattccaggggctgggtagtagtggtatctcaccacagttttaatttgtatttatctggtgaccatgtcattgagaactttttctttttctttttttttttttttccccgagatggagttttgctcttgttgcccaggctggagtgcaatggtgtgatctcagctcactacaacctctgcctcctgggttcaagcgattctcctgcctcagcctcccgtgaagctgggattacggacatgtgccaccatgcccggctaatttttgtatttttagcagagacggagtttctgcatgttggtcaggttggtctcgaattcctgacctcaggtgatctgcccaccttcacctcccaaagtgctgggattataggcgtgagccaccgcgcccagccgagaactttttcatatgctctctggccatttgaatagtctcctttttaacaacgtgcctgttgagtctttgccccctcccccacttttattttaaggtgtttgactttttctgattgacttgtttttctttgcatgttctgccttgagtcttttgtcagataaatgtgttgtgaatatcttctcccagtccatggtttgtgtgttattttcttaataatatcctttgataataaagtccaatttatcaaaatcttcttttgtggtattgcttttggtattctctttaagaactcttgccttatatacaaggtcacaaagatattctcttggaatcattatggttctacctctcactattgggactatgatctatctccagttaacttttgtgtatagagtgaagtatggatcaaagctgattttttttctctgtattaatatccaattgccccagtaccattgttgaaaagaccacccattcccccttgaatagcacctttgtcataaatcaagagatcatatgtgtgagtctacttctggactctgtcccatttcattggtctttttgtttatccttgcaccaatatcacactctcttaaatagcatagctttatcattgatcttgaaagatggcagtgtggccaggcacggtggctaacgcctataattttgggaaggccaaggtgggggaattgtttgaggccaggagtttgagaccagcctgggtaacaaaccaagacccagtctctactaaacaaatatatatatatataattagccaggcatggtggcgcatgcctgtagtcccagctactcagaaggctgaggtaagaaaattgcttaagcccaggaggcgtaggttgtagtgagccatgattctgccactgcacttcagcttgagcaacagagcgagaccctgtccgagagagagagagagacgcaagagagagaaacagagagagatggcggtataaattctcgtggttattctagttcttttggttccatatatctgtttacaggaatcagcttgtcaatttttaaaatgtttaatttttgtgagtatatagtaggtgtatacatttatggggtatatgaaatattttgatacatgcatgtatcatgcatgcatgatacatgcatgcaatgtataataatcacatcagggtaaatggggaatccaccatctcaagcatttttcctttctttgtgttacaaacaatccaattataatcatttatttttttgccctgtcttatggtgctgatctttcggttattttaaaacctgcaattaaattattattgactatagtcaccaaatactaggtcttattcactttttctatttttttccacccattaaccatccccacctccctcgacactctttcactactcttcccagcctctggtaaccatcattctactatctccatgagttcaattgttttactttttagctcctacaaataagtgagaacatgccaattttgtccttctgtgcctggcttatttcgtttaacaaaatgacctccagctctatccatgttgttgcaaatggcaggcttttattcttttttatggctgaattgtactcccattgtatatatgtaccacgttttctttatgcagttgtctgttaatggacacttaggtgcttccaaatttggctcttgtgaatagtgctgcaataaacatgggtgtgcagatatctctttgatatactgatttcctttctttggggtatatacctagcagtgggattactggatcatatggtagctctatttttagtttttttagttttttgaggcgcctccaaactgttctccatagtgattgtcctaatttacatttgcaccaacagtgtatgtgggttcccttttctccacatccttggcagcttgtgttattgcctgtcttttggatataagccattttaaatggggtgagatgatatctcattgtagttttgatttgcatttctctgatgaccagtgatgttgagtaccttttcatatgcctgtttgccatttgtatgtcttttttttttaaactgtcgattcacatcttttgcatgtttttttaataggattattaggtttttttcctgcagagttgtttgagctccttacatattctggttattattcccttgccagatgggtagtttgcaaatacttcctcccagtctgtggcttgtctcttcactttgctgattgtttcctttgctgtgcagaagttttttaacttgatgcaatctcaatcgtccatttttgcgttggttgcctgtgcttgtggggtattactcaagaaatctttgcccagttcaatgtcctagatattttctcaagtgttttcttttagtaatttcatagtttgaggactcagatttaagtctttaatccattttgattcaatttttgtatatggtgagagataggggtctagtttcatcattcttcatatggatatccactttttccagcaccatttattgaagagactgtccttttctcaatatttcttcttggcacctttgtgaaaatgagttcactgtagatgtatagatttgtttgtgggttttctcttctattccattggtctatgtgtctggttttatgctagagccatgctattttagttactatagctctgtcatataattagaagtcaaggattgtgattcctccagttttgttcattttgctcaggatggctttggctattttgggtcttttgtgtttccatacatattttaggattgttttttctatttctgtgaggaatgtcacatagagattgcattgaatctgtagattgttttaggtaatatggacattttaacaatattgattcttccaattcatgagtatggaatatctttccattttttttgtatcttcaatttcttgtatcagtgttttacagtcttcattgtagagatcttttacttcttcagtaaagttaattcctaagtatttcattttatttgtggctattgtaaatgggattgctttcttggcttctttttcagattgttcactgttggcatatagaaatgctactgatttttgtatgttgactttataccctgcaactttactgaattcatttatgagatctaatagcttttcggtggagtctttaggtttttctaaatgtaagatcatatcatctgcaaacaaagataatttgacttcttcctttctaatttggatacgtttatttcattctcttgactgattactctagccaggacttccagtactatgttgaataacagtggtgaaagtgggcatccttgtcatgttccagatcttggaggaaaggttttcagtttttccccattcagtatgatactagctgtgggtctgttgtaaatggcttttatgttgattgatgttccttctatgccttttaggatttttattatgaagggacgttgaattttatcaaatgcttttttagcatcaattgaaatgattatgtggtttttgtccttcattccattgatatgatgtatcacattgattgatttgtatatgttgagccatgcttgcatcccagtgataaatcccacttggtcatgattgatctttttaatgtattgttgaactcagtttgctagtattttgttaacgatttttgcatcagtgttcttcagggatattggcctgtagattttttgtttgttttgttttgttttgtttgatgtgactttgtctggttttggtattagggtatgctggcctcctggagtgactttggaagcattcccttctcctctcttttttggaatagtttgagtagaattggtattaattcttctttaaatgtttgataaaattcagcagtgaagccatggtgtcctgggcttttctttgctgggagactttttattacggctttgatttcattacttgttattgatctgttcaggctttggattagtgattcaatcttgacaggttgtatgtgtctaggaatttatttcttctagattttccaatttattggcatacagttgcccatagtagctgctaatgatcctttgagtatcagttataacatctcttttttcatctctgattttatttacttgagccttctttctttttttcttagtctggctaaaggtttgtcaattttgtttatcttttcaaaaaaccaactttttattttgtcgatcttttgtattgtttccttcatttcaatttcatttatttctgctgtgatctttattctttttttttctactaactttggctttagctcctgcttttttagttctctaagatgtatcattaggttgtttatttgaattttttctacttttttgctgtaggcacttataactataaattttcttcctagtactgcttttgccatatcccattagttttggtacattgtgtttccattataatttgtttccagaaatttttcaatttccctcttaatctcttcattggcacaatggtcattcaggagcattgtttaatttccaattaaacaattggaaattgtatagtttccaaaattcctcttcttattgatttctagggtttcttttttttgttttttgtttgtttgttttttgtttcttgagacagtctcactctgtcacccagactggagtgcagtggcatgatctcagctcactgcaacctccacctcttgggttcaagcaattctcatgcctcaaccacccaagtagctgggattacaggcgtgcaccaccacgcccggctattttttttttttttttccgtacagacaggatttcaccatgttagccaggctggtctcaaactcctggcctcaagtgctctgcctgcctcagccaaagtcctgggattacaggcatgaaaatagacacacttttgtgtatctattgtatgtttttagatttgaagttatcatatcttgcaaataatcttgtaaaccattattttaaactgacaacttaacactgattgcataaacaaacaaaaataaaactaataaaaactctacgctttaacataatcttcccactttttaactttttcttgtttatatcttattgtactgtctatatcttgaaaagttgttgtagttattattttcaattggttaatcttttcatctttctacttaagatatgagtagtttacataacacaactacagtactataataatcttgctaagttttgaagaattgacatcatgacaatgttgaattttccaaactatgaatgtggaacctctatatatttaggtattttaaatttatcttagcaatattttgtagttccagactacaggtcttttgtacatctttagtcaaatgtttttgtaggtatttaatagttttactgttattgtaagttatatttttaaaatttcatttttcagtagtttgttgcccatgtgtagaaataaatttttgtatattaaatttgtatccaacaatatttttaagctcaatattgaatctagaagtttatttatagagatttctcaaattttctatgttagacaatcatgccatctacaaataaatagagttttacttcttccattccaatttttacaaattttatttatttttcttgccttattgacctctctatgatgtcaaatagaagtgtaatagtggacatagttgtcttgtttccagcctcagaaagtgttaactatttcactgtttaatataatgttaactgcaggtgtttttgtaaatgtcatttttaggtgaaggaagtctccttatattgatagttcactgaaagttgttattatgaatgggtgtcagtttttatcaattttcttctgcatctcttgagattgtatatgtttttctgttttattctgttaatgcaacaagttacattgattttcaaagttgcattcttggaataagtcccacttggtcttaatgaattattcttgtaatttatcactgagctatattacctaatattttgtttacgacttttgtgtctatgttcacgagtgacattggcttataatttttctttcttgtaagtctttatctggtttggggctcagtttatgctggctcatgagatgatccagattaatgttaaatcgtgactctgtgcacattaactattctcagctgtgatttctgcaaatcagtagttcattatgaaaataacaaataaaatgttcgattcgactgggataagtgtagaaatctgtgggtctctatttgattccagattaatagagttttatttgtctttggtgttctgacagccatgaaaccaccaacccgttgcttctcctctttccccataagaatgtccttggaaatcacaaaatgttttgtttcccacatctatagatctgtccctatgtgggggaaagaaaagaatgagtaaacattacttctcagtgaacttgttcctaaggatcacttttttaaaaaatcttttttaaatgggagtaagctgttatctgcacaaagcccttggggtgaagtccagtcaacagggcttcccttaggagatgttctctaaactgtgttcatgaaagtgaataagagttagcaggcaaaggagaaagggggttggagagggatctagagtttcagagaaagagaaaaacagctcacgagaaggaccacaccctagagagatgacatggtcaagggtctaacggaataatgcgacatcatctcaacactatgtgccaaggactgtcctgaaagctgtgtcataaataaagttttggtgccgcaaaagaaatagcactcaaatataaaattttctttttaattctcagcaaggcaagttacttctatagaagggtgcgcccttacagatggagcaatggtgagcgcacacttggacaagggaggggaaggggttcttatccctgacgcacgtggcccctgctgttctgtcgttcccctattggctggggttagaccacacaggctaaactaattccgattggctaatttatgtgatggagtgatggctaatttagtgatggagtgggtggtttcgtgggaaaaatggctatgacagagcatgtaataggaatgagtcagggtggagcaggtgattggaatgagtcagggtggagcaggtaatcgaaaaaggttgctttatgaggaagttaagtttaaaagtagaaggcaaaaaattgaacatactgacatattgattctttgaaaagaaatttagaactcatatctaacagctataaatgtattaactgcattcatcattccgactgctcagtccaaaacccttggagtcatccttgactcctgtctttctctctcccacctcatatccaatccatcaggaaatcctgttggctctaccttcaaagcatgccaggctgatcatttctcccggtatctgtgtccagctccctggcctgagcctccacccccgctctctcctggccactgtgcttcctcctgacggcgctccctgcctccactctggctcctcacagttgattctcaacaccaaacagcgagattctttaaaacagaagtcagctcaagatatgtctctgttcaaaactctgctatgactacctgtgtcttgtggagtacaaatcctaccaagattctggaggccctccacacacaggcccccatgccctctctggcctgcctccatccctcccctccagccgcgccacatccttaagggtcctcacgcacatgatgcctttgctgtaatggttcccatgcccaccaaacccccagctccttcaaggctttgcactaatctcacctatgcaggagcccagtgccaactgaccaatttaataacacacctcgccccatcccactgtaccgtccagtgtatttctcatgcttattgtccaccttctcccactagaatgcaagctctgtgaggacacggagcttcattttgttcacagaggtatcctcagcacctaaatcatggcctagcacataccaggcactgaataaatatttgtgaagtgagtgaagcctcacaactatcctaagaggtcggtagcgttattatccccattttacagattgagaaactgtagagaggtcaaaccagagaggtcagctctcaaagtcacatggagccaatatttgaacccaggcatctgactctagaggcaatgttcttaaccactgcattatcctggcaagcccaaagtagcaaatgcaacccgagcttccagaaggccctgtgacttcagactatataagggattgggaagttaaggcactccttcaggctttgtgttcagaaaggggtggggaactggccagcacataccaggcctcataaaacaagttagggagtttgcaccaggatagggctagatttgtctttagaaagatcccactgactacagggtggagtacggatgggtgtgacaaggctgcgggcagggaaatcagttaggggctgagataatggtgacctcagccagggtggcagctgtggggatggaaagagttggccaaagagagatttaataattgtaactgacaggattgtagttgagagagagagaacaactcctaggtttggggtttgggttagttttggtttttcaagcttttttgactatgatctacagtaagaaacacattcacattttgatacagaatacacacacacacatacacacatacacacgcatacatgtacatacacacatacacacacatgcatacacacacacacatatcttgaacaagttcaataaccacagaatactttccctgacgttaaatgctcctctgtgtttcctaatcttgtctatctcttgtctctttctctcctttttttaaatgctggttgccactcatgacattgatttcatgactgatcatggcttgcagtctggaagcccttgaccagagagtgattggaggcttgggacacagctaggctgacagacaggagcctcgaaagctgtgtccctggacctcctttctgcagagtccccttcctgcatgacatacacagtctggctcccatcacacttaccagtctcgttactcattgaattagtccattttcacactgctgataaagacatacctgagactggcaatttacaaaagaaaggggtaatggactcacagttccacgtggctggggaggcctaccaaacatggcagaaggtgaaaggcacgcctcacatggcagcagacaagagaagaggacctgtgcagggaaactcccctttataaaaccatcagatcttgtaagacttattcactaccacgagaacaacataggaaagacgtgaccccatgattcaatttcctcccaccaggtccctcccaccacacgtgggaattgtgggagctacaattcaagatgagatgtgggtggggacacaaccaaaccatatcactcattcctttggggaaaatcctttgtctctttcaaggcatctctcagtaagtctcatcaatgaatatatgtggacaagcaggaggtgtggaggggtcatggaagctattgtttaataggcacagagtttcacttttgtaagatgcgaaaagttctgtggaggaatgctggtgatagtagcacaaccatgtgagtgtacttaataccaccaaactgtactcttaaaaattattaagatggggcacctgtagtcccagctacttgggaggctgagacaggagaatggagtgaacccaggaggcggagcttgcagtgatccaagatcgcaccattgcactccagcctgggcaacagagcgagactccatctcaaaaaaaaaaaaaaaaaaaaggttaagatggtggattttatgttacatgtattttgccacaattttttaaatcaatgtgtaggcaaactaatagaaaaaagagtgtctggagtggctttccagacatgaagtctcagggttgaaagagtccttggaaggcttttagaccaaacccctctgcatgctcaagccttgggtacaggatttctaagaagtggaacagtctccaggggtgtggagctcatcgctcaaggcaggttatcttatctgaataattttgtctgttgactattgggatagttctccttcagatgagctgaaattttctccatagcttcctctattaaacccaattccacttctcagggtcacaaaaaaaaaaacaaaacctaaattccctctcccatgcagtatgtattcaataaatatttattaggcatatgcctaagtaccactgtctgatcttccaaatcttctcttttccagttaaaaattccaaatctgacaactatttcttaaatgacatgattcaatgtccccttaccatctgactgctcttttgaaatcatcaatttcctcttattgtgggacatctataaacaaaaagaggccaggcacagtggctcatgcctgtaatcccagcactttgggagaccaaggtgggaggatctcttgaggctaggagttcaagaccagcctggtcaacatagtgagacaccatctctacaaaaaaacttcaaaattagctgacatggtggcatgtacctctagtcccagctactcaggagactgagagggtaggatcgcttgagtccagaagtttggggttccagtgagccacgatcacaccaatgcactaccgcctgggtgacagagcaagaccctgtttcaaaaaaaataaataaaatgttttcagaaataaaaacattacaataatcaatagccccaaatgatttcatcaaaaaatgggagattctaatggaatttccaggcccaagtgagcacagtgtcatggcatgctggtgagaaagatatgtgaaggccatgctgacatattgcaaggaggactacatttgtctttcaggtgcaagacaaaaaatagtgtaaattcacccttaagtcttaaggataggtacgagatccaatcagccttcactcttatctctaatttattctgtctcatcagaaccagaaaacatcactgcactttccttggaggtaagtgctttattccatgtagtgtgccacaggactgcatcttgccactacataaatacacataatatatgatttcctccttcaactctggaacctaaacaaatggattatgttccccaaattccataaagccataattctgttgagtggccatggcgctcccaaagaatttctttctaaatatagagaggtattcctctgcagaaaaaaatatcccagcatcttggttctaatatataattaactcctctctagatactttgcagttacgttttatggcttattttgagtgttcatattttatcagaaaattataattttcctctaaataggagtttttacaaggcttttgaattctgatgactggcttcatgtttcagctataattaaaacagtgaaatgaaatagcatcaccatgcatcacatgtggttctgagactgcttggtcccccaaccgcctgtctccccacaccccgcaacctgcaggctggggacactctgaccaatggtgggggctccagttttgaccacttagtgggacagctggttttagaaagaaacagaatggcctgagaagaagggatgaggagaccaaagtcctcacctcggagaagcctcccaaatatgtcccccaccgatgtcccaccttgccccattttccttccaggaaaatatactttctccaagaaatacactttccctccaggaaaattcactttccatctagttgttagcttatgagcttactctctgcttcccctctagactgccaactccatgagggccaatgcaaagtcttttttttttcttttgttttttttgagatgaagtttcattcttgtcccccaggctggagtgcagttgtgtgatctcggctcactgcaacctccgtctcccaggttcaagtgattcttctgcctcaacctctcaagtagctgggattacaggtgcctgccaccacgcctggctaatttttgtattttagtagagacggagtttcaccatgttggccaggctggtctcaaactcctgacctcaggtgatccacccgcctcagcctcccaaagtgctgagattacaggcgtgagccaccatgcctggccgcaaagtctttttcattcaacatggtatagacaacttcttgaaccccgtattagtttgctaggctactataccaaccaaccataggctgggggtttaaacaatagaaattgcttttcccacagtgctggagatcagaagcctgaagtcaaggtgtcagcagtgttggtttctccggaagcctctctctttggcttgtgcatggctgtcttctccctatatcctcacatggtcttccctttgtgtgtgtctgtgtcccaatctcctcttctaataagcacaccagtcatgttggattagggcccaccctaatgaccttattttaccttaattacctctttttttgagacggagtcttgctctgttgcctaggctggagtgcagtggcgcaatctcagctcactgcaacctccgcctcctgggtttgagcaattctccctgcctcagcctcccaagtagctgggattacaggcacccactaccacacctagctaatttttgtatttttagtagagagggcatttcgccatgttgaccaggctggtctcgaactcctgacctcaggtgatccacccaccttggcctcccagcgtgctgggattataggcgtgagccaccactctcagccttaattacctcttcaaagaccttatctccaaatacagccatccctcagtagctcgtgggataggttccgggacccacccttgctcaggacaccaaaatttgtggatgcttaagtttctgacataaaatggcatagtatttgcatataacctatgtacatccttctgtatgctttaaatcagctctggattacttataatacctcatacaatgcctacacatcactttatgtacatggattcaatgtagttctctggacagagcaaattcaagttttgctttttggaacttggtggaattttttctgaatatttttgattcagaattggttgaatccacagatgcagaacgcccagatatagaaggctgactgcacagtcacattccgaggttcttggggtcaggatttaaacatatgaagtttggggtggggggccgaattcatcccataacacagtattaggctatcaaccactgtttgctgactgagaaaaaaatgaatgaccaatagaacacagaaacattatggcaggcatgctcctggaagcagttctcctggcacacgcttctgaaggcctttcctttttcccccttccctctccctccacccatacaagggtccagacgagtgagtcttctgtcaacttcgggtccaacctaaccaatccagtcacacaaaaccctgtgccatgaacttcagacatgatactaattcccaggaaagactaggccatctccaggaagccttccttgtttgtcttcagggaacccctgctcagtagggggactgcagaacacacagaagccattgagttgtctctatgatgatgaccacatcgcagcagggtacagctgagccaccagagcttgcccatctgctccctctgggccccgccatgattctttctatcactgcctgtaagcctttatagtcttcctctctctccttgcaagagaaacctcctaacttgttggccactgatggactttaaccagggtgtttgtcatggacctgtattgccaccaaggtggctttggctccctgagtcctgaccctctgcttgttacttcccaacaggcgtcgggtttggagttcaagtcggtagccgacagcgttctgtttttacgtgacaaaagatgggaagaggtcagaggtgccctgatgtctgctttcagtcctgaaaagctgaacgaggtaagacatgagaaatgcaaactctcttctcttacggagcaggtttcttctctccaaatcgtgatgagagccagttcatgttgcatcacttgcccaggtgacacatcaaaatgcctttcccactgggaccttcagacctctctgttatgcagaaagcacgggactctgtgttgagcgtctttcgtctctccagcctcccatatccccacttgccataaatgaactgtgagtcaacaagtacacagggcattcgcctgtgtccagagacagagcttgaggtgctttgggggccccaggagacaactgcaacagtgtctgttggactgtcatgcataatggatcacctagggatctggctacaaagcaggctctgattcaagagggccagggtggcctaagaatctgcatttataacacccggccaggtaatttcgttgttactggacaatgaaccacactttacatagcaagaaactagagaacagcatgaaacaaaggtgacctaccaatcaagtcttaaatagggaggtgattgcagtgaatgactggggaggagtgggcgatcatgtcaggcagggacacccaggttaacctctaggccaagttcaagggaagggcaggctccacaggatgctaccagctctctaaggccctggacactctcctttccctactgagtgactcactctttcctatcagctgtgcacccaaaaccgggtgtttgtacagcctccagaccaatttctcacacaacagatcctgactgctgtgttttgtatctaagcctgacagccccctcaattgctggtctggctttggtgtttgctgttctgaattgtgcaaccacaagggagagagaacttgagcccttatgatgtgaaggggctaaggggcttctttagttccagtctcaggtacacaggcatctctagagcaagggagcttccaaagcttggcttgagtgccctgggcttctgccatccaccctgtctggatgttccagagtagcctgtcttcagttcaataaaaatgaaagctacttttagcttaagctcaagatgctcatccatatggtcctgattgaattcctataaatcttctgaagtcccccagaagaggagggggttccacacctcattatatccaattaaactcactcagaagctagtgatccccccatttttatgaggttttgatttgcatttccatgggtagctgttggtgtttgggggcagagcctgtctctgtatgcagcacctgctcacactcacacagctcagagtcaggtaccaagggttgcctgtttagactaacacactgcctcttcaccacattcctgcgagataaataccatcatccttattattaccatcccattttacagaggaggaaactaggcacggagagattaagtagcgtgctccaagtctcatagctagtaagcagcagagccaaaatcagaatccagctccggagcgctcttcacctctctgcctgactgcttgctacctccatgtgattttccagtggtgctcggaggccacgtaggactgtgccaggggctgtctggaggatgcaggaaggggaagtgtagcaaatggggcctcggtggaaagctggggggtgggggagggtcagaagcaaaacttctctattttctgcctaagtttggaaccaactgaggtatggaaagaggttttaggcaaaggaaataaaattttctcttatcttactggtaaagctgtttgaaaaatagagtccccatctgatcacatgggcttgctatgctaatacttcacccagaatgggacaattgcaggggggtggcagatgccatcggggctggcccgcggcccacatgtgctcaattccttcctccaagactgggtctgatacagtgtagacagcaggagatggagagtgacttagatgcagcggttggccagtggggcccaccgggatcacttggggggctttgaaaactgttgctgcctgggtcccacacctagaaattctcattcgcttggtttgctttgggatgcagcctgggtttgaggatatttttttcaggctccccaggtgattgtcacgtaaagccagtattgggaaccaccaccagtagaagttccccacaaggacatgagaggaaaggggcacctgcttccactgcaacaattagccctgctcacattgatctctgttatctattgaggattcacaggagaatgtgaaggaagggcctgcatcttaaagctagaaaccactgctctaaaccatgtagactagctgcctggagtgtgcccctttatcacatccagccactaaaaggttgagtcagccaagagaagaccgggggaagagaggagaggtaggtgagcctagggctggcatcactagcgtatatgtctgtattcaaaagcaatggcttcatggcactatagaagtagaaagaacctcatgtgtgaaaaagaaattggtaaagagtatctgagaaaagaagaaaagagaaagaagaaaaggaagcaaggaaaggaaaataaggtttagcagtcctgggctatgattctttgataaggaattttatcatggtctagattcctttaaccccttacaggggatactccagaaagtgacacattgtcgtttcccaagcaaatccagtgctcctggagtccagtcttctccctctagtccagaaatcaaatgcatagtgcctgaattaattgcagaaaatagagttcctcaatatgtccacggcattaagatgccaagagaagccaggcaaggtggctcacgcctgtaatcccagcactttgggaggccgaagcgggtggatcacctgaggtcaggagttcaagaccagcttgatcaacatggtgaaaccctgtctctactaagaatacaaaaagtagccagtgtggtggcaggcacctgtaaccccagctactcaggaccctgaggcaggagaatcgcttgaatccaggaggcagaggttgcagtaagccaagatcataccactgcactctagccttggtgacagagtaagactccagactccatctcaaaaaaaaaaaaaaaaaaaaaaagccaagaggtagagagagatttcatagagcccattatttaccatacactatcaataaccttgaaattcccttgaaaggcatttttttctactccatatagttcaatttaggttcttgggtttgcgtttgaaaggattccatcccagaggcaggagaagttaactttttccccacctctggggattttagacctggcgagttgaagtttactggaaggcccctaaggagacccttcaagaagaagttggctgtgcagatggcactcaggtgggagggggaagaaagatggtcttcaaaacacagagacgtgtagcatatgtgttagatatggttctggggagaaccatatttaagggaggagcggaggagaaacctataaagaagactcaggaagaacagcctgaaatggaaaccagcagaatgtggaaggggaaagcatttcaaagaggaaggagcagccagaggtgttaaatgctgctcacatggaaagaaacacgaggacgaaaaagtgcacagcaaagataatatttctgaaacgtgaaaccaatgtatgtctgtttcatgctccatagatcgtgttccctgtaattttcccgcacccgcggaatcaatggcaccagtgggtgctcctgaaggtgcctctgaggaagacagtaggtgccatccagaacaaggaagtagttgcttgattttgaactgtacgttagcaagctttattaggagaggaaagagttttcctaattccaaaagcagctcccctttgcatatgaagagcagagggtttgaggctctaagccatggtgtagacaggatgcaggaaatgacaggggggctgcttctgggctgtggaagatgggtggaggggacaaaatgagaagtgtcctatattcctccccaaaacctcctggtttctggatgcttcctcaaactttaatctcccagctgcctttgttctctaagtcactggttctcaaaccttgtgggaccaagggctgcatgagaatcacctaggacccttgttaaaaatacataatttcagccacctcaagatctatatagtcagaatttctaagggtaactgagaattcgcatgtcacgagttccctggaaagattctgctgagagccagcgtggaaagccccggcacagtgagtgttcctgttggtcctctctctgaccacctcagactgactacatctccaggctcgaaggacctggcccctgaacccccaccctccactgctttatttttctctgtggaactatcaccagctaacattccattttgtttacctgtttattgtatgtccccttctgctagatggatgcttcaggaggacaaagtctttttgcttttttcttattttctttattgttaactgcacacactaggtacataatagacattcaggaacaattaatgaatggatgtatgaagaatcaaagaaccgagaagctttctacctattctgcctaaggatacatgatgaaactaagctaaaaaaatgaaagggaaataattctatcaagaaaaaattaaataagaggatacagcaaactggcttttcctttagagagtcaccaatatatacacatatacgtatacacatacaaaaagtcacagacacaaagagggaaatgagccacagtgttaggagatagctcagagactctgagccacagatactcggctgtgggtacctgagtcagttttcctggaaatagctttgaaataccagcatctctagtcctttctgaatttgtaagtagtctttggacttttgttatcaaacatcagagtttattcttgaaataaaagtttgtttccccttggaattctgaggctttctcctttagaaccttggcagcctaagtccctctctacctgtgtctttaagtatggtcaatattcaaaagctttggatggcgttgtcttcgtttatgcggatattaggttgcctcagtcaacaatgcttgaaaatggctttaaaatgagcatcatatcatgaagccatatttgtatttaaattaaaattgtttttttttttggtctatgtcataccagggataatatagagcaacagagaaccagggaaaatgtgattcatgcatctccaagtcaggaaaaagagactattggaatcatagccagcgacaaacaagttattgggatttatagaaaaggatggctgagcattcctggaaaaacaactgactttttgttgttgttgctgttgttagggaagattttgtctgcttaactggccagagttttcactccatcccccgaagaattgacgttttaaaaagcacaactgtagatttagattttcacagtcttttgctagattctttaccaaagactattagtgagtagtaaccctgggattgtataaaactttattaaggatgagggaataaataggtttaatttcaggaaataaaactggggctaaattagtacttctctgacggaaaatgtataaataatgtgatcccctggggacccaggttagcactagatttatttttaaattttataactcatctgaaagagagagaacacagtggaatctatatatttgtatattcctctaagctgttctgatttgaaagatattaaatcaataggaataactttctgagactcttgtaagattgcataagtcagcacaaaagtggcaggtaaccttcagtgtaagcaagaataaaagaatacatttaggagaaaggcatctaaactgtacttatatgatgatgaatttcaagctatgaattactaccagggaaaaggatttgaaatatggaggaccgaaaaggccccatagtcaaataatttggtgaaatattacaaactatattcttcaagattcaccatgtacctgagcatatgaaaggcttgagaaaggcctgcagtaaagaaacctgcttaactttgtttattctgggctcaaataggttttcaaaaggagagaacgtgggttgttaacttcctggttggctactgagagaaatgagtctcttgagcaattatcctttgcaggtagcttccatgaagaacccagtttttgagtgcctctagcagagactaagcttcaaacctcattaaccatggatccaatccaatatggcagcttgtatgttctccattctcaaagcccaatataaatgatgggctttcttcattcacccagataactaagagctgatggtaccccattgagcagatatgggagacaatgaatcttcatagatgagtgcctaaggatatatgtgtcactcaagagtaaatgaaccaatcatgttgctatgcatagggactcagttaaagaaaagtcagataaaatgggaggctggtatctcgcacagcactgatccggctctctgcctaatttttcacttttcatccagatgttccccgtcaagaaggcacagtcaataatgtatgaatcttaaaggcagaggcagatgtggttattactccctgtaggcatttcctgacttggagacgacatgttactcgagaatgactacaatttttaaaaatttaagttgatatagcccgcttatgagtaaatgcatttcagtgcaaaagtcttttcagaattacagtcatcatcacagtttagtttggcctttaaattttcactgtaaactctccagatggtcacatatgggggcttctaaggcagaacacgcttcccaataacattagagcaagcagccttctctaggaggcatccatttccagcagtctatttttaatatttgcttttatttcttaatcctcctgaacaataaaaatgaacgtcattataaccaagtgtggctgtagtcatcaatacttcagagtccaaaaatacattggccttgcctgaccagttgcccattttctggaatagctgggtatttatctagcagcgagagaccattatcctgagacacagtcgtgttccaccgacacctgatctactaattaaaatcactatcatgatggactgtttaaattctggtttaaatgttccttttgcatttgcatttaaaagaaaacacactcctcatcatgggcaccccagcctgggttataatttggctttcctttgccagaattataatgtcactctgacttgccgctggttaaatctaaaagagcatctaaatgtgcctcacagcttggctgttgcttggcaacgccagcagccacctcctcattggggtgacttctaattggtcacaagtcttgacaggagccactgacttattagaaatgacacttgattattcacctagatggctagagctgatacttagcagcaggaaattttgcataaaaaggagtcgtggatgtttttaatatctgggtggcttttagcgatggtgtagtggaagaaggaagtgataagtttcattagtggaaattaatttttcatttgttggtcaccagtttagagcactttaaggcattaattttttcatttttaaaaaaaacccagaaatacgtttaaataccttcccccacccccagcagctgacccttacttattcagaaaaccctcctctgacatcagccccaaaatattgcccccaggtccaccaagggccaaatcagatgaaatgttcaatttataaaggtcaacaaatatttattaattagttcctgttgttaaggagtttataatgtagaagagaaacacggtacataaatcactgcattattaccaatcgtggaaggtggtgacagagctggggtcctgctttgagcatcagaagccactttggcagggaggaagcagtgagtagcaccggaattgagctctgaagattttgctgttttgacagagggagaaggtgcattgcaggtggaatgagctgcaggaatcaaggcatctggacagaaaagtacagggtatgttcagggaataggggagtacaaattggctggaacacagagtacatgtaagggattagtgagaaagaaagctgaaaaagtaggttgaggcacgtacagttcactgttctgtgccgagagagtgtttggtgcacacttcactagagctcgaggagctattaaatacttgaaagtgagggagtgacctgctcagaactctgtgttaggaaaaagggtttcatttcagctgtttagcccccaagccagccatttcccagacccatggggcaaatctttctggtgcagatgaggggaactgtgaattgtctggaggagtctcctctttgtagtagccccaagtatgggcaggctcccaggggccatgttatgacatcaaggcagcggtgtccactgtggctcttttgagtccctcttcgtgtgtggatcaacaagtcacccaagctacacaccatcaacgtttggggcttatctctgtttagatggatagggttatgcaaaaaagaccctctccttccctctctctgtgtaggaaatatgttttccctagcactcagcattgtccaaactttcaggaactccaaaggcttaaagatggtgggttttttctttctcaagtttatgacataagatctgcacagaatgacctagaagtgaataaactaaggagcaaaggaaatgtggaggctgagttttgtgggaaagcaacaagccaggagtcaggatatctggggttccaattctcatttgaacacaaaaataaccagattctgccctttaggtccctatgtattctgaagttgatgtgtcaaagaaatgacaaaaggctttcttgggaatgggatgtgttgctgaaagcacatggaccaatgatctgacacttccctgcactgagctaagaatttggctgctctctccatggcttcaagcaactgtctcaacctgatgctttgtgacctccttggaatcttcaaatgtcagtggaaagggacattatagctcattgcgatcagcccttcatttagggatgaggacccacgttcagagagattcaaatgccaggtccaaagtaacacataggaccagcatgagtctcagctttcttcttcagagccagttttcagcaaaccacactgtattcatgctaagagacagtgcctcaatctgttcatgtttcttgggtaccttctatgtcaaggctctcaaggaacatttgatcaatcagtcatcacacaggtatttctagaaaatcaacagaatggggtgtgctatgctcattcttgatataacaaataccaaaaacttcattaatccatgacaacatgcaatagttaccacaaaagagcaatattgagagtgtattagttatctattgctgtgtaacaaaattaccccaaaacttagtggcttaaaacaaacttttgttagctcattgtttctgtgggtcaggaatcctggcatggcttagctgagtgcaaaggctgagtccagagggactgagggctgaggccagagggatcaaggtgtcttggagtagtagtcaaatggctggcctgatctgtggtctcatctgaaggcttgactgggggaagatctgcttctaagcctcatcacacggttattagcaggattcaattcgtaatggactttggaagataagaatcttgtactgtgtccttcagtcagtggggatctacaaatgtttcagcaaagcattactgaaataacaagtatttttggaagatctggccaggcatggtggctcatgcctgtaatccaagaacttcaagaggccaaggtgggaggatcgtttgaacccaggagttcaagaccaacttgggcaacatagggagaccccgtttctacaaaacattaaaaaaattagccagctgtggttgtgtgtgtctgtagtcccagatattaatacttgaggggctgaaatgggaggatggtttgagcccaggagggcaaggatgcagtgagctgtaatcatgccactgcactccagcctgggtgacagaatgagatcctgtctcaaaagaaaagaaaagaggccaggaagctctttcaaagaactttctttagtacacctgggtgtcaggcactatcaaagtcctaagactacaaagatgcttaggctatagtcttttttctcaagaaggaagatgacaaccatattccaggtgacaagtagcaacacctgaactaggaggtgactgaggagataaatatgaaagaacagatgaaagaaaggaagcaatgttaacatgatgaggcaagaacagatggctccaatggggagttgtccctgaggaacaagaaaagagaagagaatgattccagtagtccaaaccagcctgggaggatggatccctccagaggacaactaccatgtttacaccactccctgccttctgtgccaagtgttttgcatattttgtttctaatctttgtcacgactcttcaagggaggtattattttcatttttgcagatgaggaactagactcagtgaggttaggcaatgtacccaagatcacacagctataaagtgccaggggaaggaaacctactaatttgcagtgcctttgagtatttgctatgcttggggcaagtattctccaacaaggtcggaatcttacactcaaggaaggaaactcagtgatgagattctgtgagtcacccaaaaggagaggagaagaagacctttgagcagaagctctcagcccttcttggtcgttactctctttgcccactcatcaggccctccctccttttagaattcactctgttgccctctgtctgcaccttgactcaaaatttcacagacacagttggtagaaaatccattaaaaaaaaaactggtgcccatcaatgacagactggataaagaaaatgtggtacatatatggcatggaatactatgcagccataaaaagggactagattatgtcctttgcagggacatggatggagctggaggccattatcctcagctaactaacacaggaacagaaaaccgaacaccacatgttctcacttacaagtgggagctgaacaatgagaacacatgcgcataaggaggagaacaacacacactgaggcctgttgggggaggggggaggaagagcatcaggataaatagctaatgcttaatacctaggtgatgggttgataggtgcggcaaaccaccatggcatatatttacctatgtaacaaacctgcatgtcctgcacatgtatcccaaaacttaaaataaaataaaattttaaaaaactgggtactttaattacataagaatctccaggttatgcagaaccttccttccttggggaatttgcttcccagggtggggatggtgatttcccctgaatggttaccactggttgccagacagctgctcagcctcacactcggcatcacctgtgtagggacaaccaatgtgagaggcgagaggaacaaaatgggaaactttctcccctagcttggctactgcactgcaaccccggtcttagcttgggctgtcataaccaaacaccattgagtgtgtggcttaaacaacagactttttttttttttgagatggagtcttgctctgtcacccaggctggagtgcagtggcgtgatcttggctcactgcaacctccacctcccaagttcaagtgattctctggcctcagcctcccgagtagctgggattgctggcacgggccaccacacctggctaatttttgtatttttagtagagagggggtttcaccatgttgaccaggctagtcttaaactcctgacatcaagtgatccacctgccttggcctcccaaagtgctgagattacaggagtgagccactgtgccaggcccagacatgtattttctcacagttttggaggctgggtgccagcgttgttggtttccagggaggcctctctttctggtttgtgggtagccgccatcttgctctgtgcccacaagacctgttctttgtgcatgagagagagagagagggagagagaataagcatgagtgctctggtgtctcttcttataaggacaccaatcctattggatcagggccccatccttgtgactttaaccttaattacttccttagaagccctatctccaaatacagctacactgggagttggggcttcaatgtatgaattttgaggcaacccaaacattcagtctataagaactcccaataaatcactttttttaaacctaataacattaatattttatctgattataagtgtaatacatgtgcattgtgaaaaatttggaataaaacaaaaaataaaaattactcattatcccatgaagaagatgaaatgtaacaaccgaatgcatcttttagtaagatctgagtgagaatagcattgtgtattcatctgtgcatgtgtgtgtgtgtgcacatgccacgtttgcctgcttgttcaaaaatctaggagaagaactgcggggtttgtggattgtataaagattatgcaagcccatcaaagacagcttttgtttgtatgcaactcatgtaaaagtaaatattccgtaactgctgtgtaaaatgcaaggaagaaaacctgaaatgatggctattggccaacatacagattatgctcggctgtcttataatattttctctgcattgctttttaaaacatttttcatattacatgccccatctcatatcacattaacccaaataaaaatgtcattatccattcagttcgacagacagcaagcagagtatcgcagaaaattacaatcacgtcaggcagcaacaaaggattctagtcaaaggcacgtagaagacccgatggtgggcagctggcctgggctctctttcacactgtccaggaatatgtttggattcagaatgggtggccccctctttatacacagggcatgcctctgaagagttgtgtgtaaatcacattttatgttccatctcttttgttatgttaagaaagcttcaagctagatatctaaaaagacttcctttcaaacagtacatatatatatgtagatagatagacagattttcttttaccatgttactattcctctgaagtaaatttaaaaggtatttaggtttatgggattttatgaaactaggattcagttgtaccactaaacttattaagataatcgaaggaagatagccagtaaagctagttataaaaatgtggcttagactgtactgacttttccaatgttaagggtagactgagacttcttggaagttggggcctagagaccattttaagtgacccattggcacacccttttgtactgatggattattaaatcgatggtttgtgagaatttagaaaagcatacagtagtcatgaagcatcaacacagagatactaagaataaatcaggatagtcatacttatttttcttttttgagtggacttccagataggtagatgaggtaaatcacatttctgtttctgcaaatcatttgacaaagtcttccccagctgactcatcagtaaagcggtgcctggctgagtatttacttaggttcatgcacagatagcccaagatccaaaaacagtgatgatgaatgattctgcggctacctaaactagctgtccagtggaggggcacaaggctctgcaccagggcctgcctacagaccaatgaactgaagggaggcttagaaggcacacttactacattgcagatagaacgaagaaagaatagcccagtgttgcaggtgatgggatttttttttttttttttttttttttgagacggagtctctctctgtcattccagtgatgcattcttggctcactgcaacctccacctcccaggttcaagcgattctcctgcctcagcctccgagtagctgggattacaggtgcctgccaccacgcccagctaatttttatatttttagtagagagggggttcactctgctggcccgccaggctggttttgaactcctgacttcaagtgatccgcctgccttggcctccgaaagtgctgggattatagacctgagccaccacgcctggccaggtaatgggattttaatgagtgagtacatcttttgctcccccacagtgttcaaacaccccagtgctctaagccctgtggctttatgaacagcaaatctattttcccaagatggctctccctccatgagccttggcaacagggcactcatgagtctcagatgctctgctatctctccacttgggtgtgttatgctgtgaacattctgctccttgagctgttgttcagccgtccatagcgctgtccaggccattgtccctgccttggttaccacctccacgtggcagccttcatggagccattgcagctttgatctacaggactccctcaccctccatctacgggaccccctcgccctccatctacgggaccccctcgccctccatctacgggaccccctcgccctccatctacgggaccccctcgccctccatctacgggaccccctcgccctccatctacgggaccccctcgccctccatctacgggaccccctcgccctccatctacggggacccactccttcagcagaggagttgggcccctggtaacacaattctttccttacacccagagcacgtgggactgactcggaggaaactgcagaggagaggggtcctataaaatttcatgtcctcccaacatcctgtcaatagccggccagctgtcccactctaccaggtgtctccaaccaactgaatattccagagaagataagagatcgttctgctcagaacacacggcaggacaactagtgcctttctaatgaatggtccctaaaaaaatcgaaatagcaattgtacctggttatcatccatggaaaaagacctcgtggttttcattaacctgaacctcaatatttgcctgcactgtttgtcttctagaaaagtcaacataaaactggctttgcgattgacgtgtagggtacagatctcaggaagtgattcatttaccatacaccaatccacacctgaaatactgtattccacttatgaggccacctttaggagtgaccctgataaagatgagagcaataaggcaggaggggtgtatgcaagccatatggttcagtcccccattgaaaggatgggggcagccaggcacagtagttcacgcctgtaatcccagcactttgggaggccaaagtgggtggatcacgaggtcaggagttctagatcagcctgatcaacatggtggaatcccgcctctactaaaaaaaaaaaaaaaaaaaaaaaaaaattagccaggcatggtggcacacacctgtaatcccagctacttgggaggctgaagcaggagaatcacttgaacctgggaggcagaggttgcagtgagccgagatcacaccactgcactccagcctgggcaacaaagcaagactctgtctaaaaacaaaaaaaaagaaagaaagaaagaagaaggaaagaaagaggaaagaaagaaggaaggaaggaaggaaagaaggaaggaaggaaggaaagaaagagagagagaaagaaagagagaaagaaggaaagaaagaaaaagaaagaaagaaagaaagaaagaaagaaagaaagaaagaaagaaagaaagaaagaaagaaagaaagaaagaaagagaaaggaaggaaggagggaaggaaggaaggatgggaacagttgtctaggagaagatggggagcagataggtacttgctgtctgagtgtcgggtgcactgtcatgaagaagagaacagaaatgaaaccagcaaaagattgttagacgaagtcagattttgcctcagtacaacaacataccttctgagaagcagattaactttataacttttcccagtgcctcaagactttaagaggaaagagtgggtattacataatcagtacgatgccatgattcgttcattcacttaacaaataattactatgagccaggcgctgttctaggtgctgggtttataaaaatgaagaaacagactaagatctctctgacctcgagaactcaatattctagtgtgaaaatcatcaaatctaaacataggttacattttatgtctttcatgagaaatgctcagaatgatgtattagagcacgttgctttagctgtgatgctattctagaatgggcagcgaataaaatgattctgctcgatattttcagcttggccttttaatcatgcaagagagaataaaaggtcacatgggtggccagcaggctccacaaagaattccacccacccgtttgtcgaagccgagtggtatctatgtgaatctccattatgccactctacctttctgtgtaagttaggaattttctaacataaaagtattttcctattaaaaaaaagaaacccaacaattgccccatgtgggcataggaggcatcttgaagtcaaggttttcccagtattcgaaagcttagcggcttaagcacaaaagaataaccatccatcaggaatgctctataaataatttctgtgttaaataagaagttgaaatggatgaccttaggttcctttggatactaagattcaatattctagtgaaagatctaaaatacaatcggaatacacaagcatagacttgggttaattccagggattgtgcatatggattaggctttatttactcgctaatgctaaccaaatgtcatgaaactgagtactgattctcagttttgtctaagcacttaatgatcattttcataattatttcaccgtattcactgtaaatctgttcttcttttttgcttccaaagataaaaaatgcttaagctaaaatagacgtttagagctattgtattttatgaatatttgtgaattttaggatcttcttcttgaatcttagctgtgtgaaaaatatcttccaaacagtgttcattttcccagaaagcactacatataacctcttcatctgcagccaatttaggtgtactcccggcatggtgccctaattacacctttgttatccattatcagatggttcccctcatcagccaagcctgcgaccttctcctggctcatttaaaacgctatgcggaatctggggacgcatttgacatccagaggtaaggctgctgcattacagatgagaaatcgagtttttgaatcactgcttcttgtaactgtccataattgctgacaattaccttgggactagcaaactgtggaaacgctagaagctcataaaagcatggatggactgattaataaaaagaaaagaaacccacttaacatgggaaagagatgtgagcagagccagggtacgtgcgtcctgtcgaacctgtggatggatccaccctctgacctccacagacccaggaatgggcaggacaggcctgcgcctaaggacagggatggggggaaagttcaagcattttcacttcaagaaaaattgtggtgcacctcagcccagaagctataacttagtggtggacaccaaatttaaataactgattatctggcttttcgtcattttgtaactaaaaggtttttgctttaaaaaaacatctttagtctaagtttgtccgacccacagcccgctggccacaagcagcccaggatggcattgaatgtggcccaacacaaatttataaactttcttaaaacattgtgagtttttttgcagtttttttttttctcatcagctatcgttagtgttactgtattttatgtgtggccaagacaattctcctgcttccaacgtggcccaggcaagccaaaagatttagccacctttgctttagtcattttatgccaaatcatggcttacagcagataaagaataaagtgggatggtgaatcatccagaaatttattcattattatcattgctaataaaataataacataatcatcaccaacactggtattgcaccagtttacacagtcttttcatccacattgtctctgattattataggatgcatgagttggctaaagataaggtggcctcatcagctataaaagcaaagtaaataaccctcaagacccttaaatcttcaaccttcaggatcagatgaaatcacattcagtagtctcattcttgttttcactctagcagggaaatgtgtaatcagttgtagaaacgttttcaataaaagcagtgtgaattttaaaagtcatctggaaacgtcatgtattccttaatgataagttagtggttatagaattcatgtacaaaaggagttaagtgtgtgcctacattgagaacaaaaattggccttttaattataaaaagatattaataacccagtttttagctttttggaaaagaacttaatctgactactcctataagataacaaaaagaatcatttgagtttaaaatggccttttgagggggcagctttcctatagcctaagaggttaaattttctggagctcctgccagacacttttccttctgtttgtttctaaagcacaatgtatgttttctgtaataatatacagatgttcatgaagcctgccttaaagtttgtcttgtgtttatttgagtgctaagagcccttgctttttgttcgttgctattaagaaaactgtaaaatcattaagaggaagagggagacaaagttaataaaactagataattaggttgttaattcatcaaggacaatttgatgtctatcagtcaatcattagattctggcctgagctgggctgtgcagagctttgggtacagcatgtaggcgttgggtcacctgtgtgccctccttcccagggaggaaactataaagtgtccttcttagtacctggctgtgttctggttgaccacagctgcctgaggctcgaaggtggaagaggctgtgccctcctctcctcccaggtctttgtttagacgccaggtcttcgtgtctcctcccaccctctgccgtcactgctcagagtgccccatccaggagcccatctccctccacctccccccagatctgcagaagctcctcttccagacacatctgcagggctgggcaagccagtgtaagcaattcaggccctcctcctctggagggggccattgtgggtagcccctgccagagtcctttcagatctctgtgctcccatctcccgtaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactctgtaagtgcggctgcagcccggggcgctgcgatgactccagcaagttgggcagaccccatgacacctggggtggcttctggggctctgtccctgccactgggaaagggcactcgggttgttcccctgcagaggctttgtcttatggagccaccgggttcctcttgtcacccgcctagggccacttattagcaatgctgtagccctggcattggtaataagtggccccaccgccatggtgagaacggttgggacgcaccgtgttaggcacggggtgtgcgttgcctcacttagtcctagtactcaccctatgagaaaaatattcttgtccctatttctcaggtgtgaaacaggcctagaaaggccgagctgagactggaacccaaagcctttcatttcctagggcatatttctttccttcagcaaaatcctcttcacaagacttctccacttgaagcccaacacacagaaatcctgtgtggtggatgaggattaggtcacccaatgcacgaggaccagtctatttattttattttatttattattattattatttttttagatggagtttcgctgttgttgtccaggctggagtgcaatggcacgatctcggctcaccgcaacctccgcctcctgggttcaagcgattctcctgcctcagcctcctgagtagctgggattacaggcatgcaccatcacgaccagctaattttgtatttttagtagagaaggggtttctccatgtcggtcaggctggtctcaaactcccgacctcaggtgatccacccaccttggcctcccaaagtgctgggattacaagcgtgagccaccacaccaggacttattttatttttattgtagaagtgagattttgccctctggccaattctagtatcttcttgcttttataggagcattgacgtgttgttatgcttggtattgattattgccatgatttctaaccattctgctgggctggtaaattccattcattccttgaccagtttcattcccgtttctgagccgatgtccatgggagcccgtcacctcactggctccgccctgaaatcgtaggcagagtcactctgagtgtccagcagtctcttcctgcaccctttccaccgatcttggaggcagcgcaggctgtgtctgccccttgtgcctcaaccacggcccaggcctgtggggcaggtggctcagttgtgtcatcccttctatttctcctctctgcctctgcagggccctcctgctgctgtgtcacattggttcggactctggctcttgaaaatgggcctgcgcattctgagagcatgtgtgtctggagatgttctccccagcccagctcccatagagcccggtgcagggtgaacccacaatggaagctgagaagctgaacccagccagtgcccctctccaggggagatgaggggttcctgactctggcagcccgatccccagcacatggcagcaagggcccatgctgcacccaggggccggcaagggaggcacccacagcagcaacagccagtacccttgtcagcagctgcagtggcagctcttgggagcaattcaggaggtcatgctgggaacaattatccactggaaagaaaattcaaatgaccagaaagtttgtaaaaagtaaatcagcttctaccacttgctaaggcttgaaacagcctgtaatcctttctctcttaatgaagtacaaagaccttcaggtctcatccccaggacctgaaacattaatttatgagggtgaccttgacctcttgagggccagatggaagtgcagactcgattaattgcacagatgtttattgagtgcttactatgtgccaggaatggtgaggagtaccgagagggagtgagacatcacccctgctctcagaagcagcagtgcggcggggagggcaggactccaaaacggctccgattccaggcccgcgtttgcttcccgggaacaggcgtctaatggccctggtttattatcacccccttttcaatgccacttttgtttttctctttcaagtatcatttccatccataatggtcccactggcccggattttgcccaataagaaccgagacgaactgaatggcttttttaacaaactcattaggaatgtgattgccttgcgggaccagcaagctgccgaagaggtaacgtattttaataggacacagccttgaaatggaatggagccgactttggcatcactgtctctgctctttctcttccctctcagccccgcacatcacaccgtgccgtccttcagcaacccaccacttacagcttccagggacagtggagagaacagaggaaggttgaggaaggtcagacaagaaagggagggtgggacggcagagagaagcctacagcaatgtgtacatcctcggacacggacgggtagaattaaagccgcccccaaaactgtctccctagtgcaagcatcaacccaagcacaggttagaatagcccagaagaattttctgggtaagtgtgcccacatgcaattttcatgagcatattctttatattgaaaacccagcaagatggagttctccagcatgaacagcatgcttattagagagttcggcaactgtcagtcactaaccccacactcccactcagcatggaggatgtcgctacagaactcgtggttgagggccccctggactccttggcacgattcatatgagacgtagcattttctttcctccttgcagatttgcactatgcttggcacatagtaggaatcaagtaaatatttgttgattgaacttggctaaaatagaaagaggagttttcagtgggaagaaaggtcatttcaatactggatatgcatatgcatatgtaaatctgggctttaaagcccttgtcacattaaagaaagttactaaaaaggaaaacagggctgaaatggcctttccttagctggctcgtgcaagatgcaactttaaaagggttgtctcaaagactggatggctcagaggaattggtgagggccaattgttaaggcactggcctgaaatgaaatcaggggtcaattagtggcttgatacaccgagcggccttgggcagcagccgcgtcctgtgcagcttcacgcccggagaactgtgcagcaaacgtgtctagatccagaaggcatgggaaggtgtaggcaagcttgcagccccttcggcccacaccactgtgaactcaactcgcatgtccttggaggtgcgggaagaagcagctaactggcatccctgccccagctctgaagcctaaaaggacagaacattctgatccaggttcatgtttctccgcagagtgaggctggagccagggggagaagggataaagaaagaaccattttcaaccctcaacattgctactaagggccaccttttgagagtgttcacacacacacacacacacacacacacgcatccctagcctggctgtggaatcaggctaaaaattttaaaactgttgcatcgaatgacttactaagaggtgagaggttattaaagatccaattactgggattgcctagagcttttccttttataaactctagtgctatttgtttcaaacaatgagttgatctgagaaaaatctcccaaccacaaatccaggacagccatgtcaagacagagctatacggttactaagaaaacttgctttaaaaccatctaaagtctgtatacattccatcaagcagatgtgtgtttgcgcagtgaaaatgcagcacagatgttaaaaggtaaatatttttctaagctctagccgatgggtggattagacacctacatctatcagggtgcgtattttccttggataggaccataaaccagcaccgtttcagtcctcaatgggcagtgttcagatagcctccctgatgccatgtgaataaaagaaacccatctatactaatgttcttctccagtgcacgggccctggagagtggcctttcctctggcctctgtagctggaggttaagacagatttctgcaagattctgacagccctttagcagtctgtctgggctgggataagaggaaaggatgctggctgcagttttgcccatggaaaaatacccggtgtagaggtggctgtgccctccctcccatcattactcctacactacctcagcaaagccatagccaagcctcagggaccacaatgatatcacaccccgaggaccttcagagggactgactgagaggtctgggggtgctctggggtcctgtgctggtgtcccagagctgagggagcaagggatgctcacttcccctgcgtgccatcttgcctgaccctgccccagctctgctccatgggagcagggccagcagtgggaccacaccagcgcccattgaccgagcagcaggaaggaagctggggaaagccagcccttgaggatgctgtttgaaaatcagaacgagcagggccagggtggaatgaagccaccaactacccccgaccctcaccattttctcagctattacaacccagcaggctgttgggaagctgaggccttgcttccttagactcaaggtctgtggcacccatagtcttaaccttgagcactgctaggatcccagtaggcaccttccaaagtcacaaggctggggtgcagtagagctgcaaaggtgtcagcagccaagactcccgctctaaagagcattcacttgtcatcaaactcagcatacccatcctccaaatgcacgcactgcattacatttttatctgttgagtcatggactgcagatttaacatgtgctcagcataaaactaggcacggtgtcaggggttgagggtggggtcctgccctggagttgcttataatcttatggaggaggaaaagcaaccacacatgaaatgacaacaatcttaaaagatggaatcatcaggaggctgaggcgggcggatcacctgaagtcaggagttcgagaccagcctgaccaacatggtgaaaccccgcctctactaaagatacaaaaattagccgggtgtggtggcacacgcctatagtcccagctactcaggaggctgaggcaggaagatcacttgaacctgggaggtggaggttgcagtgagccaagatcacaccattgtactccagcctgggtgacagagcaaaaaaaaaaaaaaaagatgaaatcagacgctcatgtgtgtggcatagattattaatgcaatcgaaattcagaagccagtgaactgagaaaatgctgcagctagcagagtactttgcatgaaattctaatatttttctgttggtgattctgatactctccttttgccattttagtcccataaacttcagaaaatggaaatgtcttggttgtccttcatgacattaaagagcatttcaaagaagggatgttctaggaataagctttgttaacacagaggcgatatagaaacactcctattgttacaattagtaatagtgaaaatataaagaatatgcaaatgactgataaagaaggtagggggaaatggaaaaaaagctctgactacttaaacgggggcaggggattactgagaaatagagggaaccgatgtgaagatctgatatgaaggctaggggatgaagaaggcaaagcctggagactttgaagacaggcgccgccaaactagtcccctcgccttgccctcacttctgttaacttcctactgtgtgagaaaaactggtggctgcccatctaagccctaagctgcacagaagtgagcagtacagcacatgcttggttttaaatctatctatgtgatgttgccattgttttattgttggaaaaccaaccaccaaccaacagtacaaaaatgtataaagtaaaaaataaaagcccccctcctggttttcccacctcctccagctcattatgaactgttgggtggggacattgctaaaatcgtctatgtgtagacagatataggtgatgatatatttagtacatttgctgtttttgcagaaacgagagccacagtgcatactgttccatgaccggctttgtttttacttaacaaagtggctcaatgactttcacatcagcccagatagaatggcctctgccttgctcagggcagcagcccaggctgctcttcactgccccagaacctgcctgaccagtgctatactaagggacattcaggtggcttccaggttctcaccgtcccagataacccagcaatgaggaagcttgttgctactgagctcttcaaaagctatgcccatgtatcttcctcctttgttctccaggaagcctcactcttcatgactgtaaggtcaaaatgtgcatttttctccttttgttccttagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacgtgagtacaagttggatccagttacccatgggatatccataggacaattgattttgtgtttgtgggagtgaaacttatttttaatgacttgctaatatcacattctaagcttataagatgaaatagggtcattgcttggcttctcctgctctccgggttagcaagcgaaatgaaatgttgagaacaataaccacaacaaaaagacaaattgtgtgtgcaccttcactgtctggggtagtccatgaagccaggcctggctcgaggaagctgtggaagcccaggaaggtgtcaggcccaaagggcagggatggggaaggagtcatggcttcccaatatctgacttggagctgccacacggagggaggcaggtgtgagccagaaaggagagccaagatagaaggcaggagtggacaaaaggacaggccaagctgaagctggactgaagactggaagctgaggaggaggctcacaaatggaataagggaagatggggcccgtcagcgcccaggccagcttcagggcattttcttctagatgaggcccctcttgatcgcttatagcagatataacgagggtgctgagcaaggctactttatcacctcattttttcctctagatgcttgtgtgtgtataactttgactcatgagttgtcaaagagattcatttttaaaatctgtactttaaaaggaagaccaccacagtggaatcctttctgttacattctgatatgattgctattacattcaccattttgaaaggtggtctgttctgttactggaaccattaaaaaatgtttcatacaatgaactgaaaaccacttcccgggaaattctacttctttattctactggggaagtaaaggcaaagtcagtgtctcttcttcacagcagtttttaaatatttgaaaactgcattcactgtgttactaattaattgtcttaactttaggctcaacatgagtttatggtcaacttcaagttctaagtagttatgacaactgccaagctgggcctttccaaaccctgcttacacaattgatttattgagcctagacggaagagtttatatttatccttattactgttcaagtcagtcaaaataattttgaatcttgattctgccatctgttatattagcaattcctccagcctcgtgtcatctgagacttattaagcatgtctcctatttcatccaagtcattgattaaaatgttgaacaggacaggacttccctccagattgacattgatccattaatcaatattctttgggcatggaatctcaacaagccatgaatccaaataaccctgccacccatcttattctgttttatatgtagtggtttgtgtatttgttcttaaattgaggaaagggtagagggagggaccaacggtgactggggtgcattagtgcaaaagaagtaaaaggagctggaagcgaggcaatctattaggatacatttagttgcagataacagaaccccaacccaactgatttaagcaaaacaaaaacaaaaagtaaaaacaaacaaaaagactcataaatgtgtatttctgagtacatttaattgagcagctcaggaatagatgtggctccaggcaaatctttgtctaggtctcaaactggtgcacaggtccgtttctctctcgccagttcttggctgtgctctcttatattggccccatcctccatcatgctctcctctcaaagccccaagaagcctgtcaagagtgtctgggactccatacttccttgcttgtaaccaatggagaagagagggtctgtggcctaaaattcccagaaagagtcatgagggtcactctgacgggaatgcttaggtcgctgcccattcttttttattttttttttgagatgaagtttcactcttgttgccgaggctggagtgcaatggcacaatcctggctcactgcaacccacacctcccaggttcaagcaattctcctgcctcagcctcccgagttgctggcattacagacattcaccaccacaactggctaattttgtatttttagtagatacggggtttcaccacgttggtcaggctggtctcgaactcccaacctcaggtgatccgcctgcctcggcctcccaaagtgctgggattacaggcgtaagccaccacgattggcctgctgcccattcttgaaccaactcttgaagcaaggggaatggggtccctgataggcttacaccaatcagactctagccctcagtcaatcatgctcaagtcacatgactgagaacttgggaaggtgacttctcaagggaagcttagcatgctgtcccaggaaggcattagagggaagcccagcgctctggtctcagtaaaccagaaatcacaccaaattaagggctttgaagcatctaatgagtgtccagcagtttagtagacacagcagaggctaggagagggggcagaagctctaagagatagaagtcaggtcctcatcttgcgggaattccatcgccaattgagaagcaatgttatgtctatgaaacaatattttccttccaaacacaggcctgcagggcagtagaaggcagaagataatcaggtctagaatgtgtgatgtcatttagagagccatggggcgataggagtctgtcccaccagctataacaatagtcacatccagttatgtcagtctgccaggaggacacagcaagtgctcatgttaggccaggcacagtggctcatgccagtggctcatcccagcactttgggaggccgaggtgggtggatcacctgaggtcaggagttcaagaccagcctgaccaacacagtaaaactccatctctactaaaactacaaaattagctgggtgtggtggcacatgcctgtaatcccagctactcgggaggctgaggcaggagaatcacttgaagcagggaggcggaggttgcagtgagcaaagattgtgccattgccctccagcctgggcaataagaaagaaactccgtctcaaaaaaaaaaaggaccacatgttattatggggctgtacagactgttgcaaagcactgagaccccttggtcaaataaacacattacagcaggtcaaatttttgagtttagtgtgcataaaagtatataggaagactgcttagaatgcactttccagggtcctgacctcaggggttccgattccataagtctgggctgggacccaggaacccgcattttattttattttattttttgagatggagtctcgctctatcatccaggctggagtgcagtggcacaatcttggctcacagcaaactccgccgcctaaggaacccacgttttaaataaatgtttccagtgattctgatgcaggtggtccctggttccactttgagaagacagccttagactctcaagggctcggatccctcttccaagaaaaaaaatcagggtccaaagccctcctaagccatgcaagccacaaggtgattttcttcccctatgtgatagctggttgtgggggggagtctctgaaaaatgggaatatctacagctgtctttttaaaaacatacatttggtagtcacaataatgttgctttgcatagccttgcacatggcacccactcaatgaatattggtaggttttctttttttcttttctttctttccttcttttatttttttaattttttttttttttactataatcagagctctgttaatatgggccatctgtcaggacatggaaatgcagattagatgttcacacattagatattttcctgaaaatattcctgaaaatttgcatgtaaagtatgacttgttataattttcctgctggtttccattcaacaaatatttcttgagtgccagttaatgccagactccggggctccagccctacgcacgagggtgttctggtctagctcttctgtgacatccctgtagagcatccccatgcctcattagatggccttcccttgtatttgtcaatgagattgcttaatttgagctctagagtttcttttccctgagcaatttctttcatagcaatgcaccatgggaatctgatgagagctacatctcttcctccaagaaagagcagatatgtgcatggcatcagttcagactcttctgtggacagtgataaaaaaaactcagcccagattgtctcagggagtttactgacccctacaactgaaaactccagagggcagagctgccttcaggtatggcttgattcaggggctcaagccctgtccaagttgttctctctccccatttctcagctccggtttctctgggcacactcccttctcaggcacatctcccctaggggtctcaagccagctgtgtaaccagtgttttgaacagtctcaactcagtgaggtaccaacttgaaaccatttggtgttttttgtttcatttttttcccttaaatgtgctctgatgaatctcctttccctgtccgtgatgatactttggacagatctcaatgatttctggtcattttggggggcattaaaaagtccaggccagtctggcccagatgaaaacttcaggctcaaatccaatcagtgcccttctgttctcttagctcaggctgacctgtggcctgaggatgccgccctgcgggaggagaggtctgttttttcccctccttctacccctcccccacccctgctgggcccctttctcctccaggagtggggcctgtgaacggatccccaaatcctgcctacctggagctgccctcagtgccttccctgcggggcttctgacgtggggtagatgcaagacgtattcggagggctcccaggtctgaagtcctcactgcataattccctgccagggagacaggctccagctcctgccaccagctcctgccccaaggctgcttgatggggaatcttgagcaggataccagctagatggctccagcttccatgccttccccagtgtccgcccagcctatgggaaacacacaactgggccacacccacagtggccaccttctgccctctccttcctccctccaccctgtcatgtctctccaagtacttttcctttgctcaaataggcagagagggcacatcagcaattctgctgcatgagcagatggccaaggagaatggcccacctctatgagtggctctgctgaagaccctcttccttggcttgggagtagggaggaccctcttccctaggccaatgactccttgctctaagttttctttaaatccctctaatgtctttataggctgaggatgggggtaggagagagtaggttcaagttcaacgggaagaagcaagagtctctttcctgcaagtctcagcaaaagcctcctggcatcccagtgacttcgagagggtcatgcacctgccccctcaaccaatctttggaccccagaggaatatgatcccctgattggcttagacttgggtcatgtgccccatccttggagttggtgtctaggtgaggccttacccaaaccactgagctctcgagcggaggagaggttgatccccaaatcactcttattaaaagtggggtaaatggcttctgggtagccaggaaacagtgtgtttgcccacccctgtacatagaatctgtggcccccagattagaagttcccacctctcaatttcctgttatgtgatcatgttcaccttccctctgaacttttaaaatccagcttgccaaattagaaggtataagtccggcagtgcctggaacagcctgctcttgcctgtttcttgcaaatcatcccaagttccctgtgatttctgcaggaccagtcggtccagctcagcagttttgccttattgcatccttcaccatttgagaagtgaaaatgtcaggcatgaaagtcaataattcagattctctactgttagcagttctaaacccctggcgcatataaagatactcaaaggtctccctcactatcggggatctgcctccgcacatcctgtctggcaacatcccatctctcatcccatacagccttgactgcattctcctttcagggtatagattttggttccagcttctaaaacagttacaatccacttttttgtttgtttttgttttgttttgttttgtttttgagacagagtcttgctctgtcgcccaggctggtgtgcagtggtgcaatcttggctcattgcaacctccacttcccaggttcaagtgattctcctgcctcagcctcccaagtagctggaattacaggtgtgtgccaccatgcctggctaatttttgtatttttagtagacatgggatttttccatgttggtcagtctggtcttgaactcctggcctcaagtgatccgcctgcctcagcctcccaaagtgctggaattacaggcgtgagccaccgcgcccggcttcaatccactttttaattcatgcccccagactgattctttctggaccacatgtgttttcttccaaatcgtcttgtttgggaattttatctggcctctcctcctcttgtcccaccatcaaaattcagtgtaaaatcttctttctcaagtcccccaatctcttggagaagtctctcttttcccatgttgccttggtctatggaaaaggaggtagtacgttcagtaaattcaatagtggatgggtgggaaaaggtttgtaccatttgtaccactcgtaaagctgaaaaaaccacaccatctatttaatgagacctttgttatatggctgcttcattgtgttctcatgtaattttgaaaaggatgagaaaggaaaaaaaccaacttcttttcatataaattgtgtcttctatagctttagtgttctatgttgaaattattgacttttgatctggctaaaccattctcttttcttctctttggtgctggactctgccagccaaaatttatgacccattttccttctgcttaattgttgttataaatctgctgtgcagaacccagttgtaaatttatcacagactggattggattgatatacagcctctctttaggataatttgaacacagttatgccttagaaggaaggccaaattcttaaaacttctcttgaagagctgctttgtaaccattataaatatctaattaaaatacaacttactctttctttttctcttaaggataaaagaacattctgtgctggttatttcagcttattagctcatgctgctgtgtgagcaaggttgaggatttgttccttgaagcagtcagaggatctccaagaaaaaaaagcatattatgtgcttacaaaaaaaaaaaaaaaaaaagccgttttacccccaactagctttttcatgaatacacatcctttgtcacagggaaagggttgagcaggaaaaaaagtgaatagcttaacacaaatctatcctcactatggaaaaaaaaaatgtcttcccatgtggatctcacccagggaggagggcatggttggctttgagatcaagtagaaaactggaaatgggtttttccccatggggaaggtttcctcccctttgcccaggtctgctggggtcgggctacccacagttggtgaggagtaagttcaggagttccccatcaattcagtcccccagccacacaggggtcagaggtgctgctgagtctctgccttctgacagaccccacaacagcacaacaggacaacagagcacaaagccacagggacaagggaagaggcaaaacagagaacgccttacagccctaatgttgaatctaaaacaaagaacagcgtcactgcagcgtgagaaaagtggcaacgggctgtggcaccggcccttggttagggcatcacaaagtttaacgtgcacgggaatcacctgggagtcactaaatctgcagattttgattcagcaggtctgggacgagcctgagggtctgcatttcttttttgtgattattattttgtatttatgagacggagtctcactgtccccgaggctggagtgcagtggcacgatcttggctcactgcagcctccatctcccaggattaagtgattctcctgcctcagcctctcgagtagctgggattacaggctcacgccaccatgcccagctaatttttgtatttttagtagagacagggtttcaccatgttggacaggctagtctcgaactcctgacctcaggtgatctgcccgcctcggcctcccaaagtgctgggattacaggcgtgagccaccgtgcccggccaagggtctgcatttctaaccagctcccaggtgatgctgatacagccagtccatggcccacactatgtacaaggagccaggttctgaaccatacgtactgtgtctctctcacgtgtgctggacatggcaagtatgtattcctcatgacatttaatgtgctcatgttcttcagtggtttaccttttgctaataaatctcagtggtttcctgatcattccataatcatgatggcattcactttattgagtgggagatgaagtgatgcaggaatgagccaatcctaatacattttagaagtgtattaatcctaaataaagcctaaaatcatctattttcttcagtaattgtttccatggtgggaggttagggggagcttttgaggtgatttaaagtcattttcaaagcagatgaagacggcaacctgagctttctgtcaggacatgtgtgtagactggagacctatcacatccaacgggaccctcaggccaatccttttaagcagggggctccacccagccccttagcttccctactcccctaagccccttggttgtagacagtagcttcgggtgccaggtgggaggccatgccaaacaactatagccaaagagcatgtctctgatgccatttctttggtggcctaggacagaatctgagctatttccactagaggaataggagcttcagcagggggccttggaaatgtatccaaggtacccacctcctgtccttctttctggaagcatctggccctgggaagtagcatcccgaccactaatatcagggcactaatatcaggcaaagggaggaaaagttgcatcctgaccactaatatcagaaaggcccctcctcccagcccgtgaagaggggcctctctgggtgtgtacctggaaccctatcttggaagttaagttttgtggtcactgctaccaacacaccaactcccaggacacaggatactagggacttctgtgccccatcagtggacaagtcacaagttcccaaagcagggtgaccaatcgatctggatcaggtggcagggcctcggatcttaactgtccatttcattgttatgcacacaaacttatcttagagatccggccatctgcctgttcccgtcctggggatacctgcgggaaggcaggctgtgcctcccagaggtcatctgggctgcaaatgggtgccaagaccttcctctgcccctactcaggactccagactcctccacatcccctggagatactcaaagcccatgcccacagtaacccgtagggaaactgacccgctctgcctgggagctgctcccaggagcctcagcagtggcaaccaggagcttagagaccgctgtgcctctccctgcccaccctctccctctcatcctgccccatttctctgttgtctttcctctttcctctcttcattgttcacagcactatttaatctccttcccctctttcttcccttattcttgttctgactctattcccaggtccagagaggcccagaatcttctctgctcctgctccacctcctgacccactgccccctgggagcccctggtcatcccagaagcctgtaagtgcacacagcagccaagacccacatgcctgcaatgggggtggcacaggggaggcagggtgaagagcaggacagacttgcaggtgtttttttctgggctgcctggcttcatcaactgcaacactccagcactttgaatttttagcaattaatgccccaagtccccctccccctgagtccctgcagagcagagggaggggcacctgcaaagagaagtctctcccaggaatgggtcacaccaatcagcatgtatgtggtgtctttcatgtagcaaatcagagtctttcatattcaatagctgggcctctagagggaccaagctttgctaagcaaataagcttgtggggttggttcacatccatccagaaaagcaagaatgaaaaataaacttgggaaagtcagctccacaggtgaagctcaaccttctgtgcatctgcttggcatggagctacatttgcaactgaatggctcatttatttaactattgcacacattatgggctcttaaaacatcaaaagaatgggttttattcccaacaattagctcttgaaataaaagaataaacatactttttttttaacttccccagactctgttgaccaaagtcgctttcacaccagtggagtggaagctccaaaatggtatcatctggtgggaatttaaagacttcttgtccccaaaaaaccttttcgtcactaggcttaaaattttccattgggaggccctggctttgttttgacacatgatccgttattaacacaccactcattttgggaggggaatatcatcaagtcccagccaggatgtaaaccccacgactaggaagcctcgtccgctgggtaccttggtaggtcccagggccgagcacagtgcctggcacgtgagaaataggtgttgagaaaagttatttcactcttccttttctaactggaaaccaactccaagcacagatttgaggggggacgagcagggaggcacagtagataaagcctgtgagttactgcgcccagcgagaaaggggtcggtggagtcaaagagagaaggcactgcgtggggagatggaggcaggttgaaggcaacacttggagtccctatagtcctacaattgcagtgcaattgcccagaagatatcatgctaagaaaaggagggagcctcagccctcggcctccgaggagacctctggggacatctagggcagcttcccatccaggacagatatctgaaagatcatgaggctgggcttgaatcctgctgacaacaagaaacttactacctatgtcccctaccgctgctatggtccgcctcctctgtcagctcatggtatttgagcacctactaaatcagcaaattaatagcttctgcctgggggctgcttccacactccactaatagccaatcgctgggcatctcagagccgagagaggaaggaaaattggaaaatgagtctagaataaggggcctttccaaaatgtgtgcttatggcccagacactcctttaaccctaggttttccagaaagtctgttttgccccaggactgtggacagcattatgttttgtttggtgagctttcttttttttttttttttaggttgtattttataactgaatatggcatgtgtgaaaatatcagctaccagactctgttagtccaggcgtatgaatattccagatcacaagggaggtgtgactcccctgtgaattgcaatgcggaaggtttataaagttaatcatttagaaatctgtctttaaaatttaaatatttagattgggtcgctaggacacaaaaggcaattcctgtttctcactcacttaatttgatttttttttcttttggtcgcacaagttgtttttcaaagcctcattcctcgaatgttccctataggaggaatgtaattaaactccactggcctccccctgctgggaccaaacaggggccagagctgtagggagcataaaacagatatcctgcaaaagaatccttattataaagatgagaagagaatcaacttccctctggttatgaacaagaagctttagaaagccacccaggctatttttgcaatgggcttagtctccaagacattttaattagtaatttaagactggaaggaaggggataaactcctcacctccctggctataggcaagaacttcaactggatgagtaactggttcaagtggctgaaaaggagggaggtccagagggagggtggttccttaaaatgaaccaactttttcatgaaaatggcatagctagatatcccggcccccagtcagtcactgtttttgcagtcccacttcttaaggcagttctcacccctcaccagaggcaggcactgcctctctctgggacactcggctggcaccagagcaaagaagcttgtgctgagggatggttcccctcacaccgggccaacctggacttctctctgaccaaagagcatatgcctcccaccaagcgagaaggtggaaagatcctggcagggaaccccgagacctgggtgctagcatcatccccgccatgagagcacacggggcccctgagctgacacctgctggcaatgtgacgtggatcactcacataatcccttccttagtttttctgtctgtaaaatggggatagtaacattgtgtagctcataaggttgtcaccaagattaaacgagttaagaatacacgtgcaatgtttgaacagcgccagcattacgtacatatagctactctcattcgcctttctgtgactcagtttccttatctgtaaaagaaaaaggttggactagacctcttctccactgttattgatgatgatgatgataaatgaatgtttctgtgccagatcctaaactaaacaaaagttaacttgatactcacaatggctgtatgaagtgggagttatcaccatccccatttcatcagtggggaaagaaaggctggattagtcagggatctccagaggaaccgaactaataggacagagacagaaagacattcattttcaggaattggctcatgtaatttatggagtttggcaagtgtgaagtctgcagggcaggctggcagtttggacaaccaggcaggagtcaatgcaacagtctagacacagaattctttcttcgccagaaaacctcagtttttgctcttacggccttcaaccgattggatgaggcacgcccatattattgaggataatctcctcaaagtcagctgattttaagtgttaaccatatctaccgaagaccttcccagcaaccctgggattcatgtttgattaaataactgcacactatagcctagcaaagttgacacaaaagactaaccaagctaaataacttgagaacataagataataccctaggacagggcctaggtcggattggcactcacgtttcccgactccttagtctgtattcttttcaaccttgtctctaatattccatgattccatggttctgatgccattcctcagcgctctgctgttcttgcctgaccaagtggatcaatggtggctctggcatttctataaaggggatttcagggctgcctgctggggagggaggcttgaagctgtgtctgcactgcatcttcacagcactgagaaaatgccagtcattcaggaggacagggcagccctgtcctcgccacagtgcccgcatcttcattggttcacctttgcaggtatcatctgtgacctgtcatccaggctctgagccctgaggataataagtttccctcgaaggtcctgggtttgttggagctttttctccctcttgccatgtccttttcacggtccatcctctgagtttgtgaattatctttcttcgtggcccatgtggcacaagatgaagagtgcatgggcagcttctcccctgacatccctacctccctgacgcttaacccacatagggaagaacattcctgaaacagagacgtcacccagggttgctttctgccacagcaggcactctgcttcgtgcctttctcacttccatttgtaaatgatcttgtctccttccttgtagaaagcttttcagccattccaggctttctctttgggttccatccctctgggattttccacgaattgcatttccttgtagttcattttcatcattttccttgttagggaaatgcacctgagacattggcatgcagcctgattgcccccggcctcccctctgctcattgccagagctacctctgcacagaggagtcactctcctcccactccagggcctctgtcaggggccaggcttgatgctgtcaccagccagctcttcactgctgcccagtgccatattcatatccattgagacaagtccctgggaaatggttgggagccgggggacagccctgcatcctgagatcctaagatcagggaggttctccctgcactcccagctggaaggagactggatcggccaccctcaccaaattcccagattctctgactgaagcaagccagtccttggtttgaatggggaatcaactcagggttataaaatagacgccagccttcttgtaggtagaatctgacttcagacagcaaaagactctaaaacagcttaaattcctgtatatgccttctcctgtgcatgccaccggtcagaccaaaggccacacgccaatcaaggcccaagatcagccaggggtgtttccatgtcctcaagaacttttacaaactgtagctgattgggttccgcccctggagattcgatttagtgggtctggagtgaggcctgggcttcttagaagccccagcggattctaaaatgcagccaggaggaagaacgttgccagaatcccatgaggcacagatgcaaatgtgcatagtgacattgggttgcattatcaatggcaggactgactttataaacctccacatccttactggagctgctgtttgctttttagaaaagtccctcatcagattatcaggaagtcgtgggttttccgtgatcatgctgtggtcagatccagcccaaccagagagccaaaaacaaaacaaacatacaaaacaaacaaacaaacaaacaaaacccaaatccctggcaagccccacgaaatgactgctctgataacattcagcagacaagcctgtttgaaatcatctcagaatcataccagacccaaacccaagaggtcatctggtctatgcatcgactctaggagggtgtattagtccgttttcacgctgctgataaagacacacccgagactgggcaatttacaaaagaaagaggtttcatggacttacagttccacatggctggggaggcctgacaatcatggtggaaggcaaagaggagcaagtcacatcttacgtggatggcggcaggcaaagagacagcttttgcagggaaacttccttttttaaaaccatcagatctcgtgagacttactcactatcacgagaacagcacgggaaagactcgcccccatgattcaattaccgcccaccagtttcctcccacaacacaagggaattgtgggagttaaaattcaagacgaggtttgggtgaggacacagccaaaccatatcagagggtgaggggctatttctccatgttacagacaaggcacgtgaagcctagggacgttccatcacaggcccacaccttgtctcagaattaagaggaaatgcttctggctgccaggggtggggtggggtaggatgcagagcctctccctccaccaccacctccatccttttccctttctctgaaaatctcatttgatgattccccagcctggctgcaaattaaagatttgtagacctgaaagatgctaccgatggttatcagcaccaccaccaccatcgtaacagtaaacatttatggagcgccataattattcataataatttttatgtgttaaacaaatctgacctagctctataaagaaataggccctgttaaccaaaaatattggataaattaaaagtctcctagaagcatctgatgaaaggatctcaagttccataacacacggaccattcagtggtgttgtttctgggcttgattcactgtgggtcacttgaacgatgtcgggggtattgtccacctcccagtgctcagtctgtggcttgtggccagctgttcctctgtggggtctatgttggctgtgttaaggcctgctgcagaaacatctcatttctagcatgtttttctcaagcagtgatcctgtggggtcaagtcttcaatatcaaataatattgataataattatgatagaaataataagaggccaggcaccgtggctcacatttgtaatcccagcactttgggaggcagagttcaggtggatcatttgggcccaggagttcgagatcagcctggtcaacatggtgaaacccagtctctactaaaaatacaacaattagccgggcatggtggtgcacacctgtaattccagctactcgggaggctgaggcaggagaattgcttgaaaccagaaggcagaggttgcagttcgctgagattgcaccactgcactccagcctgggtgacagagtgagactctgtctcaaaaaaaaaaagaaagaaaaaagaaataaagaagaataataagaattatcagtcattgaacacgcgctctgttcttggtgctcttggtgttattccaggcaattctaacaccaattagatattttcccctattttaaagattaaagcaactggcgcagtggttcacacctgcaatcccagcactttgggaggccaaggtgggaggatcacttgaggcagggagttcaataccagcttgggcaatatagtgaaacccctgcctctacaaaaaaaaaaaaaaaaaaaaaatcaaaaattagctgaggctggtggtgcgtgctcgtactcccagctactcaggaggctgaggtgggaggattgcctgaggccaggagttggaggctgcagagagctatgatggtgccactgcactctagcatgggcgacaaaacaatagtcttgtctcaaaaaaactaaaaaagactaaagtgaaattgaaattcagagagtaagtgacttcaaggtagaggcagaaacagaggctggatttgaattcgatcctctggctccagagctcctgggagttatcttgggaatgactgcaaggtctgaggtagatcgttccaggagcaggtgcttatatacagtggaatggcacccactggcacaccgctaggaattctgttttcttaccaccaccggagccaggtctctgtcacggtgatgagaagttcccaaagtcatttctcctctctagggtgtcccctctctgtctgctgccactaaatccctaacgacattagagcgaataaatggcatttttaacttcagctttaagcaacaaagaaatactattaagtcaagatgtgtccatctttaccataaaaaaaaacaaaaaacttgcttcaataaccaataaacagatcaaacaacagaaaaataaatagcaaaagacttcagggctcgatggctcacacctgtaatcccagcactttgggaggcggaggtgggtggatcacctgaggtcaggagtttgagaccagcctgaccaatacggtgaaacccgcctctactaaaaatacaaaaattagccaggcttggtggcgtgagcctgtagtcccagctactcaggaggctgagataggagaattgcttgaacccaggaagcagaggttgcagtgagccaagattatgccactgcactccccattctgggcaacagagcaagattccatctcaaaataataataataataataataataataataataaataaatagcaaaagaaagaaaaaaccctcagctaagaagtatactgttgtgttttttggggttttttttatgtaacatttgacaagtttacattttccttgtctgccttgggtgccttaaaataaaactctgtcaatatttccatgtaacattgggttttgcttttttttttcctcacgtaaaatccacatatcaggaattcctctatttattccgtcgcctgggtttctttccttgggaataatttatatgtcaaacctgtcatttatcgatttattgctgtacctagcagcatttttctccctgccctcaaaatttagcttaaagaccacttaataaggcctgtgcgggtcctcagactccagagatttctgctgatatgagccataatttagcaaaacaaatcctgctcattgcgggcatctaaatggtatcctgttaaatttccatacatgcttttcttttctaaagttatggcctacaactagaagaagggatgaaacatcacccctacctccacatcttatttcctgtatcaaatttcgaagcccttggagatgcaaggcgggtttccctaatgagttgagaatcaatgcgaatcatctgaaatgagaggtggcccgtgggtgtaatccatccctgctggtgctccaacttggttacacatttccagaaaccagcacctccctgttgtccatgtctggtcatcagaggcctctctcctcaggtgggataaccagagaccaagaaagaaacatgtttctctcccttggaatttctcttccttagtcattttcagaaagttaggagtcggcaaccttaaggaggagtttcctatcatctctcctccacttcctcccctcatttcctccccgtcttctccttggagtccttcatcaatgtctctattttctgttcaggataaacaaagagtccctcttacctgcacaggcctcacctgccttccccccctgtcatttctgcagccagcctgtctcctgagcctggcctggcattctccaaagactccttaaggccacttggcttccggtctgcctctaggcttcactgtctgcaccagagtggaaattgtcatgtgccctcagcaacattttacccctcccttccagaacagacacaggcatttcttccacaagcagtattccacagatgaaaaaaaaaaattataaaagcgaaaccaaaaatactggtagtatatttttttcccttcaaaagaatgataatcatcagtaaaaaccacaacaacaaaaaactaagcaaagcagcctgaagataggctgaaagcacacatctacggatggcttgttgttgttttgtttttgttattgttatttttgagacacagtcttgctctgtcacccaggctggagtgcagtggcgcgatctcggctcactgcaacccccacctcccgggttcaagtgattctcctgcctcagcctcctgagtagctgggattacaggcttgtaccacccatgccccatgcccggctaatttttgtatttttagtacagactgggtttcaccatgttggccaggctggtcttgaactcctgacctcaggtgatccgcctgcgtcggcctcccagagtgctgggattacaggcatgagccaccatgcccggccaggatgttctgaatattaaactagctgaccggtggacattagctgtgctgtggaaaagtgaagcagaatggctttttatcccttgtgtatgatcatcaagacacaggacagcacagagattcaaaatacaatgcattccccttgctcgtctggtcaggctcaccttcctattgcacagggttgattggttggaggccgccaacctctagctgaaaggcagagacagtctcccctgttatttcggtaccaagctgtgtttcttaggcattaaaatggagggaaagcaaccactggcccctcactgggattgttcttgaggattccagacagaccataagtaattcattgagtcgctcacaaagggcctggccctgaaggtttgtggctgcagcatccaggcgagccaaaggtgtcagtgccaccaaaatgcagagaaaactcttatcagaaagatgtcatttttttcccctaaatgtcatatatacaatttttattggagtgtgatgacagatagtgaataaattaacataaatttgcataatacaatacagctgttaatttatgatcatattaaaacacaaagttttgtcgtttgaagcagttaaaagtcttaatcttctgaaaatttccctcttgtttgttatttgtttatgagttacttagggttattagataaaatacaggcttctggttaaatttgaatctcagataaactgtaaataattttttagtgtatctcatgcaatatttgggacatacttatactaaaaagttaatcttattgtatatctgaaattcacatttaactgaatggttatattaatatttttatttgataaatcaggcaactctgtatttcataagcagtttaacctctctctactggctcttctctggcagggcagaggggtgctgttttatggagaaaggcacttactgctgggaccttgatatctttagactgtgggggaggctggctctcctaggaacactaacagagtcaaagagatcagacaagagaggtgccagtgcaaagggggaaactgaggcaggcagcatgcctgggctttcttgacagtaccaggggtattatagccctgttttccagattttttggactacaatctcatcataagaaatataatttataattcaacccagaacacacatcccttataaatggaacaaaaagttttaggaaacatgtcaccttctatgtacaatctgctcgacatcctgttctagttgatttcatttctttaaatgccactcttaaccccctaaattgaattcatggattgaattcatggtcccctaaaggatcacagcccacatgttgaaaaacactgggttagagggtcacagttcaggaaaatgaacgaggaggttttttaaaatctactttacaaacgaggaaatgtatcgggttccttaagagcctttccaggaaaatttttgctcatttgtggccaaactcgaaataaaacttaggtcccccaactcccaaccctgcgttttctggtttccttccaccactctttctagtatccattttcctggtctccaagttgtaatacacattctgggatccacatttacttgttttattttacataattatattacttgtatactatttccttatacttcatattcttctcaaatttccatgttttatatcatttctgatgcaaactgattacatcattgcttatggcacattcttgactgatatcaacattttaaaccaaattgtcttggtacgcaccctctgatctttggcatcttactgccctgccccatcttcaacctcggctcactattttggtgcctcaggaggtctcaaccatgaaccttccatgtgctctcactgggattggtgccatctgtgacataagaaaaacatagaaacataaaaacataagaaaaactattatttgttgtgatttgttctccctaatctatgaagtcggtagggtatctgttataaagattcccttctagagtcgagaaaacagaggctcagagaggttaagtgtttttctcagggtcacacagcaaatacagaactccagtcttcttgctgtgtctcttaccctctgtcatcaggatgcaggggctgctgagctgagatgcctgcagatgagtaaactggcgggaagaaagacaccaacccaatagatctccatgtattttatatattttctcacctactcagtctagattttcaaacaacatacagaactttctgggatcttgtcatcattcagtgtactgtcctctggatcctctccaggagccgcccactccgcacacatttttttttctagttgtcataaacaaatttcaaagaaagccattttcccagagccctttcttgtgactctaccacagttcatcctggtttgcagaatccaaactcagggcttccttccaatatttttattagttcagtagtcgatcagtttgcacagagaagtggattggagctccccttcccttggagctgccagtggagaaagtctcctccaaccctcaggctcagcaccactcagggccagtgagatgcacaaacagcatcttgcaggtaccacaatgccttcatcacttgtatcttccccgaccctgtgatgaagtaggatgaagatggctgagggtatggacgttgggcccacctccctggcttaaagctgctggaccccttacccggccatgtggccctggggcatgacacagttccccctaagcctcgcttcttcactgtttaaaggggataataatagcatctgctctgttagactgagggctggttaagtggaataacatacttagcacatagcctggtacccacttattttttttattttgctactttgtttcaaatcttcaaatcttcctattattccttttttacagagccatgtcagaaaccttagattcacgtcccttccatgtgtcccttccacatgtccctccttgacctgccacaatgcctctgctccacccagagcctcagcacctgcgttctgccccctcagtaaccagggtccctcacctgccactcctgggttgctctctccttttgaactagaaatttttctaccctcctgcccctccagccaaaattacctttttgatgtcccatttccccaggacactattttgtcctagggatcaaaaataaaaaaataagaaagaaagagagagagagagagagagagagagagaaagaaagaaagggaagggggaaagaaagaagaaaagaagaagaaagaaagaagaaagaaaaagaaagaggaaggaaggaaaagaaagaaagaaagaagaaaaagaaaagaaagaaagaaagcaggaaagaaagaaagaaaagaaagaaagaaagggaagggggaaagaaagaaaagaagaagaaagaaagaggaaggaaggaaggaaaagaaagaaagaagaaagagaaagaaagaaaagaaagaaagcagcaaagaaagaaaggaaagaaagaaagaaggaaagaaagaaagaaagaaaagaaaagaaagaaagaaagaaaagatcaaattaccaggatctgaggacctgggaggatttcagaaatcgctggtcagtcccagcaactaaggctcaaatgccctccccaggattctgctggagatcattctgccagtcactccaggagcgaggggctcacctcttcctaaggcaggactttccacgaggctagaccagaccagtgtcctccaattaattcatttccctgtgtcttccatccatggtttcaaactctgggaccccaaagcacagtggccctttacaaagttgaaggctatgtccctctggcttctgcagcttttcctgatgtggcagggtttcaggtcccctgcccatccaccccccacccctctagcctgactgtctgtgtccctctagagggtgacatgccttgaatggcagcgaaccctggtgtgggctgatggtgtggagtacagagcggtagccgctgccctgttatcagctgcttccaaaggccagggtggtcgttagtgcatcattaataacccattatcgggttgtcatctctgaatttatctaaatttatctcaattattgtaaccctgtagactgataagccctataagtataaaatacactggatgaaaaagctacttcctattatttgttctaaaaaattaactccttcaagtaatctagagtttggtgaccaatttcttattttaccctcctcacatcttcaaaactcagcactggtgatttcacgtctgttgatgggattcatctgtccccctccactagactggaagctccccatagggtgagacccactatagcatcccccaatgtccagcacggaactggagcatcacaggtgccctgaggaatgaatgggtggacggcgcttacagactcgggtgccacttcctcttgtccagctccatgccctcccccatagtgtgtggaccatcgggggcctagaactgaggtcctggttggtagcacccaggagcctgttcccaacatggccccatggcagggcctggtctccaggtgtggcatgaggtgctacatgagcattctgtgagcatcttcagggagaaaacaaagtgttggccaggcccaccggaacagcggcccacctaaacaggctggcgggcggaggagtgccacagaatggacatggggaggccttacaaggtctgtagtagcagaggtagtgaatgtttgttgagttctctctatgcgctagtgttattctaagtgaggtccatgggccacgctttttgctgactacaactctgtggagtaggactaggattatccccattttcctgggtgagaagctgaggctgccagagttaagttgactagggccacacagctgagaagtggtgaagcataaattgaaacttgggcagtctgactcccatatactttaaaagaaaatatttccatagattattggggaacaggtggtatttggttacatgagtaagttctttaggggtgatttgtgagattttggtgcacccatcacccaagcagtatataatgaacccaatttatagtcttttatccctcacccccttcccacctctccccccaagtttccaaagtccattgtatcattcttatgcctttgcatcctcatagctcccgcttatgagtgagaacataccatgtttggttttccattcctaagttacttcacttagaataatcgtctccagttccacccacattgctgcaaatgccattaactcattcctttttatggctgagtagtattccatcatatatatatatatatacatacatatatatatatgtgtgtgtgtgtgtgtgtgtgtgtgtgtgtgtgtgtgtgtgtgtatatatatatatatatacaccatagtttctttatccactagttgatgggcatttgggctggttccacatttttgcaattgcgaatttgtgtgcaagtttgcttttaaccactatgcgatcttggctctcaaggtggaaatttgatgtggaaagcagagtcaggccctggaagaatcccccaggctatctgtaagagctagaatcggtatgatgttctagaagcaattggcctgggcagtgccctgagagcttagcagtgcagtcatgagccagcactctgcctgggtctctgtcacagagtttctcgtgcttggctgcagcctggagccaccttggggagcttgatgcctggggctccccacggattccagtgtcatcggcctgggcatttggcatttgggatattcacaagctccttggtgactccagggtgcagccgaggttgagaaccattgggaatagaaaagcaagaggaagctgttctcacctgccctttccacaccagagccccagggtcccggggagactaaagctggggtctatttctattcccccaaccaagacgggagcttcacatccccacacactgagaggccagaatgggtcagaccagagtgagtgtgctctggctaagactggccgacagctctgttcccctggggtggggactggacgtggccctttggtttaactgcattttactctttccagcctgtctggccattattcttgcaggagcacgcaggactaaagtccccttcctcagcaccacgcatgtcccatctcaccctgtgtcttccaacttcacttgccataaatcagttgtcaggacccccgaccctaaaacagtcacctaatgataaatcatgtttaattctaatggaaccctcccgccaagactactcatcagagaggaagctaattcgcagggatatgaagagctttctaaaattagttccagacgttttttgtcttaaatctgtattatggctgccctatttttaatttactttttgaaaaaccacattgggacactaagtaatctgggggcccaaaagactttgggggccacgggaacctcccaggccctagggggcagtagcaccaccatgcagatcaccagttccacaaaagaacggaactccaccagtacctagtgttattagtataagttttgggaaaggtccttcttttcttagctcattagaaaaacaatcacagcatcctatggactgggccaaagtgggcagacattgcagtccagcccaaagaggcctgtcccagcaggacgccaggggacagggtcagaaagaggcagcccacaagctgagcacagctgcagaggttttagcttgcttactacatttgaattaattgccaaacttttaaactcaggggaattccgcaaaaatctaggtaccagcttttcttgaagacaacggaagctcaggccaccctgaggccatcacctctggcagtcacctgccaagcacgtggctccagcttagcccgagcgcctccacctgccccgtcaaggcccagatgcagtggcccttacccatcacacttgcgctgttctgaccacagactcacagtcatggtcccacctggccccatggacatttgggtttgcatcatcatctaatgacacagtgaagctccttggcctaccagctccctttgtgttcaccttgaccagcccccagctccttgcttctgcatcttgacttctgccgtggtcctgcccagaaccctgagggctgtttctcttccctactcccctccggcttctccttcctacctttccacgctgcaggatggggtacttctgcttgcctcagctgcctggcccctccaaagcctcctttgaccatcagcccagcttgcatggatgcccgggacacatacagcactttcttggtcttggtttacaaagtagtctgccccagtggtcccaccacacctccaatcaactccagaccccagccagccacttgaaaatctgtagtccaggccagagggcaaaaggcacagtcgaggacaaggagcaggcatcccgtgtggcgggagcaggaacactcttgctcagggtgctgtgcgatgggccattggtaggtagtcccagctggtctggtgtgtgaggggagaggcaggttcacccagctgtctgtgcctgggcagggcaactcccgaagtgggctgagggagagctctccgtgatctctaaggagggaggcagcgcattgcagggttagcaaacctttagaagatcctcccggtgttcttcctcccgctcctgccctgcccatagcagaaatcaacaacacgtgggcactgagctcttttccagaaactttccaaagagacccatgggtctggccaagaccctcaggggttgccctcattggcctggggacagtttttgagcgactgctctttgagaagaagtcagcatcagagggagtcagagaagaggggtaagcaagctaggttggggagctgctacccccaaatcagactgcaaagacaggcaagggtcatggccacttccgtgggcccagtgccagacagctccacagaggctcagagagggctgaagggccaagcctaaggaaaacaacaaggctgaaactccccatgtctaacgacatcgtgagcgtggctgcagagctcccacatggcttcctcctccttcccaaggggctgccccaccgctttgccctcactagccagagcaatctaccttgttcactttgcccaagacacagggaggacccttgtggtctttgcaggggcttcacccagttgagctgggaagagacctcacagcatcctccccatctccctggcccgggtttagaatactgaagacacatagtcctgtcctccgtggcctacgcagatccttcctgttcctgagatctctggccccatgcgggcccatctctgcattcctagcttggtggatgccctgcctatctggcttctacctttgattgttcccttggtcactccgatgccatggtcctatagcaatcagggtgctgagtgagtccctgcctgtcctgccttataaggaagagacaattatttgtgtcctgcccatctttgctcatcattgtcatgggttttagaatcaagccgacttggcttttcactcccttaacactgtgagctcctccttatgcaaaacaccacaggcctgcccgccggccttaagcacacacccttctgagcctcagttttcctgtctgtaaaataaaactcaatgaaatgacacaagtgaaactcacctggtgcctgccctcttctcataaatggcccattgcttctgttctcctctcctcccccaggccaggcctcccctccctagtcctcatcttatacccacacctccctgcccctcactcagggccttggctctgaagggagaccccgaggccatctgaaagtgtgagcacagctggcggtggtggctggcatccaggggacgtgagggcgcattcgccccagcgcagcattcctccttcctaagcttgcacagggcctggtattgaagggcagcagattcattccagcatgactactgcagctacctgtgtctcctggcggaaggggcagcctcaggagtgtggagttcagggatccagctttgacttggccacgcccagagccagccagcctcgagcacctgtttcctgtctgggggcacgggaaccctcctgtcctccagggaccccagcctcctcatctctgctgggcagtcatctactacccctggttctgacccctgagacctcttgtcctggagcccgcagggtccagctcagctgtgccccctctcggggccgctctggtggcttctttgctgccaccctccccacccccggcactgtgctctccctgcccccactaccactctcatctggttgcccagtccatgattgtgaacttgacctctacccctggctgcctgggcctacgatcctgcaaaaacccctccaaccagctggccccacccctcaggacttccctcctgtggcagagtcacctgtgacacctggagggactccagtccagtgtgtccccaccttcaggctaacccccttggagaagcctcccgacggtgcaggcacgggggcacagaggcagcaggacattgcaggagcagagacacgaagacaaaagaaacaaatgattccttaagatccatggccaaaacaaattgccgcaattaacacgtgccactgccacgatctatgggctgaaacgtggctggaacgacgcagaagcagaaaccacagagagcgtgcgctccaataaaacggcactaaatggcacggctgtgatggaactcgtttcgattttgttccaaaaccttgtttaagtgcgtttattgtttctgtgtgaaagaacacaaatgctttttgaaaattgcttcagcataagcctcaccttctccagaaagtctttctgatccctcccatccctaccccatgcaggtccgtgacccccacgatgcccccatatgttgcccccctatgttgccacggtgcccacacttccctgtcaccaccagtgtcctcctggcttctccacccccagggactgtgcatcacccgtctccaccccaccccagaacaatgctctgtacacagcagacagcaggcagcaggtgacacaggcccaatggaatgactgtcaaggttaagggagaggtcatttatgaacatcaagggaggcacgcaggctgctaaggggacccttgcagaacagatgaaattcttattagaaagagtcagtgttgatttctcaaaaaatctatcaatcaataaaataaaagcataaagacatagaaacacataaacagagaatcgttttacatggaagatggggagtggtgacttggcctcatagggccataatcacccttttggggttttgtcccacattagaagagcagccccatagcagagataagaaaaccaaaaaagggtaacaaaaactgggcacagagtcaggactggactgaagccccggagagcacgggcagctctctagcaggtggggcaagagggactttagctgggagcacttggcccccagcctaggcaccagagctcgaggggagacccttcccattccctgagagatggagtatgggtctcacttgcaggggagcctcgtgggaatccctcatatgggaagaaggatggcatggaatggcctttctctcccccaacgcccagccaagggaggcaagccctccctgtccgctctagcaatatggcacaagggggtatgatctgccagttctcccttgagaggcttggtggggaccacctgcaggccagctggcagccccccttcacctgctcacaactagcaggccagggggtgaggcatggaccagcatctccgctgctttgagcaatcatgaaaactccaggtccatggaagataagaaattggctatcaaggctctgaggcatgtgctatctgcgatttagtaaatctcttcccacccccaaatttaattttttaaaaaacctccctcctcaagaacttcattctcatgtatcctaatccaccccgccagctcccagcagaggggagggccactctcttgggtccaaaggcccacactagcggggaagctcgcggagccatgtctctgggggccgtttttactttgttttgccactgtagaggccactcttggcaagaagcctttttcactaaaagccatcagctgcagaagaaggcaaagggctgaaatagcatcaggtggaggaggcggccctggagagaggcctggtttccatcccagctctcccaccatctgcctgtggcctctgcaagctccccaagccctgggggccttcgtttcctccctgcaaagggagctgccctcagaagcactcagctcggttcttggcatggggagtgattagctctgcacaaacctggtagtttcacgagaagccatgtaaggtagagaagtcgctgaaggcatctccctctcagagttaaaaggaaacagaaagactggatcttgtgtctcttcctctttttaaaaagggaattaggcctggtgcagtggctcacgcctataataccagcactttgggaggccgaggtgggtggattacctgagatcaggagtttgagaccagcctggttaacacggaaaaaccccgtctctactaaaaataaaaaaattaaaaacaaacaacaacaaaaaccattagctgggcatggtagcgcacacctgtagtcccagctacttgggaggctgaggcaagagaattgcttgaacccgggaggcagaggttgcagtgagccgatccagcctgggagagagtgagactcggtctcaataaatacataaatgggaagtcatatcatcacgaggtccccacttaccctcatgacctcatctaaccctaataaccttccagaggccccgtctccaagtatatgatcatgttggggaatagggtttcaacacataaacctggggaggccggactcacacattcagtccattgcacaatgtatcaaaaattctaattgtattgggcaagcctacactgcccaattgtaagcgaagtccctgaggccggagaaatcaaggtatccatcagtgaatacagggtattaagaaatgccaaagcttactgctcaagttcatctcctgctgaccctgcggccctgctgcctgggcctagaatggacgcacttctccacaaggccttgtctttcttgagattctcacagtgtgacccgagaagcatgctccacaatttcttatcaattgaacactaaaaatcccatctagctatgggatgcctagtttctcctcctggattttgtggttaaacccttctgtctccaatgcaatgtagcagtgagcacagctctggacccgcatcccaaggcctgaggtctaacgctgcctctgccccctcctttgctgtgcagcttaggcaagtcacttcacctctctgggctgtggttcctcatccatccaatgggagggttgaactgctctttgtttgctttgctttgctttttctttttctttctttctttttttttttttttttttgagacacagtctcactctgccacccaggctggagggcagtggcttactgcagcctttgcctcccaggttcaagtgattctcctgccccagcctcccaagtagctgggattacaggtgtgcacaaccatgcccagctgattttttttgagatgaagttttgctcttgttgcccaggctggagtgcaatggcgtgatctgggctcactgcaacctctgcctcccaggttcaggtggttctcctgcctcagcctcccgcgtagctgggattacaggcacctgccaccacacttggctaattttttgtatttttagtagagatggggtttcgccatgttggccaggctggtctcaaactcctgacctcaagtgatctgcctgccttggcctcccaaagtgctgggattacaggcgtgagccattgtgcccagctgctcttccctttttactgtcctatgactggtctcccaatgccagctgagagtgttggtctgatctcttttcttctaagctggccacacaaatggacctcagttactcagtagcccttaaaatctggtaccagtcaccatttaggcctctggacatcatccttgggcaaaggaggctttttttttaagcttgggcctagccctccccacttatatcctggactgtgaaaatggaccgagtgggcaatagggaattcaggatgagctggaaaaaaagaaaaaaaaaactcctgctgcaataaattacatcacagtggagatctctttctacccagaaaattctgagcccagacaatggcttatttatttcagacaatattcaatacaacagaattccaggtcaatagaaggatttctgcaggttcttagagttggtagcaaagggatttaacccacggagaaaagagagctgttcaataatagattcccaggcgtgagggaggccttattaataaatccatcggtggtctgctgaaaatgctgccccctcccttgcgggcatcccacctgacgacagtgggggactgatgcacccagggccctgaccagggaggacgtttgggtaaatatttgggcagagatggctgctgctagaatggtgagcagagctggggagcgcaggaaacggcccctttctcccaggccctcagatgagacatttttataaacatccaggcaggcagcctctgaagactcctgggctttacaaacacatctcgtattctatagtcagctgagaccatgctttgagcatgggcggtaagaggagcaggaagcaggaggggcggggaggggtctggcaccagctttctaaatttaacatgcagttgcttttaggccagtggataaaaaataaattccagtgcttaaagctcttatctttgtttaccatttccccaaacagctagtgacctgctctctgactcctacagcaaatcatcaacgagatgcacacgaagatgagggatgggaaatgcaggaggggtgtgcggagggcaagttgatggctctccgccttcccgtcacgtttatttggcctggcagagtgaccaggatctgctaaggtcatgaggctgtccctgggtgggtgggggcgtggccatgctgcatcagaccagtccagaggtggagggcaccttggggtctctcgtgtggctctcctgttgatgagggacctatgaatatcccacagcgaccttttcagatgctccataacctcgtgtgaaaagccccggtggacctgggcttgcctattgcattgtgaagttgtagtcctttgaaaatcctgccccacgtggagtcagaatctttctttctgggactgatgccatggggcctggctccacccccacaactgcatggcacagcactgccttttccttggccatgggctcgccctgcagatgggtgatgatgcgctcctgcctcccttcagtttgttctgttctcccaaattctttcagtgtgcctggtagaagcagtctgccagtctcccctcgctccctctcattcatcccctctctaactactcatcctgcgaccccactgacttggttttggccttgtccctgccacagttgacaaatataatggcgcgtcttcttcttcattattatcattattattactggcaatcatagtccactctgcctcaaactcctaggttcaagtgatccttccacctcggcctcccgagtagctgggattacaggtgcacaccaccatgtctggcattttttttttttttttagagatggggtttcactatgttgtccaggctggtctcgatctcctggcctcaagcaatcctgccacctcagcctcccaaagtgctgggattacaggcgtgagccaccgtgccagccatcaatggtctctcttagtcttgaatctcccaggcactgtccaggagatctgagatgttttccagggtcccttactttccagttgccctgccaccttcccctgggaagcattaaggttcaatgcttggctctgtgcttgtttttcttacccctatcccagaggactcatccccgtctgtgcgacaccatctccccacttctacgccaagctgctcacggtctcacccaggtggggtggtggagggggcctccagcaaaatcctgcaaaagctgatctccttcccctggaagatgctgccccacccatgtggtcctctttctgtgtttctctcagccacttaggaatgaaaccagggaatccctttcatctctcttcattccctgacccgttaaatcccaacaccctcacctcccctggtagagcttcctttatgacagtgattctgaaatccaggctgcatgtgataatcccttgggggacttctaaaacaataccaattcctgcaccccaatccagaccgattaagtggaaatgttttgggatgggccccagcatcaatagggaacagccaagatagacagccactgctgataaggcttctctctttcagccccttttcccattctgactactggccttgtgattggagcacctcacttttgcctggactattgcaagaacctcctgtcttattgacctatttcccaactctttctacctcagccatcctacatgtcgttgtcagatcacacaaagccattttcagtatgttatcttgactcatcaaaaaccttcagtggctccctattaccataaaaataaatctgtgaatgaacaaataaatggtttcccaaatacagagtaagttctatatggcacagaaccgtatcttatcccctctctttccctgcccctcaccccacacactctgctaatcggagtaaatagagggaaccaggatctgtggggtgagtgaacaaaagcattttctctgcaaattaaatgtggtccactcacttcccagtgcagagaaagtgggctaggtgatttaactatcacttacttaggggcttatttctttcaacatcatatacagtcagctgtgaatgttccatactaatggaaaaaacagaatcctaaatattaccaaacagcagataattcaaagactcgaatctagttgatgttggaatgcgtttttgcttatgagtgctgagtgcttgtgtctgataattggggcaatttttaaaaattaggtaattagatgtgttttatttgttcctatttccccctccccccactatacacacacactatatgaataaataactcagctcccaaaacaatgccctatttctttctctcagtcctttcctggaatagagatagtggttacatttcagaatattagcaaggaagggagaagaaactggggaggagcctgcagttagagtaaatagaagaaactaggatgtcaacaggctgcttttcaactgattcactgttaaaattttaggcagtgtgaacaacctgtctgtcaaactgtttgcaatatctactaaagctgaacatacacatccctcatgacccggcagtgccatgcccagatgtacacccaacagaaacctgtactctgttcaccaaaagccataaacaagaatgttcataaggctttattcataatggcccccaacctgggaacaactcaaatgtccattgacaaggaaaaggatggataaatccgggcagctcacccaatggagcaccaaatcatgaggatgaacacaccacaacacacaacatgggtgactgtcacagacatgaaactgagcaaaagaaggcagaccgaaaagcctgcatggaaatatttcatttataggaagttcaagacaaagaggcaaaagtaatctctcgtgttagaagtcaagacagtggttactactgaggggcatgtgaccgggagaggccacgggtgtgcttccaagtgctggaaggttctgtcttggtctaagtgctggttacacaggaatgcttacagtgtgaaaattcattgagctctaagtttgtgtttgtgtcatatttttccatatgcgtgttattcttccataaaatgtacaagaggaaaggaagggagggaaggctggagggagggaaggtaagaccaggtaggcccaggtaatggaaaaggcttggaatttgaagacctggattcagttccaactctaccattaactggccgtgcgacctgggacaagtcacttcacctctccaaatatctggttttttttcatctataaaatagacaataaaagctgctctacctacctcacagtgtggttgtgaagaccaaatggtataatggatgtaaaaatccattggtgagcaataaagtgtttcacaaggcaaaacactattattattctagatctctgcagacagcaatttctgcagcaggtcagcactgtcagtgaagctcagcccagagccatcatggagaagactgatgccccgtgggttgtgtgtttgtgtgcgcacgcagcctggtttatgttttttcattacatctctgcacctaatcccttaatggcctgggcctcagagtacaaaaacacctggaaaaatctctgtgtttttatgagacgggttctgtccccttctaaagcaggtataaatagatgccatgtacactctcttaattactttttctcgagtatggatgaatttcaacatctaaatctgccaaattattgaagctagcacagagaactttctgggcattggccagggaagccagcaatgtggatggaaagatttatcaccccctctcataaccaaacctccatcgtatctccctgcaagccttgaaactgctcactggacccactcagacaacagagctatgggatctagaaggtgaaatgtcagagctcagagaacctcagctccctcccaaccttgccataagaactcagggctggccgggcgccatggcttacgcctataatcccagcactttgggaggccgaggtgggtgaatcacctgaggtcaggagttcaagaccagcctggccaacatggtaaaaccccgtctctataaaaatacaataactacgtgggcatggtggtgagcgcctgtaattccagctacttgggaggctgacgcatgagactcgcttgaacccgggaggtggaggttgcagtgagccgagattgtaccattgcactccagcctgggggatagagcaagactctgtctccaaaaaaccagttgcaagggtgaggggctttgcctctggtttatggtcagaagggcaaagcgaaggtcaccccattttccacggcttggtttcatattatagtcccacggtccctggagaatcagagtgaatggaaatctttattcttcatatggctgtattgccccaagctgtcctcgtgcttaagggatttccagctccggcttctagagggcaagggccagcatcacttggcctacttcttagtataagaccaagtctagtgacagctgggtaggcataactactacagatgctgctgttcctactgctctgaagaagaaaactgaagccacctctgcttctatttcctttaacaacatagaaaaatgataatttttctattaggtccgtgaatctccaggaaaaatctttgtgaaagcaatgacatttttattttctttttctcatttatactccagatgacatctgcacacacacccagtgtgtggcgtatgtgtaggtgtgtgactgtgtgtgtgtgtctagctttcagagaaaatgatacacaaaatgataaatatagaaaagagattaataggagagggcagtactgttatttcctacataaaaggatttatcgatagattgcccatagagttagttccctaaaccatcaggttaatctattgtatttaaatgtatttaaatattgggccaggcagagtggctcatgcctgtgatcccagtactttaggaggctgagactggaggatcactggagtccaggagttcaagacaagcctgggcaacatagtgagatgtccccgcatctctacaaacaaacaaaaaacaattagacaggcatggtggcttgcacctgtagtcccagttactctggcggctgaggcaggaggatcgcttgagcccaggagttcaaggctgcagtgagctatgacagcaccactgcactgtagcctgggccacagagcaagaaaataaacaaacacatattggtttctagatcctaaactatatgatggaaagactaagagaccaagaatcttaggaataaaattagaagttactgcccattgaaaatcaactacatatgaaaaagtctcccccaaaatgaagaaactctggtttgagaatgtaaatcactaggtaaagattctgtttattttctttatttccatgtttcccaatatttaattttcaaccctctaagagcagttattttataaaataagtcccagctgaaatgaatttgataggattttagaatttctttctcccttaacacatcctattagcctagttcaatagagagagcagagcgcctcatgttgaaataagctttcccgccactgaatgtgttcaaacagaaatatcacctgcttaggaggtactttccagttgccaaagacttccaccttcatcttcttgttcactctactctgcaagatgggtgggacagcattacagacgaggggtcctgtagatactgtcctgacgactggcccaaggccatggctaagggttacagacccggaacagaaccctgccctttgcctcccttgtgggacccaaagccaggccaaggtcaaggggaggcgctgcagggggggcttcctcattgggtgtggacagcaaaggttgattttgagatttccccccagctctaattctcagtaatttggcctttgaaacaggaggcagagagaaccctgggggatggcttttcatgttatcttttggaaacatagaagcttcaggtgcttcctggcttgaaataagagaatattctgctcagtcccccacatttttgagacactccaggcccagcagacccacagcaccctcactagctgttggtaacgttggtgcctggatgtactgacagaggaccaggtgtgccaagggcctgtcacccaggctgtagtgcagtggcactatctcggctcaccgcaacctctacctcccaggctcgagcaattttcctgcctcagcctcccaagtagctgggattacaggcgcccaccaccatacctggctatttttctattttgagtagagatgggatttcaccatgttgcccaggttggtctcgaactcctggcctcaagtgacaccccctgccttggcctcccaaagtgctgagattatgggcgtgagccaccgtgactggccgataagaattcttttctaaacatgaccacaataccattatcaactaaaaccaaaatgaatgttcattccttgagagcatcaaatatcctgttggattcacagttccctgattgattcatatttgttttaggttggttgcagcagcctctgaacaaggccatccacttttcactggcttattctcactcatcctaaaaatctcagcctggacattgtcgcttcctcctcacagagtccctgatcccaaatgtgggagatgtgtgtctctcatctgttctcccatctcacccttatccacttgtttgcatcctgatagactggaagctccgagaggctaggacatgtccgtgcattttaaagttacgtctcccgggcctagcacagtgcctggtgaatcatgctcgccaattccatatgtattccttgaatatgtaaatgaaggatctcctaaacagaactggttttgcattcctcgtaagcacattcgataacactttacacatccatgtcatgatttgtttaggaatcggtttcctcaatggacagagcctccttggacccccagcacctggtcccgcacctgacccatccaaggtgcccgctgaggaactgctgaatgaaagaggacttataataaattctatgttgagactttgggttcacaggccttcctctctgggcctcatttttctcctctctgtcaaggaaggatggctgggaggatttccaaggtcctttcccgggacggggagtcctcatttagcatgcgcttgttgccctctgctggcagaatttgctcaggaccgttctgtccctgctattcctgaaagctgcagacaaagccagcaactgctgggtggaccagccagtgagtgggatagggacttgagttttgttgtctcgctggttcgactaagacatggaggtgtgtgcgtccttctgcctcatccgttcattcctcaggtgtggagaagcgctagggtaggtctcagacagacagtcggaaagacctatgcccctgagtgcacattaggacagccagggggctaaaaagggagagctggtgcccaggccccacctcagaccaacactggggagtagggcccaagcatccatctatactaaaacatataaaaatctggctgtttctggctgggcgcggtggctcacacctgtaatcccagcactttgggaggccgaggcaggcggattgcctgaggtcaggagttcgagaccagcctgaccaacacggtgaaacctcatctctactgaaaatacaaaaattagccgggcgtggtggtgggtgcctgtaatcccagctactcgggaggctgaggcagaagaattgcttgaacccaggaggcagaggttgcagtgagccgagaccgggccattgtactccagcctgggcaacaagagcgaaactccgtctcaaaaaaaaaaaaaaaaaagctggctgtttctaacatgcagccacatggagaactgctgaaccaagatggtctttacatacgtatctttttgtttgtttgtctgtttgtttgagatggaggttttgctcttgatgcctaggctgtgatctcagctcactgcaacctccacctcccggttcaagcgattctcctgcctcagcctccagggtggctggggttacaggcacccaccaccatgcccagctaattttttgtacttttagtagagacagggtttcatcatgttggccaggctggtcttgaactcctcacctcaggtgatccacccacctcggcctcccaaagtgctgggattacaggcgtgagccaccgcacctggcctacatgtgcatcttgatctaaaagcctagaagcacagttaaaaagagaaaagcctatctagggaaagagtaaagactttgattttctaatacaaaattcgcttagcctatctttaaaaattttctttctttgacaaaccgtgacaacttacaagccatacagttttcttcggggaaccaacaccatttacccattagggatgctgcttccagatccagtttttctttttgagatatagttccctatttttgtgtaccgcacctctgtttcttgtttgatacatgcatattcctgcatttgttaagattcgtttggttgcagacaatggaattcagaatgttgctaacttcagctgcaagtgagaacttgttggaagggaccaagatgccacccacagggttacctgccaggagcagatggcaacaggaactggaactccatggggcaccgagaaatggtctctctgtcctttgcttctgctttgttgtatacatctgattcatttcttctttcttgaggccaactgctgttttctgctcattaatccacaaggccgaatgtggccaacaatgggtctccacttccctgtgttcaatcgccacctgctggagaaaaacttttttctttgtcccagatcgaaatttccagactggcccctttgggccagtcaatcttggcctgcagggctggctacaggatctgtgaggcccagtgagaaataaaagcgtggtagcctttattcccaaagcagggggacgtgtccatcgtggtactcagcgagcttctttgtttcttctgcagtctctttttcgacttgtcatggtgctttttattttccatttactgttgttctaagtaaagaaaactcaatgttaaattattagcaagcattttaccattcatctttatatcaaacaatgccagttttaaatgtaaatttcagagcgtttaacttatatgcagaaccactgaaattacacaattggtgtttgtgacttgttggccagaagagacaaacacaaaccaaactcataaagattggaagcaggaagacaagttgcctccaggtttgcccaacggggatgttctttcaggcctggacatactggatgagcggggggagtccagacccttccaggcatccaagggccctgtcagccaccagacacatgcactgagacccagccagggaggcaggatctagggaaattggtccagctgtctcccctttccacagccttccccagccagccacagcagactaacctccaaggatctctaaacctctgtgctatgacaccctcagtacctgggctaggggtgggcagaggtttgcccccatcgagaaacagcctccggccggccccgccacatacactgtgtgctgccagcctagggcagggacggccaccaccatgccaacccgagatgctgcagggtgcatgcaccctatcctggccctctctgtgcctgtacccaggaccctgtgaagtgtggacagcaacagtggccataggtcagggcagaaagggggaagccaggtggagagcacaggcagctgagagctggtcgtgggaggcagccacaggtggagccatgcataagccaggcttccaaagcacagattcaaagataaagttacgtccgggtgcagtggctcacgcctgtaactccagcactttggaaggccgaggcaggcggatcacttgaggtcagaagttggagaccaacctggccaacatggtgaaaccccatctctactaaaaatacaaaagttagccaggcatggtggcagatgcctgtaatcccagctatttgagaggctgaagcaggagaatcacttgaacccgggaggtggaggatgcagtgagccgagatcacaccactgcactccagcttgggcgacagaaaaagactctgtctcaaaaaaaaaataaataaataaaagataaagttatgaagactctcaagacagcgccacagaggattaacccccgcacagagcccttttcattggtcacttgctcagccagctgccccagtggcctgtgatgggagtgggaagtgtggggttgggtgataaccttctaaagttagaaccgttcccagaaatgcagacgggagagctttgggaaaaccatccaaaccttgttattttttatgacaaagtaggaatgccaccctggccctctaaattcataaacagtcacagacatgggattaaactacatataatttctgcaacgtggcttataggcatcattaaacagctgcaatatgttgaatggctatgtcatcatagattagctacgatactggctatggacttcaagactccatgtgtcctggcccctgcccttccacccctctgacccgagatgcagttctaacaggttcccgggtgatgctgctgctgctgacccttgcccatcccggagctcactttgagagctggctgagatcccaggcagggtggccagtggctgctccagggctgtgaagggctccccctgcagacggaggaactaggcctcccagcgcctgtaactggaacgttggcggcttgagaatggacttgccctgaaggccggcctcctgctgctctgggaaaaagagggaacagaagaaagcaatccgccaccttggggactcctcctggattagcattatctaggtgaagaaagtgagaccatcacctaccaaccagataactcattccacctctgtgggcaaactggcagagcagcaaataagcttccttaatcccagtgcgcccacaccctgctcaagagctcatgggcacgtgttcatcttcaggccaaagatggggagccagggagtgacagactgtcactccaggagagtcacccgggggtgttaggatccccacatttgcaccccctgaaatctaatcagcattttccagctgttcctaatctgacctgtgcaaatggaatctcattggaacttgcatttttcattatagtaactcatatggcctctgtgtttcgcctgttcatagcctttgaccatttttctagctagttgtcttttcctactgactgatagtagctctttggtttttgttactgttagtcctttatagatgtggcaaacttttttatttgctatttcactatttgccttttgacttcataatgtgccatgactacccatgtgacaggctctttgagcctcagttttctcatctaagagatggggaaacagtcaccacactggcttagtggagcatcaaatgcggtaacgtctatgctgcacttggtcggccacatcgtcagctcccaataaatgctggcggctgtggttgccgctgcagttttataaccaaacttctctgtattacgaagacccctgagccccaggctagcaccgtgaaatataagcacaatagaaccactgagcgccaatcagatgcaatttgggtcataccgactttccattttgtggggtttctgtttaaatgtttgccaaagttggaaacgagattgaaatttaaggaaaagacaaaatgctgtgagatttgggctaacacgaacttctccctttgtcacgacccctccatcagatggcccctgagttctgcagcctcgaggaaggcctgccctatctggacatggtgattgcagagacgctgaggatgtacccgccagctttcaggtgtgtggtagccccctcccctgcccgagtccccacctcctacccctaccccctgccccagcctgcaggtcagggccctcctccatcagttaccacttgtgtttctggagggcaacgcctgagtcctgggttcctttgtatccccatggcacctcagatatctggcccgctttcctacaggttaacaaccttctcaaagcttcacaggcattttcttaacaccgccttcctccccagcccaagctggccctttggtctcctagcctttgctggcttttgccatttcccctgcctgttcgttcattcattcattcattcgttcattcattcattcagcaattgtttattgagcatctactctgtgccaagcattgggaaatcagctgtatataaaacagataaaagtccctgactgatcttggagctggcattcagacagtaggggactgtctgagtcctgggagctccttcctgccatccaacacccccagctgtcccatcctggagctccaacacgactcaccctccaaaacgtctcactgcccctcaagacgtctgtgttgggcttgcctcacctggtcctccctgcccttcctcctcagcactttgagctgtaactatacacttcatgttatattcttggacacatatctgccactccatgacatttcactaatgtacacaccaaccagccggtcacaccaacctgtgggtatcttgagagcaaaaccaactattgtgcttcgttcaaactctcccaaacaaggcactccatagagaagggcatcttaattcatgtccccagacccctacagagagtgaagtaacagccagatttcaggctctagaaacagaagcagcacaaagcattaaccgtatgtgataaattccactcaacacttttatgaattaacagatcacataaaccatatggaaatacctttcaccatttttaaagacaatatgtggatgatttgagggtatctcaaaacgatatttcaacacaaaagcattacaaagaatgcaattgtagacattgtccaaatgttcaagtccagaagcaaatacagaaaattccggtggcgtgattcgaactgcattgtcctcaagcacacaaggttttgggtctcagtgtggaagcaggccagtcactcaggggctctgtgccccctctccccatgccagcattaagacctgatgtgcagcccttccctgatctcctttggagcctcttgcaaactgtcatccaattctttcttttattcttttttttttttttttttgagatggagtcttgctctgttgcccaggctggagggcaatggtgtgatcttggctcactgaaacttctgcctcttgggttcaagagatcctcctgtctcagcctcccaagtaactgggattacaggtgcccgccactatgcctggctaattttttgtatttttagtagagacggggtttcaccacgttggccaggctggtctcaaactcctgacctcaggtgatctgcctgccttggcctcccaaagtgctgggattacaggcgtgagccaccaatcccagccttatttttttcataattgatatccagctttcttccaaggggattgtgggaagctggtgtacatgttaaaatgaagttcaagataaagcattcagggatcaaatagaacaaaggccatttaaaggaaagaaggccttacagggccccagagctggctggtagctggggtccagctgtggcttggtgaccagggctcctggccaagagggagagcagccaagccaaacaggtgtgttctccagcaagaggacagcacagaaactgatcaatggacacagtacttcctggacctaaactcagccacgaatccatcagacaagaccttattagctgtcatgttgaataacaaagggattaggctcttcaacatgaaaatgcggtggccgattctccactgacccgttataaacagcagagcagaaaaggaagttggtgcaggtggaccaggaagctggtgatctcacctgaggaccagacagaaactagagaacctgggtgaagtagttagaattcatctaacaggtctagagggcacgtcagaagaccatcttggccctggccttggcatactgcgtgatcgtgagcctcatgctgctccgtgcctctccttcctacgggttaaatggggacacacacctgcttggctggccctgcagaagcaggcaagaggcagtgggtggcacaggtggaactgtagtgcccgctcagctgcctgcagcatgatgtgtgcagggaggagcgccggcactggtcggacagtggaatggacagcttccatccagcctcgctctcctgagccgccccttccccacacatgccccacacccgccccacaccttccccacacccaccccacacctgccccacacccgccccacacctgccccacacccaccccacacctgccccacacccgctccacacctgccccacacccaccccacacctgccccacacccgctccacacctgccccactcccaccccacacctgctccacacctccatacctgccccacacctgccccacacccgctccacacctgccccacacctccatgctggccccatacctgctccacacctgtcccatgcccgccccacagccgccccacacctgctccacacctccatgcccgccccacacctgccccacaccttcacacctgccccacacctgccccacacctgccccgcacctgccccacacctgccccgcacctgccccacacctgccccacacccgctccacacccgcttcacacccgctccacacccgccccacacctccacacccacaccacacccgccccacacctgctccacacccacaccacacccaccccacacctgcctcacagctgctccacacctgctccatgggcatttttcaccctatcagctctgctggcttttcttattgatcaccagatatgagagagacaaggtgtcacaattctcacccagaccagaggacaatctgcttctgctcaaaggatttgggggtgaatgtagggagagtgagcatttttattttattattttatttcatctcaaaaagcgtgttgacttttcccaagtgctgacacaacttggacttattcataaaagaaaatcagaatcgcccttgtgggaaacacagcagccctgtctgagcgccactgaggtgactcccggatgctgtgcggtgcagttctgaagcttctgttgatctcttatgaggttcagtttacggggaagggaaggccctattttccagcttccagggggtctgcctccaggtccaggctgtttccagaaaagatgaacaagcagggtgccagggaacagcttcatctgacccctttggaactgcgggtacagacatcacaaaccccagctgcctgccctggtttcagtgctggtgtttgctatcagctccaagcacatataattgcattagcagcttagcatctcaatgggttctccacgccctggcctttttctgttcctgtctgttacatgaaaggctcataacagagagggagcagcaagaagccacaggctgcttttaatctcttacgggcaggaacagggcataacagtaattactgtaatcattgcatttcctttaggatatttagggaagtccaatcctacagcttgaagtaaaatccagcatagaattattttgaatttttaattatttatattgccaaaatagcatgcttatacaaacaaaacaaaaccaaaaaaaaaaaaacagtcccggccgggtgtagtggttcacacctgtaattccagcactttgggaggcaaggagggaagatcacttgagttcaggagttcaagaccagcctgaccaacatgatgaaactctgactctactaaaaatacaaaaattagccgggcatggtggcagaaacctgtaatcccagctacaagggaggctaaggcaggagaattgcttgaatctgggaggcggaggttgcagtgagccaagatagtgccactgcactccaccctgggcggcagagcgagactctgtctcaaaaaaaacaaacaaacaaacaaaaaaaacagtcccctaaacaatgaagaataaaaaaaaaagaaaaaaaaaggccccctgccattctccatcccaatcccatcccctagagaagagaaagatagaaatttaagtattcttctagaaatgttatgttcatatacaagcatatatagtctaccctttaaaagtaaagcataaatgagattgtgccattgcccttgggtaaaatgaacaatctgatcaaatattttcctctctgggagaagaagctatcggtagagacatagacaacagggaacagattttcaaacccaaatttccttccctcaccaggactcactcagaggagccaaattaacaaagaaagtagaaggctgtctgccagggaccagggagaggggaggggagggagttagtgtttaagggatccagaatttcagtgggggaagaggaaaaagttctggagatggatggcagtgctggttgcacaatgaatgtactaaaaccacagaactgcacactgaaaaatggttcaaatggtccattttatgttctatatatatatatatccacaatgaaataataaacaggtgagcagataaataactaaataaacccagcctcaccaggaccaattctgatgttccaatattccagaattatcatggcatttgatggacggtttgagcctgtcctcattagatgttctcatgtcctgtgttaaggacttaagactcagaagatttttcatggattccaggcacgtgggagtggtacagacaggagcaggagtgggagcccgtgtacgggattcattagggaaacagaactttgctacgttgggagggtatctcgaggacaagccttgacagagggtgtgaccagcgtctcctcccaacccccgtgttacctgggataggaaatggcctgaagtctggaaggtaggaggcaggaagtggggcttggttttcttgctgtgagccagatctgttggagtgggataatgctgaagtcagagagagacttctcaatcgaaccctatagtcacaaaagtagttgggaagggggtgggctgagaggtgcagggaggtgataaagagaagctggggctgtaattctgccctcgtcctaaaaggctctatctcatcctttaaaatcccaaatcacctgtaaccagaactttttttttttttgttttgagacggagtctcgctctgtcgctcaggtgtacagtggtgcgatctcagctcactgcaacctcctcctcccgggttcaagcgattctcgtgcctcagcctcctgagtagcagggactacaggcgcacgacaccatgcctggctaatttgggtatttttagtagagacggggtttcaccatgttggccaggctggtctccagctcctgacctcaggtgatccacacacctctgcctcccaaagtgctgggattacaggcatgagccaccacacacccggccatgaccagaactcttgagagcgtgtgctcaacactcgaagtccaaaagtctacccaagttcaggaagagagcggttcttcacctctccacctcgaattttgtttctagaatgttgcatgtaggtctgaagagtgacagcacgtttgtttaacaggaactcaaagccagcagatcaggaaaggacacttataaggtttggagtttgggttacagaggtttaaggtaggtcttttgtggcaaggaatatttgaaattgggcaagatgagtgagctgagatcgcgccactgcactccagcctgggcaacagagcgagactccatctcaaaaaaaaaaaaaaagaaattggggcaagatgtatgacataacaatttaggaatgagtgaatacaggtaggtgagttgaagggagttctgacaggtaagactgttgtctggcaagtgaactgtttgctcacgcaagcaaaccattgtcctgataggaaagtggtttgctcagacaaattagtttgcattaatttcctgaagccaacagtgaagctgtttcttggttcagaggtttatcttcctcggcaagaattttctggagcagagaggaagtcactgacacaggtggtctcgatgctcactccaagagttgagttgtgtggctccaggtagactcatttcccagggtcacctgctgggccataatcaacaaggtacaagcttaagagagccatgccgggatttcaagttgcaaggaagagagattcaatggtgctttcttgagtcacgggtgttggttgtaagaaactggtggggtaaggaagctagaactctcccaggaaccaggaacggctctcactggcaggcctcacggaggagacccaagctgggggactggaaggtggttcagattgttcacaagctgcagtggctccagcagtcagattggggtgtgatctcacagcaccaggagccctgaacaccagcctgaggctcagccctgaaggcagcttgaccaggcaaacctggagactgcatcaacaccagcagcctccaacacacctgacctgctcatggccttaatcccaaacccaggtcctaaactacctctcactgtgcatcgcaagtcactgcccatcttcctggcttctgatctgctgccgtccccgattcatggcctcacttcacccactgattgcccttgactttgagctacaggtttcaccagctaactgcgactctagcctcagctctggggccatacagcctcaagcacctgggtcttgctccagctccagctccctgttctaggcagcccatccttgggaagaagcagacaaaactgcatgtcagagacatggctctggttgtcatgagaagactggattgcaaagaggtcaatgagagacgagaatctaaactaaggagatggcagtaaaactggagagatggcaccatacgaaagaccagtgatgaatctgcagacggggagagacgagtacaggatggcttctggtttccggctttctcaagcctgtgtgggaaacagaaggaggagaagattctgatgacctgctgctgctcaggccgacttcgaggattctgtggaccgcccagggaagaggccgggtctgtgggtagaaattggaacctggggttcaggctggggctgaggtaggaggcttaggagataatggaagttgaatctgggagggcagacgaaatccctgggaagtgccaggatttaagaggctggtggatgcagaagagcctgccaatgagggagaaatcaaggaaagaaatgtgtgtgtgcatgtgtgtgtgtgtctgagagagagagacagacacacacacagagaatggtaaagatgatggacacaggccaggtgcagtggctcatgcctgtaatcccagcactttgggaggccgaggcaggggatcacttgaggtcaggagttcgagaccagcctgaccaacatggtgaaaccaccccccgtctctactaaaaacacaaaaattagccaggcctgttgacacacacctgtagtctgagctactcgggaggctgaggcaggagaattgcttgaacctggaaggcagaggttgcagtgagcagagattgtgccactccagcctgggtgacagagcaagaccctgtctcaaaaaaaaagaagaagaagaaagaaggaggaggaggagaagaagaagaggaggaggaggatgcagcaaaaaacagcaggtgaatctgggtaaacgatacatgggtatctaatgtactattcttcaacttttctgtaagttcagaattatttcctaatgaaaattaaaacagaaaaacaaacaaaccaaagaaatgtgcaagaggaagacaatcaatgacatagacagaccaagtcagatgaagactgaggagtattcatcagatgtacccataaatattctttggggatcttggcatggggaccatccacaggagggaggggacagatgccaggcagcagggctagtcagtgaaatgggaggagagggagcgagagggtgagcaagggcaattttaagaggcttggctgtgaatgggaagataggataggctgtggcccaggaatgaccctccaggcccccactatgaaagcaatccttccaaagcagtttgcaccccgacatggggcacaagaggggccctttgtgcttgacaaatggatgcatgaagggatggatgagtacattttcatcaaggaccaagtgagcctagcctcggggctgcaggctcctgggcagtgagtggtaatggggtgggggcttggtcaccctgggaagggggctgagcagggggtcctctgtccccagcctcattccacacaccatgctgcctgcccctgatccccttcacactcagactctgcctgcccagcacgccccaagctctgctcctcatctcttctctgtatccacccccgacctggtgtttccctcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggtgagtactgccccttttaaaaagctctgaagggatgtgagtgtgtgggatagaaatttaccagtggaggcagcagccgggaggcacagacttagcaaaattgtccccaaatagtcaaaagttatggcaattcagatagatgtttgcaagacataatttccaaaggaaataattataccattttttagccacgcgtggtggctcatgcctgtaatcccagcactttgggaggccaaggtgggcggatcacaaggtcaggagatggagaccatcctggctaacacggtgaaaccccatctctactaaaaatacaaaaacttagctgggcgtggtggcgggcacctgtagtcccagctacttgggaggctgaggcaggagaatggcgtgaacccaggaggcggagcttgcagtgagccgagatggtgccactacactccagcctgggtgacagagcaagactctgtctaaaaaaaaataaataaattaaataaaaataaataaataaataaataattataccattttttcaaggtccaaactgaatccagagatttagcatttcagcagccctgcatgcaaggaacaaggcaatttcaaatgattgtcttccattcattcaagccaggacatgggatacaggattgtatttcaggtctgcactggaaagtaacggaacatcatttcctttttaaaaaacgggcatctatgccaaaacaacagcttcagctgatgtctccatgaatctaaattcacgtgatccactggttgacctgggtccccgccttccaccacctggctttggttcattgtctcctttcatttctgggctctgtgattggaaacatctgagcaggcggcccacactctggtcctcatcagaaccagtcaatatcctgtgtgtgtgatctggcaagggaagggctggcccggcaccagttgtgttttcacctttcatggctccaactgagttcagcccaagcctacgacccagtcactgggaaaacgtgagcaatgggatctacacaacaatattccacagtcagcagctcctgaacgtgccgcagccacagggcttacagcctcacaataaagcccaggggtagtaaaaagtgagctcgctgttacagaacagtgagtgccacctagcttcactgtcatgggacacacgctgcaggcaaatgcactacttggtaggagattcagcagttctgaggaagggcctccagctctccaggtactgcagcttccagtggttcaagtgtccagtgcaggggcctgcaaagcaaacacgggcaggagaggggctgccagtgtggcccaagagacctgcagggcaagccagcaggacacgccccccagggagggcccaggaggtgctgaggtgcccggtaccctgccaaggaagcaggtggcggctgggtcatcctatgggaggggaggtggcgccatgggcccaggtgagggtgatcaccaaaccctggggttcagggatgccgtgtttagactctgattgtgggcggcggtgagtctgtgggcttactagccacacactgaattcctaaggagaggcagggagggagctgtggacattccaggtgattctgcgaattcagctctgcctctggggctgtgcaggaagacaggaggccaggagcagagagggactgaggctcaggaatgagcagccatcagctcccagagccttggagacatccttgtctcagatgcaggggtggctcagctggagcacagggctgcagaggggagggagcgggtgttctgggccagccctgaccacacggacctgcaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtgaggcccccctgctcagaggcaggggcaggggcaggggtgggagggccaccccagttctctgcgtgagagcaggccagcctgggggcaacatcaggctctgcctccgtgagcttgggcaagctccttaacctctctcggcctcagtttcttgattcgtaaagtgggggtgataataataacaccctctacctctcaacatcctgtgaggatccagtgagttcacacagcgctcaggtaagccctggcaagccaacccgagcacgtgttaaccattgttattagtattgttctctgcacaccagggctggacctcaccttgctgtagctcttcccacttccacaaagggcacacagacaatggcatttgcagttgtgacatgtgcctgcctttgcggggtggggggtgcatggcttgtcctacagaaggtggggacacttcctctggctcctcctgacagagcaaggtgctgtctgcttggaggggaagctgaagggtttcagctccttgaagggtacccccagctttgccttccccccttgtgcagacactcacgtgtccccatggccacagcctggtccctctcacaggtggtgacacagcctcttcccaacaacatatgccttcattcctgaggtcctagactggtgcacagaccctgtcctcacccagagagctgagctctcctgaaatggggcctcacccacttttccagccctatctcccccccacatcacacactccagaaccagcagaccaattcctcaacaggtcagggagcttatatcccctgctttcacactcacagcaaccctgcagagtaggagtgactattcccattctttagatgaggaatcaaagctcagagaggttaaataacttgcctaaggccacacagcaggactgcaggcttcgtgatggcagggacccagtctgtcatattcattgttggactttccagcatctagcttaatgccaggcgcatgacaggtgctcactcattcattcaacaaacattaatgagcaaatggataagcagccagagatgagagaaacgggggtcctcacccagatcctgcccactcccaagctctccctccttcctgacatctggctacgtctctgcacagcgttagctattccctgcctatcctgaccactgctgtcccctgcacctatcctcatgcttgtcctgccacccggaacccactgttcagctgcagacctggacaggcaggcataggaaggcataaggacacagttgacagatagcaacaattctagattgagacaggcagtgcctctgacagagaacctgggaccagctgctggtcctggaggaataatgagcttggatgggggacatagagtctgagatactgaaagtgaacgcatccacatactctgggctggagacagggaggggcagatcggcagagcagagccaaaccaagtgaggtcaaggggcagacggaggagcagccccactgcatcggggcttccacgtgtgcggggcttgtctcacttccccacgatctcaacatacagtacagcagccagaccagtctcccaaaacgctgcttatgcctggcactccccggcttaagaaccagccaggagtcaagggctccccgttcttccttgtctgctcagacaagtgctggggcctgcagctttttcagatgcctttgagggctatggctcccacaggagacacgtacagccccaagcactaagaccctggtgactctttgctgtcacattagccactggctcatcattttactcagctccagaggaaacccaactcctcgagtaattctttggtttttcttcaaagtccccagtccaccactggctctgccttttaagctggacataggaaagctttctggatgtcagtgaggccagaccacagcacacatgagcaggaacagcatgaagctgctttccccagagcccctgggccagagggcattgctcagttactggccagaactggagagtgagatggggaggatcagcagggacggctggagtcactgaaagataggtttggggctttgctctctgctttcttcttgtgtgaccttggacaacggacttggccttcttgaacctccaagtcttcatttgtacagtgagatgctactatctctttgacaaatattttaattttctctattttaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcacttggttttgacattgccaatggggtttgaaccagtgctctctctaaatgaagaattgctgataaataagtgaaaatgtagttttgacaaaacaactgagaatgtggggttttaaaggaagtcccaggcttgtgctgaaaggaatccatggtgcagggcacatgaggacccccaggtaagcctgtcctgatggcactagctcgtggctctttcagcttctcgtgcattgtggagttgtagagaatgacatttatcgaaagttcaacctcagcagtggttccaaagctttattatgctttgattttcctaggtagggtagtaccaactttacagtcaagtttcaatcgacagaaaaatgagagtctgaaaaatgatatactttttcttttaaagaacactgtatcggccgggcacggtggctcacacctgtaatcccagcactttgggaggctgaggcaggtggattgcctgaggtcaggagttcaagaccagtctggccaacatggtgaaaccccatatctattaaaaatacaaaaaaattagccaggctgtggtggcgggcacctgcaatcccaggtacttgggaggctgaggcaggggaattgcttgaaccagcgaggtggaggttgcagtgagccaagatcgcgccactgcacgccagcctgggtgacagagtgagactccatctcaaaaaaaacaaaaacaaaacaaaaaacactgtatattaattttgatcaaagaatcaaaatatagaggtgattttttttgtaaaaataagtattgtgttgctaagcagttcacattcaaccaagcacttgcaaggtcagtctcacgatcagccaccagcagctgcgcattcatggctgctggtgaagagccgtatcacctccctgtgcctcagagacctcttctgtaaaataaggaggctggcctcgatcaaaagaccacttgtcctctagttgacacctgagcagctttaagaggttgaatgttgtatagagaacgatcttgtagaaatctgtaagccccttatgtgacacccagatgctgacgacccacctttagaaacttcaggccattttgggagagttggcagaatgagtttccacatattcactgctgggactgctgcttccactgtttggtggtcccccatccccttcagccaggagcacccactgtatccctcaaaatcccccttggggggccccttctcttattctctggccctccaggcaggaagaggacaccccagctgcccagcactgggccaggcctgtgagtgactgctgcctcaaggtgtagggctgtcctgtggccctccccacacccttgttgccaccacctgcccttctccatcacctggcccctctgcaatgcccagcctgggactcagactcactggagaaaaccatccacccctgggaacctgtcggcctccctgcctgtcccacaatccctgacctccccacggctgccgccaccatagaacctcagcctgcagacaggcccaatggcgcactcagctccctgcttggagcacagccccacaacctgagtcctcccttgggacctccggccccgccccccggcctgtcagctccatccagcttccctcgccttcccagctcagttggtcaccaccttcagacacagtggtagaggcttcctcatgtgctggggtcactggactccagtccttctactgtgtgaggccaccaaccccacctctgcttaaatcccactgttcacatccaacaccaggtatcacagggcagggaaccgcaccgcctggtcctccaaaaaaccctcttgctagattcccaactgagtcctcacaaagattctggccaatcccacacacatacacccatgtcccagaccctaccacctcttggcaccaaacatcttgagagtcacagtcatttccaccccttcccatcacaatgcccaccctttctgcaccggcaggaacggctccctccccgtcatcaagcaatctggccatgtggctcccaccctccctagcattgctggtccaaggagttgctcttcctaacctgctttcttccaggtcacccagccatggctgccagagtcttcacagctcagtggacttttccggagcaactgagcatctcccaccggatccctctggccgccctccccatctacacccccagtgaaccagttctgctccccaaatctccccagctcccagatgattcagaagcatagaatcagttcacttacatgcaagaccttagcaacagacatgcatctgatttaatggttttctctgacacctctttgcccctgcccaactacaccatagcaggaccaatgacttaatgaaaaagcaatgagtgaaatggcaggatcagtcaggctgtgaggaaatttggagggggttctgaaaatcataccatgggcaaccatgtggctgacccagctgctgggtgaagctgtgttgttcttgctgttcctctggtcatttaccttggctctcctccagcttgactgcacttgcctgtgttaaggtttcagatcactccaaagatggaaaaatgggttcatattcaccttggacctgagaaatacaggcaagccaactgaagcccaagcagcaagtcgccagcagacacacgtcctcaggaaggtggaggctgggcaaaaagcatgtagtgaggaccgagtagggagggctgacagcctggtgacaccagtggccccgccagcccctctgccaacagggccagaaccagccaaagcccagaagggaggctcctgtaaactgccacgtgtgagggacacacacaacactctctccacatgcacagcacattgctcagtggtgaacctgggtcttacggggcctgaaacttatctacgaattggaggaaagagaaaaaaaaagtgtaacatttgcaaattttatcaaaacctatgaccatgtgaccatattgctagggtccctcctagggcctggggaggggctccagcaagtgaggggccctgaaccttcagcttcactgtcttcttaataaatccatacgtagctcaccaagccgtgtcatcagctctgtcacagccctgataacggtctgaatgttacgacccccaaaattccaatgttgaaatcctcacccctgaggtgatagtatttaaagtagaggtgattagaccaccagggcggagccctcatgaatgagattcagtgcctttataaaagaggcccttccaccgcgtagggttacagtgagaagactgaatctatgaggaagcaggaggttgcactttatagactccaaacccggtaaataaacatctgctgttgatgagccgtccagtcaatggtgttttgttacagaagtccaaatgaacaaaggcaatccctgactctcagaaaaacgcctggcactcagtaggtgctcaatcaatagacgcagaaaaatgagcttcagtcttcatccacttcggataaattttcttttatttccatactcttttgtgacatgtgtggcacaagtattcaatctcacagggatgttaaaacccacactcgaagggtgtccagtgtgcttaggaaatgtgggtttgcgcaatcacaggccaagcctgggggtcctcggggaagctactcctccaggtcacctgccaggtggatgcacttccttgggcaatgggtgaccctcccaggacaaggggaaccagcagggactcgatggcaccacacagcagccacctgttctgacaatgtgacacagaccaactaatgccagagcccaggagaagccacagcagagctgcctgggttggtgtcagagcaacaggcagaagtgactgtgccgcccgtgggctgtcatccaccggtggctactgtgtcattctggaaaaactatgatgccatgagactctgagaaaccgaatcactgcagagacaaactcataaaaattaaaaccaatccataaaattgtatctagaaactctgtccctggtgccaataagcagcaaagtcaacaaagagtaaaaactaaaacttcaacacattattaaaaagcaaaactggactcaactacaatcacttctggttagtccactagtgaacccaaaagtgacttaaaagtaaaaatcattattagcaagagattaagaacataacttcattgagaggtcaatgttaagagaacagttcattaaaagtttctgtttaaaaagaaaaggaaaggcccaaatagccatttcaaggcagagcaggtgaaaggcctggaacactcctgtgcgctcactgtcggctgctgaacagggagcccaaggccagcaggatggagggtgtgaccgagggcttggaggaggtggtgtactggatgacatactctgggtagacctggtgtttctcaaagatcacaaagatggaggggtcggacacactgttcacgcagctatcatagaaggcgttgctccagccctccttggccggcggacggacaaaggaggcattgcccctgacgaactcgcccaccagcacccgggccaggaacatcgtgtgggtctgcgtgtcggatttgctgtagtggtgggaatatgcagcatctcgggcaaagtagctccctgaaatgacacacgagggctcagctggtggaggggcctgcagccaggaagggtcagcacactgcgaatagcgtcctggtgatgtgcaacgccagggcctctactcttccaccccgcatctccctccctccctctgtgccatgtctccactctccctcatgaagtcacatgcatcagtgataccaacacccttctgagtggcagcatctgaggagttaccaaactgagatagcaaattcctttcaagttccggatctgccccacgaaacctaaaggcctgtggacacgtcactacttaatcccccaaacctcagattcctcaggcataaaatggggctgttcagcccaaccttacagggttggcatggaaaatgaatgagatcccatatacggaagcagtctgtagactctggcagcccaatgtatagaattatgagccttgtcaaatggaaatctgagttagaagctgtcacctgtacatttaaatccacaagtctaccactggctgctgtccatcttgaccccttgccatcgctgcctcagacggaaactgactaacaaagaactgatggacccggaacatggactgctgggcagaaaatgttctcaacttggtaagcatattgtggttacagaagataatgtcctgttcttgggatgtgttaaagggtgaaaggagacaatatatgccacctacctgaaaatggtgcagaaagagagagggagagagaaagagagaagtggcagcatgttaaaaccaatgaacgcaggtaaaatttacccaaagaggttttttttaattattattattccaattttcttgaatttcgatttccaaagaaatagtattttaaaattttctttggcaagtttaaaaataacagacaagaaaacactcagataactcacgtgatagctagaatacatgtttacatgagtatctctgagggtttctggtttctattctaaggaaatcaatagtaaaggcacagtcagggacttcatcagggctgggaaggtatcccctctcctctcccgtctctgtcaccatctcccagggcctctgctccacagggaagcaacaccccagcctaggcaggccaccctgcccacacctggggccaagctcctgaccatgcccagaggagcaagagcaaggatgtgactggtagctgtgcccaggtaccaccacacatggagtctgaacctgctcatcagctcaggctggtcccctcatgccctctagcagtctgttcctatgcaggggcaaagcaacatgggttttgctggtggaggccagtcatgccttacccttgccgtaggaagtgccatgaacaccacagacccgccagtcaaagttctgctggcagatggcgtccacaaaaatggcgctggtgccgtggaacagctgccgctcgtccacggccttccctccgttctgcttctgcatctgtcctttttgcctagaatcacagaagaatgtgtgctgggggcagagtgtgccggccaccaaatacagccggcctgatgcaaaacaacacatttttccaaaattccaaaagtgtcctgggaccaagagacgcaggtcacaggctaccctgactaggcctgtaaggctccagccacaagccagggtgtggaaaagaagggggatcgtgggagctgggtgaaaaccctccctccacagctccagacagcagcggttccctggactccaaaagcagagcagcccttggaaaatgggtaccatttcccccaaccccacccccaccttgctcctgcgtggagctgagccctgggatgctgtaggaattttcaggctgctggtcagtgggtgcccatccttctcccctctcccattcccagacttcatcactgtgcacagagtacacattacactaccccaaccccatctggggacaggtcagcaagacccagcctgccatggtgacctattgtaggattcctccccacatagacaggtgagtgggtgctcaaggacaagccagtcctcatgtatgaacctgagacccctgctgtctagccacagccttatgttcctggggctaatggtgtggtgggctgtactgacccatcccactggtctccaggaaggcagaatggacaagtgagagtgctagctttgccaccactcatgaacgggaccaggtggtatgctccaggaagcctcggtgccctcatctctacaatgggatgtgctaccacactgccctgggggagcggacgaaggagagcagacacacagctcccagcacatggcagccctaactgccgctctgcttttcctggaaacccgggccacatgtggcaaccagccagtggtgtgaagggacagagtcaccagcccaccaagagcgagccccaacgcaccactggtagacttcccagagggccaggttctgtactcgctcaatcttctgaacaaagtaaaaaggcagcgtgcggttaaagaggttccagaccttctgatactcttccgaggaagaactaagggtgatcttctgcaaggggcaaatgtttttaatgcattaccatcaacgtgcagaatataaatcagtcccttcccaaagcttcttgtaaacactagaaccgcagaagcacaaaagcccagagagcagtgaccacattctcctgtggtttctccaggcacaggagacaatcggtcctcatgaaatgtcattgataggttcttggaaactgcaattttaagtaaaacaacaaacctcttgtttatgtcagttagcatatgggaaattggtttcgttagacagtatgttgtgccactttaagtcagtttccaagaacctactgatgatgttgaggatttactatgtttgcaaattgtagtcactttgctcctcatcactgtgaaaccaatctaaaggacagacacgtgatgcttaagccaccatcgagggtatcccctggatgtccctgccttttttttttcttgtcccacacaggccaaagacacaggttggactacatggtccaaggaccacagagtcgtctagacaaacatgttgaacccctttaggtccttagcacttcttgcctgcactgttggcatctgcatgtgccttatacaagctcaataagtcctcccaggacagggaccgtcacgttttaaagctgagttagacagtgctcggcagccggccagctggcagacatcagcccaggtgcagacgggcagcctcagatgttagtctgcgtactctcctgcactcagcacagctcccactggtcagagcccctcaacaagctgccaaattgactgtccattctcctgtctgctagtcgtgaatgccttccctcctgacagtaaccccattccaaacgtccatcggactcaggtcctccccaggctgcttctccttttctcgcttaataaaattggtatttattggttaagcccagcccataaactcatttctgccctttctagcaaatttcacgctcatcctcctccctccacaagacaacccctcccctcagagccacagccaactcctgggtggtgaaaaaacaaaaccctctgcaaaaaacaaaaacaaaaataaagcccacatctgtcactgccctcctgccccaattagccccagccttacagcttcttcagtgttgaggaatggcacagtctgttcacacacacccacttctacagaacaccttcctgtccagccccaggcgcatgcgtcccctacctgaaagcctgggtctggcagggcagaggagtcccaatagtctgggatgctcttcgggcctggaaacttggtattgctacaaaaatgtaaacaaaaacacgtagacattttattcttacacaaagcaaatataccataggtggtctctgctagccaatatcaccagtcttgcgtctcagcacatcatatttcaagagcaggtagaaggcaaggaagaatgttagcacgatattcacaacatgagagcacttttatctttgcctatgtagccaaactccaaacagtcctgagagatctatttctcgcctgtgtcccaactaccacacaaaagggataaaagggatggagtacatggttaaaggagcacacacacagccataaacctttatccacaattctgaaattctaagagctctaaagacatttttttaaggcctcgatgaggtataattgacattttaaaactttttatacagctcaggaaaagcaggagaaaatatgaaataaaacattttttgaaaaacataaaagtgacatcaaaagtcatttggcagtagaaatttgactgaagttagtaagaggccactgtgatctgtatctatccttcttaaactgactatgcatattgtttactgcagaaatattaatgtgctaaaatacagagtgtcacgtgatacaagcatcacattatctttctaaaaattaaataaaagcagttcaaaagacatatggatcaagggttcaggaacaaggactgtgaaactataattacaaatcattcctattaagtttcagaatacactgttctttctaaatagatctaccttctgtttctgctggcatgaaacatataccttcatcctaagcctcaaagaactcccacaaataactttcctgggaaaatggcacagttcgaaaataactaagcaaggtcctaccagcaagaatcagccaaaaacagacccacaaagacttaagatgctgaaattatcagagagattacaaaacaattattcttcctatgtttaaaggaaaaaaaaagacaaactttaaaaacatatgcaaggaacaggaaactataaaaagacctggaagatctaaaaaagaaccaaatagaacttacagaattaagtacaatctttaataataaaagtgtagtggacaggcttaatagcagattagaccagctggaggaagaatcagtgagctgaaacatatgtgaaatgaaattgtccagaatgtggcccacagcaacaaggaaatggaaaatgcaggaaagaagttgagacatggagaacagtgagaacttgaatatgatcagaacctaagtgaagctctaggagaggagagacaagacagtggaggcgattttcaaagagaactgatgagatgcacctatccgcagcttaagaagcccaaagaatctcaaccatgataaataaaagcacatacttagatacactttagtgaggatgcctacctccaagacaaacagaagctcttaaaagtagccaaaggaaaaaagagtgattactgtcaaagaagcacctgttagaccaacaggcaatttctcaaaagcaacagtggaagccagaatacagtggagtgatcatcacaatgatccaagagaaaatccctacaacccaaaattctatacccagt

SEQ ID NO: 2003 - DNA, 2151 bp, Homo sapiens
gtgtgcacgcgcgcgcgtgtgtgcccaggtgcgagggttcgcgcgtgtgctggcggggagggaaccgacccgaaagagagccccacgctggcaaagtggctcgcccatctcacagccggttggcgctcgcggaggagacatatactgcctggactgcctggctgatgtgagctagtttgtctggttgagttggatgtttaaatagaaggcagaacaacaacaggaaagagcacattgtgggggcccactccatgtgatgtttgcttggttgcctgttcccttttctacctgcagagcacggttcccataagggcggcgagatcagcctcctgtctcatctggaagaccaccactctggggtctcagaggaatgatggaagccttggggtttctaaaattggaagtgaatggccccatggtgacggtggccctgtcagtggctctcttggccctcctgaaatggtactccacatcagcattctcaagactggagaagttaggcctcagacatcccaagccttctcctttcattggaaacttgacatttttccgccagggtttttgggaaagccaaatggagctcagaaagctgtatggacctctgtgtgggtactatcttggtcgtcggatgtttattgttatttctgagccagacatgatcaagcaggtgttggttgagaacttcagtaactttaccaacagaatggcgtcgggtttggagttcaagtcggtagccgacagcgttctgtttttacgtgacaaaagatgggaagaggtcagaggtgccctgatgtctgctttcagtcctgaaaagctgaacgagatggttcccctcatcagccaagcctgcgaccttctcctggctcatttaaaacgctatgcggaatctggggacgcatttgacatccagaggtgctactgcaattacaccacagatgtggttgccagcgtcgcctttggcaccccggtggactcctggcaggcccctgaggatccctttgtgaaacactgcaagcgtttcttcgaattctgcatccccagacctatcctggttttactcttatcatttccatccataatggtcccactggcccggattttgcccaataagaaccgagacgaactgaatggcttttttaacaaactcattaggaatgtgattgccttgcgggaccagcaagctgccgaagagaggcggagagacttcctccaaatggtcctggatgcccgacattctgcaagtcccatgggcgtgcaagactttgacatcgtcagagacgttttctcctctactgggtgcaagccgaacccttcccggcaacaccagcccagccctatggccaggcctttgactgtggatgagattgtgggccaggccttcatcttcctcatcgctggctatgaaatcatcaccaacacactttcttttgccacctacctactggccaccaaccctgactgccaagagaagcttctgagagaggtagacgtttttaaggagaaacacatggcccctgagttctgcagcctcgaggaaggcctgccctatctggacatggtgattgcagagacgctgaggatgtacccgccagctttcagattcacacgggaggcagctcaggactgcgaggtgctggggcagcgcatccccgcaggcgctgtgctagagatggccgtgggtgccctgcaccatgaccctgagcactggccaagcccggagaccttcaaccctgaaaggttcacggctgaggcccggcagcagcaccggcccttcacgtacctgcccttcggggccggcccacggagctgcctcggggtgcgtctagggctgcttgaggtcaagttgacactgctccacgtgctgcacaagttccggttccaagcctgccctgagacccaggtaccgctgcagctagaatccaaatctgccctaggtccaaaaaatggtgtctatatcaagatcgtatcccgctgacacagaaggctgccgggtggggggagggcacccccaaattcaaagaaaaccctaagtgtggatgttcagaattttggaaaaatgtcactgaagtgattgaaagagtgcctggcatgcaaggataagaggttctttacataacatttcctaaatgcttaataaacgtttgttgcact

SEQ ID NO: 2004 - protein, 534 aa, Homo sapiens
MMEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNEMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 2005 - DNA, 26533 bp, Mus musculus
  misc_feature (1)...(26533): n = A,T,C or G
ttcgccaactattcccatgggaccaggaatatataatggttttatagaggattttggatagtttttccctctctgtgggtgccaaagaagtcacgagtagaagaagagatggaaggtctcagggtttggagaaactccagagctttccaatcaggcaggagagagtcagaggaggggtggaccaccttgttcacccttagcttgggtttctaccgctgtgataaacaccatgaccaaaagctccttggggaggaaagggtttaatttggcttcggcttccacatcacagctcatcaatgaaggaagccaggacacgaactcaatgcaggacgtggacctgcaggaaggagctgatgcagaggatgtggagcactgctgctgtttatgagccctttctccagttcttgctctgtcttcttatagagaccaggaccagcagcctgtgagtggccccacccacagcgcagtgggtggaccagcagcctgtgagtggccccacccacagcgcagtgggtggaccagcagcctgtgagtggccccacccacagcgcagtgggccctcccccatcaatcactaattccctacgggcttgcctggagcctgattttatggaggcgttttctcaaatgaggctccctcatctcagatgagtatagcttgtatcaagttgacataaaagcagccggcactacttcttcgtacactaaaatgtttatgtagctgggtgtggtgggcaatgtctttgatctcagcacccagaggcaggcagatttctgagttcaagaccagcctggagagaggctcagtggttaagagcactggctgctcttctggaggtcctgggtgctgggaattgaacccacatggcgcctcacaaccctctataactgtagtcccatggggttcgatgccctcttctggcatgcaggtgtacacatagacaaagcaccagtatacatgaaagaaatatttaaagaacagtgtggttacataggagaccctgcactgcaccaacggaggggggggggcattgtggtgcatggcacctgtattacagaagatctacaatggctctgaaactggtcctaagtgtggcgtgtggggttaatgattagctggctgcttggctgacttcctttccacgggattgtgagcagctcacctgcagaagaacccacagaaggcagcatgttccctttgctcctcgtggctgagctggtagttctgagcctcgtgacttctgttaagagccaggagacagatcccctacacggctccaaggaccagccactcttccgtggagctgatcggaatgactttgccatcgtggtctctccaggagccatcgaatgtttctggcaatttgctgaccagatgggatacctctacttcagctacgaggtgcgtggaggcctctggccataccttttataaagtgagccaggcttttgatgaagccaaggtctggttctctatgaggctgtggctgccacttgtgaatcaagtggaccttcagttagagagcaactctgggtgagacttggatgaacagccagcaacgggagctaaagcatatggcttggtctagaactggaagctacagaagtgtgttccaatccaatggacaagagaggcaacctttagctttcctcggatatgaggaaagacaacacgtgctaaaatagtcacataattgtggggcacacacctttaatcccagaactcaggaagcagaggcagggggatctctaaattcaaggtcagcttggtctacagagtgagttccaggacagtcagggctacacagagaaacttgtcaataaagaagaaacgagcctggcagtggtggcacacacctttagtcccagccccttgggaggcagaggcaggcagatttctgagttcgaggccaatctggtctatagaattagaatgagttctaggacagccaggactgcacagagaaaccctgtcttgaaagaaaaaaaaaaaaaaaaaaaaaaaaaaggaaaaaaaaaaacagaaaaaagaaaaagaaagaagaaatgagagagagacagaaaagggtcccataatagattttaagtgaaatcacttgagttaatggggtgagacaaggtcagacctcctgcgtgtgttaatcctaacaacctgtagaataaccggctcaaagctttgtctatgcacccagacaattctgttcctctttggaaggtgcctatcccttgggcaagtacacccaaaggggcttaggccaccaaggaccttaatattaaagttagaggtaactttggttttttttgttggttttttgtttttaggttgtgggggctcttggggagacaggatctcatgtagcccaggcactggcctcaaacaagatacagcatcagtccttgctggtttgttttgtttgtttgtttgtttgttctttctgtagaccaggctggtctcaaactcagaaatcctcctgcctctgcctcccaagggctggaattatgggattaaaggcgtgcgctaccactgcctggcaccttgctggtttttgagtgatgtagtaaggatctctctctctctctctctctctctctctctctctctctcttttaccggtgatggcaggttcagcgcattctcgggatgtcacatgaccgccacattgttgccacggcacataccccgcagggtttccttattgacacttcccaggatgtaaggggccagattaactttgctacacaagaaacaggtatgtattcatctccaaagctacaataatagtcaaacatttctatgaaattgagaaataaaggctgggcggtggtggcgcatacctttaatcccagcactcgggagggagtgccaggcgtatcttggtcagttcaaggccagcctggtctacagagtgcttccaggacagccaggactcttaaacagagaatgtaagacaggatggggcactaaagacctggtaatgagatctaggaattcccacaggcttctatcagctttgtctaaaaaatgagcagaatcgcttcagttctatacaagtgtatctcaactttggagtcttctatgaggggcccgaggtggatcacaagcagagtcaaaggaagcaactgaacgacactctggatgcgattaaggtaatgggatgggcattcttgggggtgtggcctgaacaagggaggactcataataaaaaccaaatgggcaaaaaaagctgaacccttcagctcattatgtggcacggcgctcctctggtaccaaggcttgggcaaacagtggctaacagacctgtctagtccgctgcctgtttgtaatactcattcacaaacttgtgcagctaccctagtacttacagcagaacaatctcccgtccctgcgagaaactctacacggtcctcactgccccatcccctctagaatctcctaaccctagaagcgctgttgcactgttcctgtaggttttctgtaaacagaagcatgcaagtggatttttatggtcccttctttcacaaagcacggctttcgtttgtttgagataaggtcttactatgtagtcttggctgacctgaattgaattcattttgtagaccaggctggccttgaactcacagagatccactttcctcttgagtgctaagattaaaggcattcaccaccatgcccagtctgattctttttttttttttttttttttttttttgagacagtttctctgtgtagctatggctgtcctggagcttgctctgtagaccaggctggcctcaaacttagctccctgaatgctggaattaaaagtatgcaccaccactgcctggaattattattattatatataacagggtctcacactctgtagctcagactggccttcaatttgcagcaatccacctgcctcaccttgagtgctaagattatagacccaagctgtcacacctaatttacatagtatgcttggctggtccttggcccctttcttagctctgaacatcctgctgtgtaagtacagctttgttcctgactatccactcaccagctgactacatgtgagtttctaccttttggctctcacagtgctggtgataatgtgtgcaaacaagcttttgtgttttcttttcatgtagctacaagtggactttctgggcatgacttaaactgcttacttttgtatgaactacccgacagctatgaagattctgatttatttctttctctctttctttctttctttctttctttctttctttctttctttctttctttctttctttctttctttctttcgagacagggtttctctgtgtagccctggctgtcctggaactcactctgtagaccaggctggcctcgaactcagaaatctgcctgcccctgccttccgagtgctgggattaaaggcatgcgccaccacgcccagcaagattctgatttctatccatcctaaagtattggtgatagctgtcctggtggtctcataaacctaacagtctgcagggacaaggtattggttaggaaggtgacggcatgttgaacacgcatctcaattgatagtggcttatacaagtaacctcaacagagtaggagatcaggattcaaagtcacccttaactacacactgagtttgaggccagcttgggctacgtgagaagtagcccaagtgcttaccttgaatgttcaaggctgctgagtttaggatgtggggagtttgtgggtactaggcaatcctccttaccactggggtacatcccaagccccaactatgcctcctaactttaaaactactccaccaatttttctcaaacaaagtcaaagtaccatgtattaccaactgctgtagcactgtttctcaaactcctgagtcacaggtcacttagatcagggcaggtaagacccaaacagcagccagagtggctttccttcttcccacaggacagcacacaaagggtggagaaccaagttttccacatgtggcgcttctacaactatgccaggatgaggaaagtggctgacttcttcctcctgcagtctaactacacctatgtgaactggtggtccacagctcagagccttgctattgttctttctggggccctccagctctattttttgaaaagactttttactgcttcaactactgacacaaagaagccaagatgctagctaacacatagcctatttgtcaaagctttgatcaaatgggctttggaaagttattgggggggaaaaaagtcaacttatgtcccctttctcttgtgtccaccaataaaggcaaatgtttaacaaaaagtgagttctgctgctgatcattctaaaatacaaattaagtgctaaaagctaaaagtactgtttatctgaggcagggtttcaatatgtagccttggctactagaacttgccgggtagacccccactgctggcaaggtgtgtaaccccatctgcagcctagaaacatctttatccagctgtccctcagccttcactgacgcacgcctttaatcccagcagaggcaggcggatttctgagttcgaggccagcctggtctacagagtgagttccaggacagccagggctacacagagaaaccctggaagtgggttcaaggatgaagctcccttcagtaagagcacctgctttgtatgcagtttgggcctcgatccctggcaccacagaaatcagggtgtggctctcaaatctgaactcttagcactgcagagggagcactaagatcagccttaggcagttcaagaccatatctcaaagtacgttaaaagctctgaaagagttgatacggagacaactttttggagtttaaaaaattttaatccattgtagaggactacaaaggtcagcaatgtccccaccttcaaccttgtcccagggattgaacacagcatcaggcttggtggcacatggctgatccaccctaccaggctgtccactgagctatcttcttggcctgtagtgtccttcaacggttggaaatattttactttatttaaaagatgttaccattggaaactggtgtggcgacagacctataataccattacctgagaggctaagacagcctgggtcccatagcatttcagaccaacttagatataatgtgacaaatgtctcaaaaaataaaaatgccccctaaaactgacataacctgatcatatcttaagaaactgttctgccgggtgtggtggtgcatgcctttaatcccagcactcgggaggcagaggcaggtggatttctgagttcgaggccagcctggtctacaaagtgagttccaggactgccagggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagacagggaagatggctcagcagttcagaaagaacattctcttttagaggactgaagtttggttcccaacaccaacaatggccagctcacaactgtccttacctcaggctccaaggaatcccaagtgttttctgccctctgaggataccgctacccaagcaggatatactcacacagacacgcacgaacaatttcctgttttgagacaggataactctatcccatgcaggatgctttacaactgctattttttatttatttattatatgtaagtaagtacactgtagctgtcttcagacactccagaagagggagtcagatcttgttacggatggttgtgagccaccatgtggttgctggggtttgaactccggacctttggaagagcagtcgggtgctcttacccactgagtcatctcaccagcccctacaactgctatttttaattctgaatatcactgttacactgatgactggaggtgttttttcagttttgtgggttttgggtttaagactggccaggatctccttatgtagaccaggctggccttgaacctatagagctccatctgcctttgcctcaccctcaagcccccgtgctgtaactaaagatatgcaccaccatacggcagggtcacgggttttttcttttaacaaaggaagaaaatgaagcctctctaagcagagaacttgtccaccaccacagctggcaaggggcagaactgaggcttgaatacagacgcttccacgctataccccacttaacaccaagaaaaatagccaaaatgcacctattaaatttattaggatagcttagtggttaagaccactgctgtccctgcagaggacctgagtttaatttctggcacctatacggtggctcacaaccagtaactctagttccaggtctgaaatcaccttgacttccttaggcaccaggcacataagcagtgcacatacgtacatgccaacaaaacactcacacatatgaaataacaaatataaaaccattaaaatttattaaattccatatgtaaaaccagaggctcatatggccgtttctacctttaacattaacacacaatagaaagtccactgtgctatcatgagcctggaaaacagtgttatcacagataacagtaagatggctcctgtcctcagtgaagtaacttagaaaccatcactcagagcaagtcttctgatccaaacaaaggcgacgcagacacaaaacagaaacacgctatttactcacacaaaacactctcaggttctggtttgtctgttttagatttttgagacaaggctcactatgtagcccaggctagccttgaactctccaagtagcctgagctggccttatacttgtgatccacctgcttttgactctagagggccagagaccctgttttcacgccatttctgttgataagaacccaagttgcgtatctcagtgttgtccagatttaatctgatggccgcacacaggaaacaaagctaagtcctctcacacagcaaaatgttcttggaatgaccgtcctaagtcagtgtctcttcatggcgtacgtactccccaatgtctgcttggtggaacaccacaattgccatggggtccacttttcggcagtcttgggtagactttgctgccaccccaaaaccctggaattgaaagaacagacattcatttataaggaaacaaaacaaaacaaaaactatattgaaacagctgtatctttgagaactgtgaaaggagccaagaagtcagtctccgagctgctgactgaaacttcatcctttccagtgggtacctggcatttgccgtgatggatggctaccgtggctactcaccagaggaatgtccgccatggaatagacaaccactccctggtactgagatgtgttctcagtaattcgacccagaccggatttcaacacatggtttccatacaagaaggactgctctgctcccggctttacccacactttatactgaaagagagttaaaagccaagacacaaggatgttgggctatatccctgaatgcggattagcagctgcttccgagtttaaggagaggtggggaacctttaagttgtttggaccccccccccacttttttgtttttgtttgtttgtgggttttttgtttttttttgagacagtgtttctctgtgtagccctggctgtcctcgaactcagaagtccgcctgtctctgcctcccaagtgctgggataccccaatttttgatctttcaccatggagttccttcctcaacctaacatcgaaattcaaccttacatagaaatgctcacataggggctggtgagatggctcaatgggtaagagcacccgactgctcttccaaaggtccgaagttcaaatcccagcaaccacatggtggctcataaccatccgtaatgagatctgaatccctcttctggagtgtctgaagacagctacagtgtacttacatataatcaaaataaataaatctttaaaaaaaaaaaaaagaaatgctcacataatcagcaatttcctttttttttccccttggaccctaggatcaccctcaccactggcacttgtgtcttcgtctctgctttctgagatccagctgacacggtggaggcctgttttcctgtagacaactaggctatgcagctccatggccataacccttcctaaacgtgtccaagcagcaatatcgacaaacaacttcttaggctgacgctgtccagaaactcgttggaaagaatctgtgctctgacctggccgccgtcacccgggacttcatcccggatggcaacctggagaccaggcccccacaacgtaccttggcatagggggccaggtaatccagagctgtcacgtgcaagcggaacttgtgggtcttggtaaacttcccaaaacacgtccccagcgacacgagcttgtctccggagatgttggcggccagcttcagcatcatctcactacaggggcgcgggaggaaggtacccggtgacgaccagggatggatgcacgcctccagcccgccacgcagtgggcagcacgccccacctcacctcacatagtacactcggtcgttgtgcagccggaaacagtacgtgccgtcgggtctgtccactaggagttgcaggttctctccgatgctgagggcaacaagaccagcggctgagccgggaccgtcccgccccggagccgcatccccactccccgcacgcccgtccctcatccgcctctccagttcttactacttcgcgatcttctcaaacatgacccgggtctcttcttcagtcaagggcctcatcttgccgcttgcttggctcccgggaatcctcgtgcctggagagccggaagcggaagtcactttcccacccgcccacttcctggggtccacgaacgcgtgtctctctagcctaattctccgtgatctttgcgcagccgccgcctaccgtggcggacttccggggaccgaaagccggctagatgagaaaccatagagacgggaaatgtttcccccaatcgtttccgtttcccaggagcgaaaccggctctgaagaggaagtgacggtaccgtgcttgagagatggcggccgctctccctctccagccctccacgaccgcttcggccacgacgacagccacggccgtcgcgctgggggaggtggaagatgagggcctcctggcgtcgctattccgggaccgcttccccgaagctcagtggcgtgagaagcccgacgtgggccgctacctccgggagctgagcggctccgggctggaccggctgcggcgcgaacccgagcgcttggcggaagagcgggcccagcggctgcagcagacgcgcgacctggctttcgccaactacaagacgttcattcgcggggccgagtgcaccgagcgcatccaccggctcttcggcgacgtggaggcgtccctcgggcgcctgctcgaccgtctgccccgcttccagcagagctgcaggtgcggctggcctgatggggacgggcgcgtcattgtatctgccaggacgctatcgtcatgacccaagcgtagtgtacagggctctctcctgattgccttgttaatccacttaaacttcacagcagccatctaggtaggtagcgtcattattttacagacgaggaagtcgaagtgaagtgacttgtccaagaacacagctagtaagtttccaagaattggaagctaggagtccactactccctcataggctgttgtttaaataataaacattcagccagtcttattgacacttgtgaccccagtattcgagccacaaagtcatcatcctagtctgagtattgaattcatggacagcctgagctacatgagacattcaaacaaactaaaaaatgtatgcatccgggcggtggtggcgcacgcctttaatcccagcacttgggaggcagaggcaggcgggtttctgagttcaaggccagcctggtctacagagtgagttccaggacagccagagctatgcagagaaaccttgtctcgaaaaaccaaaaataaataaataaataaaattatgcaaggcagttcattgagcctgacatagttaaccctatataaatgtgggctggaggtgctcagcttcaaaatgtccatcgataggaagctgacagatcctatttgtcattgtaggttgtcaaaaagcatttcctttttaagctatgttacatttctaggccctcgatctaatacacttagttctgctatccagcaggtcaatttttctttggaagcttggatattaaaaacaggttgtgtaccccatatgtctgaaaagagattcaggactgcataaagcgagtttctggaattactatagaaaagtggagaaagtttaagtgggagcgcgaaagatacatagcagcacataacatgaagacctgaagaatcttagggcaaaagtgtggcttatagagaggttagtgctctattagaaaaatactagtagctactttaaaatgtgtatctcacctgcatgtatgtctgtgcaccatatgtgcccaaaggaggttagaagagggtgtcagatatcctgggactagaattataggtggttgtgagccactaggtatatgtgttgggacctaagctggggtcccctgcaagagcagtgatcacagagccacttctccagccttaagtccagctagtaagggatttgtagacgctttccatacatttactttatgtaaggtcttacatacatgccatcttgcctgtctctaacattcacaccaatgaaaagacaggtccagagaagccaagtaccttgccataacatagacctccttcgtgagacctagagcagttcagtcccaaatgttgacagtctgggcagccaatataaatctacaagccatttttaaaatgacatggagggaggggtaccaccatgttgatgtggaagtcagaggacagcttgtagggtgggttctctctccagtgaggggatcacacttaggtcagcaggcttgttggcaggcactaggcactgtacccactgagccattgtgacgactccatgcaagcaatcaattaatgaaaagtttcttaaatcttgagttaaaagttctttcaagtgtaatagaaattgtagatttggtgtgaggattttgtttgagatagggttgcactatgtatctatccctagctggtctgcctcaacttctggagggctgggatcatgggtgtgccccaccagagccagccttgtgggaagatttttttttcccgagacagggtttctatgtgtagctctggctgtcctggaactcactctgtagaccaggctggcctcgaaatcagaaatcctcctgcctctgcctcccaagtgctgggattaaaggcgtgtgctacgaccgcccggcgggaagattttaaataaactaggtaaaccatctagcccgtgtctagtaagtgcttggtaacaaactgctgtgtaggataataaggaaatacactttcctgatcggctctaggaactttgtgaaggaagctgaggagatcagctccagccgccgcatgaacacgctgactctaaaccggcacacagaaatcctggagattttagagataccccagcttatggacacgtgtgtccgaaacagctatcatgaagaggcgctggagcttgccgcctatgtacggcgactggaaaggaagtactcctccatccccgttatccaggtagccaccttgcccaggggcctcaagctgatgatctgatagttaattctgtgattgtgactacacttacacgtagaaacctttgcatagttcatatctttctgccagccaggtaagctgaacagaagatattggtacactcattcaaagatcctattcctcatgtgccagatactgacttaggtactaggaataccttgtgaagaatatattcaaggtcatgattctcattaaagctattctaagtgatatgttgataaatacaaatggtaattggtagataacaatatttcagagattggtaaatgtctgaagaaatagccagagaaagccaggcaggcatggtggggtatgtatgtaaactcagcacttggaaggaagagacagaagggtcaggagttcaaggccatccttagttgcttagtaagtttgaggcaagcttgctgagttatatgagattctatctcagaaacaaacaaaacagaaccagggactagggtagagagctggcaagggttactagagtgctgaggcactgacattgtcagaaaggtctttccaagaccttagtgatgagaaagaaccagaacttgaaggtctggagagacagcaaagcaagaagtaggagaaacaacacagggtaaggtgggaaattggcgtttcaaggggtcccaaagcagcctctgttattggactgtagtaggaaagtctggggcatcaggaagctgccgaagctggagaatcagccagcgcctggagatcatgatgaattcgtagtttgttgattgtgatgggaaaccctaggaggatttttgagcaggagaactagttatgtcagcagctctctgtaaacctgcaggttttagaaatccacattacatgtcaggaaagccacaagaatgttagcttccagtgtccagggttaataggatgggttccaaagtatttttctcagggtgttatgactctgtttattgtcagggcattgtgaatgaagtgcgccagtccatgcagctgatgctaagccagctgatccaacaactgaggactaacatccagctcccagcctgcctccgtgtcataggctatcttcggcgcatggatgtcttcactgaggctgagttgagggtgaaatttcttcaggctcgggatgcttggctccgctccatcctgactgccatccctaatgatgatccttacttccacatcacaaaaaccattgaggcttgccgggtccatctctttgatatcatcacccagtaccgtgctattttctcagatgaggaccccctgctgccacctgccatgggcgagtacactgtgaatgagggtgccatcttccatggatgggtgctgcagaaaatctcacagttcctgcaggtgctagagactgacctttaccggggtataggaggccgcttggactctctgcttggccagtgcatgtactttgggctgtcctttagccgggtgggggctgatttccgcggccagttggctcctgttttccagagggtggcaatcagcactttccagaaagcagttgaagaagcagtggagaaattccaggatgaaatgacttcatacaccctcatctcgactgcagccatcctgggcagcagtaacacgcctgccacagtaccagccacacaaccaggcacgctgcagccaccgatggtgctcttagacttcccgcctcttgcctgtttcctcaacaacattttggttgctttcaatgatttacgtctctgttgccctgtggctctagcacaggatgtgactgggaccttggaaaatgcccttaccaaggtgagtaattttctgctatcttgggctgcccttggtaacagccagtcaagctgttgtacaaaaccagtccacataatcatggtgcctgcctgccaatgttgagaggtttaccgtgctcttcaaggttcttctgtagcgcaactctgatgctagatcaccctttgttgggggatcctggaagaagctatgatagagtacctgcggcaggcagtcactcagcacacacagtccactgcttgataccaaactcccagggattcagcagcttagaacacttacatgtatctgtaaaagtatcttttatttgcctgatgcaattgtcctttcttttttttttgttttgttttgttttgtttttttgagacagggtttctctgtgtagccctggctgtcctagagctcactttgtagaccaggctggccttgaactcagaaatccgcctgcccctgcctcccgagtgctgggattaaaggcgtgcgccaccacgcccagcatgcaattgtcctttctgaggcttactgtctacatctgctaacctaggcctagtcctggaagcttctagtagctgtatactcttacctagatctagaatattttcagcctctggacttactgctgaataagcttaccctttctagctctttctgaactctggctggctggtcatctcagctgttctactcaaaactcctcttcacattgactgattcaaactggcttctctcagcttctaactgaattgctctgcttgcccccatactaactttggcaatgtgttctaatctggctcctcgttctctggcttgttctgtcttcacctgtgtctaacttgttctcgctttgaaacctgtctgtctctaaaactgccctctttcactctccccccccccccgcccccttctcctcttggagctgctgctctctcttaagtagcctttctttgttctcgtgagagttgggcatatcctgttctgtcaaatctttctctgatttgtcactttgtctgcctctaatcaattagacatcacttccaaacatgggtgcttccttctataaactaacttgaccttcattatttgcgattaaaggtgcggactgagggcatgtttgtattccagccagagtagccatgttgctgggttaaaatcccttgcatacacacacatacacacacacacacacacacacacacacacacacacacacacatatatacacacacacatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgccacaacatggcttttcttcctcaggccagcaggtagagcatctctcctgaattatttcatcacaccccatctaccagaacacaaagcattgagtcataaatccaccagtcaaatcacacaattgtgtctactgaccacagtgctgaatttcaacaagatagcaatgaaatgcattgtttgaaatgaattttctttttcctttttcttttaccttttttttgtttttcaagacaggatttgtgtgtcttggttgtatccccagttgtcctggaacttggactatagaccaggctggcctggagctcacaaagctctgcctgtctctgcccctaagcactgggcttaaaggagcccctgccacccctgttgtgaatgaactttctctatgctgcaagtttgtgcttgtccacatagtcagcagcgtagactgcctctgtggttgattttgacattgtcctgtaggtaaccaaaacaattctggcattccatcgagccgaagaggctgtgttcagcagtggggagcatgagatctttgtccagttctgcactgccttcctggaagaccttgttccttatttgaaccgctgtcttcaagtccttttcccaccagctcagatagcccagactttaggtaagaaaaaggaaagttgtgtttttgtttttttttttttttttgagacagggtttctctgtgtagccctggctgtcctggaactcactttgtagaccaggctggccttgaactcagaaatctgcctgcctctgcctcccaagagctaggataaaaggaaagattttttaaaaaatttgtttgtttggttggttggtttttgatatgggatttctcttcaggggttcctctgtgaaactctggctgtcctggaactctgtaaatctcctgagtgctgggattaaaggtgttcttcaccacagcctggcttttatcatcgttgttttcgttttgtcttttttaaagattttatgtgagtgctctatctgaatgcacacctgcgtgtatgtcagaagagggcgtcagatcccattacagatggttgtgagccacgttgttggggattgaactcaggacctctggaagagtacttaaccactgagccatgtctgtagcccttgtttttggtttgacactagacaggatctcagtatatagcactggctaccctggaactaacttggtatacccaactggccttgaactcagagatcctcttgcctctgcctcccaaatagctgggatctgtgcctggactccagtatttactgagtgtctcctggctcaggctccatccacccttacaatggggctccaatataactaactgtccttttgtattacagagatgcccttagcctggcacaactttaataccagcatttgggaggcagaggcaggacgatctctgtgagataagagaccagcctggtctatagagttccagcaagccaggtctcaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccttatgcgccgcagctcggggtgccgctgcaagtgttgtcgctcgagttcccggtacaagctcctccgagccttctcaccgcgcctgcgcgaactgcgtcagatggaacccttcccacttcgggtgctggtgaaccccagtctgagagtgttggacagccgcttggtcaccttccccgagggctgcgagagtgtcgccggctttctggcgtgtgtgcctcgcttccaagccgtgcagatctcaggtgcaggggacgtgggcagcggggtggtcttgctctctctggctagagacagtgcagacacagcggcactcgggagccaactgaactcctgaagagcaggtcaggcccgcctagatgggttgcagggtgattccttagatatggagcctgtctttcccctttctcatgagtaggtatatagattcccatgtaagtgtgtctgtattgcacacacgattttcccagtttatcgtggtggggcttgtgtaagaaagtgggacccagatttacccagactagggcaacaaaccattccatgcttcacattcacattgttttatgtaatatggttatttgctacagtgccaagctgaaatacctttctttggggggggggggtcgagacagggtttctctgtatagccctggctgtcctggaactcactttgtagacctcgaactcagaaatccgcctgcctctacctcctgagtgctgggattaaaaggtgtgtgccaccatgcctggcatgaaatacctttgataaacagcccttgaaaagagttttgatttcttatccttgccctgtagtagtgctgggaatcacgctgagtaaaaagtcggcactggacaaaattggggtaccctttctaggagggataagagctgttatccacattcactcttggatgctgcctctgtagataggatataaataggcatggccagggcaggaaacaaagtagggacaggaggttgggcatgagttcagcaaagcctcacctcatcgagcctgtaacttcctttgcaggactggacccaaaaggagagccagtggtgtggtcggcaagtggttggacagctcgaatcatccagcatgagatggatcacttgcagggctgcttgttcatcgacaaaatggacagtgggacatttaccaatctccactggatggaggtgaatgactaacactctccttgaattgaggatctggaaatccagcatgcagactaagatggtcacatctgtgcttcagcttggaattggttccagtccgacagtagacagtgtgtgctggtctgagatgaagatgatagaaatgcttgccctgaaatcagatctgacagaatacgattacagcaggactacaaatgtaccattaaaggagtggctatttcctgacaatttcccatggagaggagtgggcaggcaaacatcctctgtacaaatgagacacattctaaccccacagcctacaattgattgataaggtaatccagatatccaaaagatttgttttttgagacagggtttctctgtgtagccttggctgtcgtggaactcactctgtagacaagctggcctcaaacttaagagatatacctgcctctgtactcctgagctttgggactgaaggtgtatcacactactgctggacttgaaagttgtcttaaaatgcagtcttaaaagtctgagtgtggtggcacacctttaattccagcactctgttggcaatcgtaggctaatgtttaaggccatcaaaggaacatagtaagattctcttaaaagaaaaaaaaagctcaagtctggggtgatagctaggcagttaggttaaagagtgcttgcttttgcacaacactagagttcagttctgagcatttacatcaatcaactcactacatctatacctccagctccagggaattaagtgctgcctcctagcctctgcaggtattgttttgtgtataaacttacacagaaacataattgaaataaaatctaaagaacaaagcttctactggtagccactttgaatcagagcaaagcagacagtgaaaggccgacataatcttggctatagatacagttctttcctttgcaacttacagctggagcatatgtagctctgggagaacagtacttaaagtggagggacctgggtttgattcctaacatcaagaagtaaaatacagaataataccagctattggaggactgtgaggtctgtgtcacacagcatttccagagctaccttatctggggaccttctaaactgggtggcatctattcagtagcagatactaggttatctcatgggaacatagacctaacattaccattcctacaattccagccattcggagctggaagcaagagcatcagaagtttaggatctgcctgagccttagggtttgcaggccttatgagcaccgctgcttcctgccctgctaaggaaagcagagagcagtccagagggtcttaccagaagtaagctttactctcaactccatactagaatcaaaaatgagacgactccagtagctcaataagggaaaagggtttattagacatctccaggacaggaccagcagaggctgggctcagttctcaggtgaaggcagcgataaagacctgcctgtttgccgtctctcctgatggaaacggcatcgtgttcacagaagctgtcagctcctgcaaggaggacctgaagctccagatgcaagcttaggagagtgggatggcttttcctactttaccacagtcagctcacaagtagccaaagttaagaggcaaggagtgaaagcaggggcctggcagcttccactccttaacatttccagatgacttttctctttatttataaacaagacagaaatcaaagcggcattaatttaggggaacaaaagttagacaaaaacagatcagggcaaggagtgtgagcatccagtagtgaagtatgcagagccagtctcaagtgtcctacatggtgaagcatctctgcagctggggaggccccttcttcatcctactaggttgacagccaggcagtagaggaaatactattgacttcacgacttcaggccctgcctggccactggtgtacgaagtcccatgaattttctccagtcagactctcaatttcattatcacatgaagctttaactctcctgtccaaagtcctcagagaatttctttactttcaggaggtcgtctgcattcactgtgggccgggtagtggccaaagaccggagcatgtccgactgcagagacaagcatgtagctgaaaaaggctgaccccaggtcctcagcactctccttttgtcatgctgtctagactgacaagaggcctgcctgccttctgaaagattacttcacccttcaccccgcagctctcatcccatcccagcagtagttccattactgaattcaccccacagtgcagacagctgacaaaattaggagaggtctatactgttcaggtaagagccatgtgaaaaagattttcactggtttccttctggaccaaaaagccaggccttggaatgatagtgtcttggcttttcttcttaaagacccttaggacctcagcaaggacctcaaaaggtccttccaccctaaaggctctggaaggcctgtgagccaggacagtaggaaggtactttttattttggactttctggttttctcccaatgggtcactcaccatgcaaaccacaggctctaagagtttatcaccagggacatccatccaagtcatctctatggcccctggatctcccggagaacatggggtcagaagatcatcaatcataacgctagggttggttcgagaagggccacacacctgaaaccaagcagagactgtgaggctggctgttgttagcagtgtgtacatcaggacctaaggctggctgaagggagtactgaggttctagtcatcaaagttggaggaggaaaaggcgccttttaaaatagtctgagggtctgaaagatgactcaggcagtgcttaaaggcacctggcatgcaaacctggtgacctgagttccatctgtaaaagagagccaacaccacaaagttgtcctttgacctccaaaacacacggtggcatcttcgtatactgccttccctgcccccacagcatttaaaacaagtcaaacaagaaacctggtggcaaacacctgtaatctcagcacttaggaagtacaggatatatgagttcaaggtcatcttcaactataggatgagtttgagattgtcctggactaattgaaccaccttaaaaaacaaatgtacatgggctagtgagatggcttagcaggtaaaggcaactgtaaccaagcctgatgacttgagttgcatctcccagatccacatagtagcagagaacttatgacctctatgtgtgcacgtgtacacacgcaacaacaaaacaaccaataaacaaaggctgaaaggtccaggagggttgatttggtttcagaggtgcatggacagtatgatcttccagctgctggcctccagatcttcctgtagccccaaatgttccatcttcccctataatgctaccaagactcatcccataaatgtacttgcagcaaaaaagttcctctcactgaagtctcctgcaatggggaaaccctaagcaaaccaaatcctcaggaattggctcaggtcactccagtgtggtttgtcttctaatagagaaaactgctcacctctccaaacttctgaaactcctgatgactccactttgctctgacaggtactcactgtttaaggggaactagcatttctctcactggttgtctccattactgcctttcatacacccaggacagggctggcacatatcacaacctacagcagacactcagcaaagatgtgcctgaatgagtgggcaagtcccccttccactgacagtgtcaggcaccctgccctcccgcatgatgctgcctgcctatcttctgtttcctatagttgaagagcattttactccagcaggaactgcagcaggatgcatggcactgccccagttctagagcaaagggcacttaatacctacccttggttcccccacagagaaggtcccttgagcagccagaaagttgttgaagaggctaccaacacctcactagcaacactgcctaagccactgccgccacttaccttcttgaagtgtgttgctgactgtacttttctgactggctgcatgagggagtcccgcacaatgatgctgatatctgctcctgagtagccttctgtcttgcgggccagctcgtgaatgttagcatctgtgaggttgtgaggtgtgcttcccagatgtaaccgaaacatttgggcacgggccgcttcctctggcaatgggatataaattcgcttttcaaacctggaaagatgcatgacatgaaatgaaagctgatcgcaggatggtaggaagggcaagggcagcctgcatgttgaaatgagtgatccagggcccagctttacacccggctctgctccatatgcagacttgggaggagtatagagaaatgggggcagatggctagtcacaaactgaccatagctagacaaagataacagactcctaggggagactcacctcctcctgatggctgaatccaacacccaggggatgtttgtggcaccaagaacaagagttccatcattattattccccactcctgtgaagaatgggagacaagtgactgaagatgcctgcaggagcagccaggccccatggaaaactaaaccatggtttggggcttccctatagcaccacttgttctgagggatgggaaagtgacacaacagaggcctcagagccctctgtttgctgccagcctgaggcatcagaagtgactctcctccattgtgcccagtgcagctccataatggagtcctgggttgcctttaggtagaagacagccaaagagtgacaaggcacaagcacacaccttgcatctggaccaagaactctgttttgatcctacgagcggcttcactctcattttcattccgtgacccacagagggaatctacctcatcaatgaagatgatggaaggcttatgctgccgggccagctcaaacaggttcttgactagcctgtgagagtgagaaaggggtcaagactgggacactccacccaaacatgcccaccctgagacacagttgttagttagacctggtgcctctcccacaggaaggaaaaaaacaaaacaaaacacacacacaaaacaaacaaacaaacaaaatagcagcaggaaaaacagggcagacaagtcctcaaacactaatgaatcaagaacttgctgtggtatcagcctcagattttgggaggggagccccattcattagctctgggcttggggagaatcctttccctttctctgagcctcagattcgtatcaaagaatggaggtcatcttgagaaataagctaaaccccatgaaatgcccccaaagaggatatatacctgactacagatgtgacacgtgtattaccccaacactgaggaggtagtgctaagacaatcagaagtccaaggtcagcctctgctactgatgagattgtaaccagttttatgagattctgtctcataaaaccaaagagaaaacaagcagatgatacgtatttacaattggtttatttcccctgtttttattttacttacattggtgttctgcctgtatgtatatctgtgttggggtgtcagatcccctggaattggaattacaattgtgaactggctgttgtgggtgctgagagttaaatccaggtcctttgaacccctgagccatctctctagctccttttttaatttgctttgaaacaaggtctaattacacagagcaggctgaccttgaacttgtaatccttctgcctctgtatcctgagtgctaggattacaggggtgcctcgtcttttccaagtttgcatacatctgcgtatcaggacagtgtctcaagaagtaagagcttgagccgggcgtggtggcgcacacctttaatcccagcactcgggaggcaaaggcaggcggatttctgagttccgggctagcctgatctacaaagtgagttccaggacagtcagggctacacagagaaaccctgtttcgaaaaaaaaaaaaaaaagaagtgagagcttgttctgactactatcccagattatcccacagcagctcctctgggaagtgatttccaaggggccaggaagctgaacccgcagctgccaaggctgctgtagcatagcggatggccaacttacttctcgctttcccccaaccacttagacatcagatccgaggaggacacagagaagaaggtagagttgttggcttctgttgccacggctttggccaggtaggacttgcctgtgcctgggggcccaaagaggagtatgcctcgccaaggagtgcgtttgcctgtaataaagaatgaacaggactcagctgtttcctgatggcaaaagaggaacaaaggaaagttgaaggcagggaggagcctgctcaggaggcagaatgcttgtcctacaagcttgagcactaaagtacagctccccggcacctgggagaataccatgcaagagtgatggctggcctgtaagcccagggtttggaaagcagagctaggggatccctagagtatgctggctggacgagctgaatcatccatcgagttctggggttaagtattggccctgccgccccccgtaaccctcatctgtcatatggtaaacagcaactgcaaaagacacctgacaccctcctctgacctccagatacatgtacacatacatgcatccccacacatgggaacacatatataattatgcatgaatataccacacatacacaatcaagttgtggggttggagaaatggcttggttaatagtactgaatacgcttccagtagacctgggtttgatcccagcacccacaaggcaggtcatgactgtaattctagtttcaggggatccagccctcttctggccttcaaacaactgcacaaatatggtacacagacatatcatgcaggcaaaacaccaatatagttaaaaacaaatctcaaaacaaagttacctcaccttacta

SEQ ID NO: 2006 - DNA, 1603 bp, Mus musculus
gagatggcggccgctctccctctccagccctccacgaccgcttcggccacgacgacagccacggccgtcgcgctgggggaggtggaagatgagggcctcctggcgtcgctattccgggaccgcttccccgaagctcagtggcgtgagaagcccgacgtgggccgctacctccgggagctgagcggctccgggctggaccggctgcggcgcgaacccgagcgcttggcggaagagcgggcccagcggctgcagcagacgcgcgacctggctttcgccaactacaagacgttcattcgcggggccgagtgcaccgagcgcatccaccggctcttcggcgacgtggaggcgtccctcgggcgcctgctcgaccgtctgccccgcttccagcagagctgcaggaactttgtgaaggaagctgaggagatcagctccagccgccgcatgaacacgctgactctaaaccggcacacagaaatcctggagattttagagataccccagcttatggacacgtgtgtccgaaacagctatcatgaagaggcgctggagcttgccgcctatgtacggcgactggaaaggaagtactcctccatccccgttatccagggcattgtgaatgaagtgcgccagtccatgcagctgatgctaagccagctgatccaacaactgaggactaacatccagctcccagcctgcctccgtgtcataggctatcttcggcgcatggatgtcttcactgaggctgagttgagggtgaaatttcttcaggctcgggatgcttggctccgctccatcctgactgccatccctaatgatgatccttacttccacatcacaaaaaccattgaggcttgccgggtccatctctttgatatcatcacccagtaccgtgctattttctcagatgaggaccccctgctgccacctgccatgggcgagtacactgtgaatgagggtgccatcttccatggatgggtgctgcagaaaatctcacagttcctgcaggtgctagagactgacctttaccggggtataggaggccgcttggactctctgcttggccagtgcatgtactttgggctgtcctttagccgggtgggggctgatttccgcggccagttggctcctgttttccagagggtggcaatcagcactttccagaaagcagttgaagaagcagtggagaaattccaggatgaaatgacttcatacaccctcatctcgactgcagccatcctgggcagcagtaacacgcctgccacagtaccagccacacaaccaggcacgctgcagccaccgatggtgctcttagacttcccgcctcttgcctgtttcctcaacaacattttggttgctttcaatgatttacgtctctgttgccctgtggctctagcacaggatgtgactgggaccttggaaaatgcccttaccaaggtaaccaaaacaattctggcattccatcgagccgaagaggctgtgttcagcagtggggagcatgagatctttgtccagttctgcactgccttcctggaagaccttgttccttatttgaaccgctgtcttcaagtccttttcccaccagctcagatagcccagactttag

SEQ ID NO: 2007 - protein, 535 aa, Mus musculus
  VARIANT (1)...(535): Xaa = Any Amino Acid
EMAAALPLQPSTTASATTTATAVALGEVEDEGLLASLFRDRFPEAQWREKPDVGRYLRELSGSGLDRLRREPERLAEERAQRLQQTRDLAFANYKTFIRGAECTERIHRLFGDVEASLGRLLDRLPRFQQSCRNFVKEAEEISSSRRMNTLTLNRHTEILEILEIPQLMDTCVRNSYHEEALELAAYVRRLERKYSSIPVIQGIVNEVRQSMQLMLSQLIQQLRTNIQLPACLRVIGYLRRMDVFTEAELRVKFLQARDAWLRSILTAIPNDDPYFHITKTIEACRVHLFDIITQYRAIFSDEDPLLPPAMGEYTVNEGAIFHGWVLQKISQFLQVLETDLYRGIGGRLDSLLGQCMYFGLSFSRVGADFRGQLAPVFQRVAISTFQKAVEEAVEKFQDEMTSYTLISTAAILGSSNTPATVPATQPGTLQPPMVLLDFPPLACFLNNILVAFNDLRLCCPVALAQDVTGTLENALTKVTKTILAFHRAEEAVFSSGEHEIFVQFCTAFLEDLVPYLNRCLQVLFPPAQIAQTLX

SEQ ID NO: 2008 - DNA, 28805 bp, Homo sapiens
ccacggcacataacccacagggatttctcatagacacctcccagggtgttcggggccagattaacttctctacccaagagacaggtctgttttcattaccatggctattataataatcatagggtcctatgaaattacagaaataatgaggaagtatacagagatgttttaacagtaggaaaaaaattcagcctttaacaccaaaaaccagtgttcctggaggctgctgacctccaaggatgccaagtggcagtctactgacgatttgggggcaacactccaggtgagcattctaagtctagggttcagccgctcaattttatctcatcatctccagttaatcagattctgggaaagtgaccaaaaaacagagacccatttataatacagaattccaattaacaaatggattacagggaagcatgtctttccagtcatcagaatatttgagtcagttactaaaagcagattcagaacaaaagaaaatgcatgatatccatgtgagatatccacactccacagcaaagcactcctccagccaggtcaagcctgtcccactttggagagcagcagtgtcttaactgccctctttaatagccagctgcactaaaaaagacattttctcaacaggggcatcagacagtccttcactatgaagcacagcatgtgtatcagtgttaaaagatcttgaacaggctgggcgtggtggctcacacctgtaatctcagcactttgggaggccaaggtgggcggatcacctgaggtcaggagtttgcgaccagcctgaccaatatggtgaaaccccgtctctactaaaaatacaaaaattagctgggtgtggtggcaggcgcctgtaatcccagctacctgggaggctgaggcaagagaattgcttgaacctggaggcagagactgcagtgggccgagagcgcgccattgcactccggtctgggcaacagagcgagactcgtctaaaaaaaaaaaagatcttgaacatctttggcccctacatgccagtagtgccttccaatcattttgactttcaaacactgccacacctttctaatcccaccccacccatcttctaccggtcctctccaccttgctccttcccacccgctccccaccccgcgcccccctcccccccgcacacacaaagggaggcaaccccagccccaacagatataaccaaaccatgagtcactgtacacaccgccttggaggcaatcactccaggagagctgctttcatgcactatgcatctattttttttttttgtctttcctaatttcaagttcaagatggtgtccctagctttaattgtatacaaggaccaggcaaacaccatgctcttaacttcaactcaatctgttgagcaggagttccttaatacaagatgtgggaattatatgttaaagagaaaacattgtttgccactacccagtatggaaagaacgagttactaaaatttggccaaatataataagtaatatttagtataagtttaacataaggtccgtgtcttccatgtcaaaaacgggatctttgtactttctaagtaaaaagaaggtcctgtagtagaattccaaaactagaggacagatacctccagggaatccttaacaaaggggaggagaccaaagacttggtaatgatctaagaattcctacaggtttttatcagctttgtctaagtaatcagcataatcacttcggttctgtgcaagtgtacctcaactttggggtcttctatgaggggcctgagactgatcacaaacagaaggaaagaaaacaactgaatgatactctggatgcaattgaggtaaggaagtgttttgtggaagagaaacatctgtggaaactgatttttaacttcagagggaagatgacttcatttaggtagaaaccaaacaggcaaggggatgtgaatttcttcataaattatgacttggctgggcacggtggctcacgcctgtaatcccagcactttgggaggccgaggtgggtggatcacctgaggtcaggagttcgaaaccagcctttccaacatggtgaaaccctgtctctactaaaaatacaaaaattagctgggcgtggtggtgcgcacctgtaatcccagctactcggaaggctgaggcaggagaatcgcttgaaccctgggaggcagaggttgcagtaagccgagatcacgccactacactccagtctgggatacagcaagacaccgtctcaaaataaattacgacttgaagctcttgaaattccatcttcgttttataccaagggttggcaaactatgtatggctgacaggccaaatctggcccattgcctgtttttctttaaattgagatataattcatacaccgtacaccatctaaaagtgtgtaagtcagtggttttttagtatattcacaaggctgtgcaactatcagcatctaattctggaagtttatcacccaccccaccctcaaaatcccactccccattagtcattctccattctattaccccaggcctgcctatcactgttctactgtctctatagatttacctattctatacttaatttttgagacagggtctcactcttgtccaggctgcagtgtgcagtggcttgatcacagctcactgcagcctcaacctcctgcgctcaagcaatcctcccacctcggcttgccaaagtgctcagattcagcactttgagccactgagctgagattactcagcattatgagctactgtgccgagattaatcagcactttgagccactgtggctggcctctatacactttatttaaatggaatcacacagtacatgggattttgtgactggcttatttttattattttttgagacggagttttgctcgttgtccaggctggagtgcaatggcgcaacctcagctcactgcaacctctgcctccagggttcaagtgattctcctcctcccaagtagctgggattacaggcacctctcaccatgcccggctaatttttgcatttttagtagagacagggtttcaccatgttggccaagctggtctcaaattcctgacctcaggtgattggcccgcctcggcctcccaaagtgctgggattacaggtatgagccaccgcgcccagccaagactggcttctttaatttagcatgttctcaacgttcatccatgttgtagcatgtatcagtacttttctttttatggctgaataatactctcttttatggatacacattttatttatccattcatcagttaatggacatgatggatatttaggtttttccacctcttggctatcataacgtggctatggacatttgcatgcaagtttttgtgttagcatgttttcatctgtgtatacctgaaagtggaattactggagactgtttaccacagtggctaaaccattttaaactcttgctagcagtgtatgaaggttctaatttctctacttcctcatcaacacttattttttgttacagtcatcctagtgggtgtgaaatgttatcttgtggttttgagttgcatttccctaatgattaataatgttgagcatcttttcacgtgcgtattggccatctctcttctttggagaaatgtctgttcgagtcctttgcccattttaggccaggccagttggcccaacacctgtaatcccagcactttgtgaggctgaggtaggatagcttgagcccaggagtttgagactagcctgggaaacatggtaagaccctgtctctacaaacaaaacaactttttaaatgacccgggtgtggtggcacatacttgtggtcccagccactcgggaggcttaggtagaattgcttgaacccaggatgtcaaggctgtgacagtgagaccctatctcaaaaaaatgaaaatcctttgcccattttacttttttttttttttttttttttttttttgagagagtcagtctgtcgtccaggctggagtgcagtggtgtgatctcggctcactgcaacctttgcctcctgggttcaagtgattcacctgcctcagcctcctgagtaggtggcattacagccacgtgccaccacgcccacctacattttgtatttttagtagagacgggggtttcaccatgttggtcaggctggtcttgaactcctgaccttgtgatctgtccagctcagcctctcaaagtgctgggaatacaggcgtgagccaccgcaccctgcctgaattgtctttttattgttgaattttgtttatatattctggatacaaatccctcctaagatatgtgagttgcagatattttctcccattctggcaatgtcttttcactttcttttttcttttttgagacggagtttcattctgtctcccaggctggagtgcagtggcgtgatcttggctcactgcaacctttgcctcctaggttcaagcgattctcctgcctcggcctcctgagtagctgggactacaggcgtgtgccacaatgcccagctaacttttgtatttttatttatttatttatttatatttttttgagacagagtctcgctttgtcacctaggctggaatgcagtggcacaattttggctcactgcaacctccgcctcccgggttcaagtgattcttatgcttcagtctcccaagtagctgggattacaggcgggtgccaccacgcctggctaatttttgtatttttagtagagatggggtatcactatgttggccaggctggtcttgaactcctgacttcaggtgatctgcccaccttggcctcccaaagtgctaagattacaggaacgagccaccgtgcccggccacttttcactttctttttttcttttttttttgttgagacaaagtcttgtgctgtcggccaggctggagtacagtggcacgatctcagctccctgcaacctctgcctcccgggctcaagcagttctcctgcctcagcctcccgagtagctgggattacaggcgtgtgccaccacacctggctaatttttgtatttttagtagagacggtgtttcaccatgttggccaggctgatcttaaactcctgatctcaggtaatccgcccgtctcggcctcccaaagtgctgggattacaggtatgagccactgcacccggccacttttcactttcttaatagtctctcctaaatgcacaaaagctcactgcctgtttttgtaaatggaagttttcttgaaacacagccatgctcatttgacaattacatattgtctgtggctgcttttgtactacaatggcaagagttcagcagtcacaggggcctgcaaagccaaaaatatttaccatctggccttttaataaaaagtccacaggcccttgtcttctaccatatacagagaacataaaacatcacctggaatggtaacgacatgctgagtacatctaaatctagaggtcctctggaagagctctctagtttgagtactgaagttttccattatttaaaaacaaaacaaaaggccggggcagtggctcatgaccataatcccaacactttgggaggccagtgtgggtggatctcttgagcccagtagttcgagatgagcctgggcaacatggcaaaaccctgtctctacaataaaaaaaaaaaaaaattagctgggtgtagtggcatgtgcctgtagtcccagctactagggaggctgaggtgggaagatcacttgagcgcagaaggttgaggctgcagtgagctgtgactgcgccactgtactcctgcctgggcaaacaagtgagaccctgtctcataaaacaaaaacaaaaattttaaactcaaatccagaccatatttcatacatagcaaacacaacatttaacaactatcattgtattgtacatcttaaaatcatatgggtaaattatttgacttgagataggttagtgctagtgagcgctcaggtgaggctagatgggggtttggaagaatcccccttaaaattgtctctctcataggacggcacacaaaaggtgcagaacaatatctttcacatgtggcgatactacaactttgcccggatgaggaaaatggctgactttttccttatccaatcaaactataactacgtgaactggtggtcgacagcccagagccttgttattattctttctgggatcctgcaactgtatttcttgaagcgtctcttcaatgttccaacaactacagatacaaagaagccaagatgctaagctaaggtgactatagcaccctggctgttttcttctggggcttagtcgaatcagctttgtaatgttatgggacaaaaatcaattatctcattaatgttttagtctgctgcacacatctaaaaaagcaaaatggcaataaaatcataacagtgaaaaagttctgaagaagtatgtattaaatgtatgcatcaaaatactgttcatcatatagcagtcccttagccttcactgagtctacttagaggctaacagaaaaccttagaaggaagatgagttgaaaaaggccacaatcaagtttgcttacatataaaagcaggagttggtaatgttttattcttaaagacttcacctttggaacttaaaataagcaatatattcattaaagaaatagtttaattttgcaatacagatagtctttaaattttttgtctataaaatatttaaagaaatattctaaggatcttaaagtaactttgggaggcacggggaaggacaaagggactgaatttttatgtcgtggcctctgatcagtgcttttagtccaatccagtcaagtaagtaaaggttcatagaaaaaattgttttataaaatcatagtgatgaaaaaaactttccagcctagcgtcatcccatccaagaaaaatactgagaaaacagcttgtaaaaaagaaggtaataaaatcaaattatactcataaaactctacacttaataacaggaatacataatatatataatataaaaataattaccatttattccatacctatcatttccaaggcactgtacactgtactagatgctttacaatcagatggagtctcactctgtcacgcccaggctggagtgcaatggcaccatcttggctcactgcaagctctgcttccccagttcaagccattctcctgcctcagcctcccaagtaactaggaccacagccatgtgtcaccacacctaattttttttttttttttagtagagatggggtttcaccatgttggccaggctggtctcaaactcctaacctcaagtgatccgtccgccttggcctcccaaagtgctgggattacaggcgcgagccactgtgcccagcctacaatcatgatttctaattccaaaaatcagactttctaattctcaggtagatggccaaagctgattttcaagttttgtgtctttttaaacagaagaaaatgaaccttattaaagctgaatgactcattcaaggccatatagctggtaggtggcagaagtggggtttgaacccgtttttcttctataccacacaccaattactgtatagaaaaatagctgaattgctcctattagccaaatttcatttttaaaaccccacatgtggtttattattctgttatggcaatgtctatgttgcatattaataaaaaagaaaatccttgtgtttagaaaacagtgttatcacagataacaataagctattcttgttcctggttccaatgattttgaacctatttctcagaacaagaagccctctgattcaaatatgaaacagtattctatttcgtcacaaagatctgaaaccccatttttgagccatctctgtatataataagaatccagcctgcatttgtcagtgatagagagtacagtaaataagaagtccctgaagaggccagagtgttgacaaaattcaacatgatggtggagtccacacaaacacaggaaacaaagctcggcctttccatacagccgtctgtccttggaatggcttcgttttaagtcaacgtctcttcatgccgcacatattccccaatgtctgcttgatgaaataccacaatcgccatggggtctacttttctgcagtcttgtgtagatttggctgccaccccaaaaccctgggattcaaaagaagagacactaactcactgaagtcattcaatatgcccatattgagggctggaaataacaaagacggaaaaaatacagttctggtctttctgggattcaaaacgtgctgagaatttattctctcaagcactcagattgaagacatacccttcttgaataagagtacttgagttctgtaacagctaccatctctactcaccaaagggatgtctgccatggagtacaccaccacgccctggtactgagaagtattttcagtgattcgacccagaccagatttcaacacatggttcccatacaggaaggactgctctgcaccaggctttatccaaactttatactataagagaattaaaatccaagagacataaaaacgttactatttctatccatgcagacaagctagctgctggatctgtgaataattttctgaaataattttaagggaaacagagagactcatgttttcctcaaactgtctatctcctgaacagaaatgcaggaagttgcccggtgcagtggctcacgcttgtaatcccagcactttgggaggccaaggcaggtggatcacttgaggccaggagttcgagaccagcctggccaacacagtgaaacactgtctctactaaaaacacacaaaaaaatcagccaggtgtggtggcacatgcctgtaatcccagctactgaggcacaagaatcactggaaactggaaagtggaggctgcagtgagatcgcaccactgcactctagcctgggcgacagagtgaaactgtgtcaggaagaaagagaaagagaaatgaaaagaaaaaacagagcaagaaagaaaaagaaaaaaatagaaaaagttattttctcaactctacaaggatcatcctccatggccaggttaacagctctttttctggaccccggtgtcttcattgctgccacttatttgctttctgatctctagctgggtctccctaggctcttctacttcgctggagaaaactaaccctacgcagccacatagcattcctatcccatagccctgaccatgctcaagctgcaagacctctacacatctccatgtgctgaaactcctccaagcacactgtcagggactctgtgggagagaagctgccggacaatctgcctaatccttgacttcatcgcccgtggcagaattggaaaccgccccacaaaccttggcataaggtgcaaggtaatccagagctgtgacgtgcaaccgaaacttgtgggttttagtgaattttccaaagcaggtccccagcgacaccagcttgtccccggaaatattggcggccagcttcataatcttctcactaaaagggtaaagggggagcaaggttgcggatgaaggaggctcgtgggacccaggacccctctcccctgggtccatgctgcctgcccggccccgcctcacctcacatagtacacccggtcgttgtgcagacggaaacagtaggtgccatcgggccggtccaccagcagttgaagattctccccaatgctgagggcaaaaagaggactggagaccgcgcccgaacgaaccggtctccggcaccgcgcccccactccacccttggccaccacacccacacactcccgcgtccgccccgcgcgctcctactatttcgctatcttctcaaacatgacacgggtctcctcttcagtcaaaggccgcatttttccccctgggttggaacaccggatcctcgtgccttggtaactggaaacggaagtcggtcgctcgctgctccccggcaatcccaaagccttcctctctagccccgtaccaatagttcgtctcgctagcgcccaatagtctggacgaccgcaggggaaagcaagccggccggatgagaaagcatagagaccggaaatgtgcctgtttcttcctgtcctaagttcggagtcagcgccccttgtggtccggaagggaagtgacgttgttgctgggaagatggcgaccgcggcgactatcccatcggtagccacggccacagcagcggctctcggcgaggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggtgcgacgcgcctggcgctaaaggggttttataactgtaaaagctgacatttacgatggtagaaataactaacacataaagcgtttaccacgttccaggttctctgctgagcgctttattaatccatttaaacctcacaacagccttcgagataggtactgttattccttttttatcttttttgagacggagtctcgccctgtcgccaggctggagtgcagtggcgagatctcggctcgctgcaacctacctctgcctcctgggttcaagcgattctcctgcctcagcctcctgagtagcagggaccataggcgcgcgccaccacgcccagctaatttttttggatttttagtagagacggggtttcagcatgttggctgggatggtctcgatcttttgatgtcgtgatctgtccgcctcggcctcccaaagcgctgggattacaggcataatccactgcgcccagccctgttatttccattttacatatgagcaagtcaagacagagattagtgacgtccaaggacacagctaggaggtttcgaattcagaactggttacccagaagcacgtccctccctcgaagggcagttgtgggcacaaagaaaaaggattcatgcaaagctcttattatcgggtctgacacagttaacattataggtgtgagctgaatatatgtgcacatttatatacttattttatacgaaagcgtggaccggaggtcatctgcttcaaaacttccattgacgggaaggtgacaaggaaatcctcgcatttgagggcatcagatatcaaaaagtctctccatttggatggctggatgtggtggctcagcctgtaatcccagcactttgggagcctgaggcttgaacccaggagttcgagagcagcctggccaacatggcaaaaccctgtctctataaaataaaaaattagctggtcgtggtggcgtgcgcctgtagtcccaggtacacaggaggttgaggtgggggggtcagttgggcccgggagattgaggctgcagtgagccatgattgtgccaccgcactccagtttgggaggtcgaggctgcggtgggctgtgattgtgccactgcattccagactgggtgacaaagtgaaactctcttaaaaaaagaaaaaaaggctgggtgcggtggctcacacctgtaatcccagcactttgagaggccaaggcaggcggatcacgaggtcaagagatcgaggccatcctggctaacatgctgaaacccccatgtctactaaaaatacaattagctgggcgtggtggcacgcgcttgtagtcccagctactcgggaggctgaggcaggagaattacttgaacctgagaagcggaggttgcagtgagccaagatgatgcgtgccactgcactccagcctggtgacagagcaagactccgtctcaaaaaaaaaaaaaaaagtcctttgtgagtcatattctgtctccattatccctagttctgccttccagcctttcatgattaaagtttaatttttcttttgagcctttggatatttgacagcagcttttgtacccttccatgctccagaatagataggggacttgataaagcaggtctctgcaaatatggagaagtgttgaaagtagactgtggcaggaactatggttgaacattagcataggagaagatgaagacctgaggggaaagattgtggattctaggcagttagtgcttcattttgaaaataatgatagctactgttaaatatttaactgtgtctcttttactatttttactttgacgcattcgctctgtttcaagttctatgttaaatgcttcacacacatcatctcatttagttcttacacccttatgaggagggtcctatatactttttttttttttttttttgagacggagtcttgctttgttggccaggctgcagtgcagtggcgccatctctgctcaccgcaacctccacctcctgggttcaagtgattctcctgcctcagcctcctgagtagctgggactacaggcgcgcaccaccatgcctggctaattttttgtatttttagtagagatggggtttcacttgaactcctggcctcaagtgatccgcccacctcagcctcccaaagtgctgggattacaggcgtgagccactgcgcctggccctatataccgttttactaatgaggaaataggttcagagaggccaagtaccttgccacagccagcaagtggcatatctggatctccatctgttagatttattaattgtatgtttttggacaagttgcttaacctctctgggattaaaaatttcctcaattgtaataatacttaccttataggtggggtgtgaggaataaatcagatagatcatccagcccaatgttcatagcaggtacttggtaactgtagctaaggtttgggtacagagcagtgaaggatcaacattcttctgattattactaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccaggtagccaccttgcccagagaggactcaaagtaatgttcttgtaatcatttattctgtggtcaggactgaagctttaggtagaaactcttgcatgtttcacatcagtttctgccagccaggtatgcctgaacagaaaacattcatttattcaaaatacatattaatcatgtgccaagcactgctctatatgctggggatacagtgtgaataaagtggtcctggctctcatgcagcttacgtgctaatgggaagtctgataattgacaaagaaatgatatcatttcagatagtggtgtctgaagaaaaaaacagggaatggggtaagggagtctagggtaggtttctttaggtagggtgatcaagaaggactcttctagggaggtaacatttaagctgagacctaaatgagaaggaggtgccagcccacaaagatctggggagagagcaaaccagaaagtgtgaagaacaagtagagagggctgaagtgggcagaaattgaggtgtttaagggatacagaggcagccagggttaatggattgtagcagcgggagagcactaggaagcaggtgaagatggagagccaggtagggccaccagtgtaagtcccaacaagtggttggaattttcttgattgcagtgggaagtcactggaggattttaagcttttttttttttcttttttttttttgagacagagtctcgctctgtcccccaggctggagtgcagtggtgcgaccttggctcactgcaacctttatctcccgggttcaagtgattctcctgcctctgcctcccgagtaaccgggattacaggcctgcaccaccacacccacctgatttttatatttttagtagagacgaggtttcacatgttggccagattggtctcaaactcctgacctcaagtgacctgcctgcccacggtgctgggattacaggtttgagccactgcacctggccaggttttaagctttttaagcaagagagttaactaacctgatctttgttggtgaacctacaggcatcagctttaggaaattacttcacatttcaggaaagccatgggaatgttggtctgcagtcttcagagttaggggaatgggttctagagagcatccttcccagcgcagtgtgactctctctgtgtattgtcagggcatcgtgaacgaagtgcgccagtccatgcagctgatgctgagccagctgatccagcaactgaggaccaacatccagcttcctgcctgcctccgtgtcattggctacctgcggcgcatggacgtcttcactgaggctgagttgagggtgaagtttcttcaggcccgagatgcttggctccggtccatcctgactgccattcctaatgatgatccctatttccatattacaaaaaccatcgaggcctcccgtgtccatctctttgatatcatcacccagtaccgtgccatcttctcagacgaggacccactgctgccccctgccatgggtgagcacactgtgaatgagagtgccatcttccatggctgggtgctacagaaggtctcacaattcctgcaggtgctggagaccgacctttaccggggcataggcggccacctggactctctgctgggccagtgcatgtactttgggctgtccttcagccgggtgggagctgatttccggggtcagttggctcctgttttccagcgggtggccatcagcactttccagaaagcaattcaggaaacagtggagaaattccaggaagaaatgaactcctacatgctcatctcggctccagccatcctgggcaccagtaacatgcctgctgctgtgccagccacccagccggggacgctgcagccacccatggtgctcctagatttcccacccctcgcctgctttctcaacaatattctggttgccttcaatgatctgcgcctctgctgccctgtggccctggcgcaggatgtgactggggccttggaagatgcccttgccaaggtgagcacattctgttggttttctgctaccctgggccttctctggtaatgggtggccagatttttgtaataaacccgtctatttgacggtgtctgctgacatggagaggtctagtgtggttttggaggttctcctgattgagaagctctggccagttgcccttcatgggacctaggacagtccatgaagtgatttgcctatagtaacaattcggtaatacacgtattagctttctagtgctgcataacaaatttccacaaacttagtagcttccagcaacacatttattaccttccagttttggtgggtcaggagtccaggcacagcacaaccgggtcctctctgctcagggtcttacagggttgccatcaaggtgttggctggactatggcctcatctggaggttggggctccatttcagactcatgcaagttggcaggggtcagttctttgcaattgcagaactgaagcctcagctcctagaggctgtccactccataggcagctgacaacatggctgtttgcttcctcaaggccagcaggagagctactctcttgagtctcttcttttaggtacctccttttaaaaacttcatttgattaagtcagatgattagggactttaattacatctacaaaaccctttacctttagcatattcttttatttttattgttaaaagtgttttattttacagagagatagtgtctccctatgttgcctaggctggtctcaaactcctggactcaagtgatcctcctgctacagaccctcaaagtgtgggattacaggtgtgagtcacttgaacttgggaagtccagcatcagagtctgtgttcttaccctgtcgctatgccacatatctgtagtgtcagctaggctgctctgttggttttgaaacttctctttcctagctgttttcttacagttttccagtggttctagctttctgaaacctcggggcttagtagaaagcttgtatagttttgcttcattttcctggatccagcacagttctggttggtcctccgtggaagttaagaaccatgtattgggccgggcgcagtggctcacgcctgtaatgccaacactttgggaggctgaggtaggaggatctcttgaagccaggggctccagaccagcctgggcaacaaagcaagaccctgtctctacaaaaaattttaaaacttagccagacgtgatggtgcacgcctgtagtcccagctacttgggaggctaaggtgggagtatcccttgagcccaggagtttgaagctacagtgagctgattgtgccgctacactccagcttaggtgacagagcaaaatcctgtctctaaaaaaaaaaaaaaaaaaaccaaaaccatgtattctctctatagttttatgacactcctccactggaaccggaaactatacccgtaatgtaacaagttgggtctgaacttcacattaataaagtgacacaattgtggacaatgaccataattctgagtttaaatgagacagtaaaataatgtactgttaaattactttgttcaggaaaactggaggggcatacatttttttgcctagtttcatgcactgctgtcccagtggtgataggctgtcccagtaattgacggtgcccttgtctcttaggtaactaaaataatcctggccttccatcgcgctgaagaggctgccttcagcagcggggagcaagagctctttgtccagttctgcactgtcttcctggaagaccttgttccgtatttaaatcgctgtctccaagtcctttttccaccagctcagatagcacagactttaggtaagagaatgaaaattctgtaaactgccttactgatgtgtaattcacatactaaataattcatccatttgtgtaagtcagtgttttttagtaaatatgaatccaattttagaatatttccatcactccaaaaagatccttcatgcacgtttgtagtcattcctcgacagcatccttagtccctggcaacctactttctgttgccatagatttgcctcttctggacatttcataaaaatggaatcatacattatgtggctgtatctggctaagcggaagaagccagtcacaaaagaactacatacgtatgattccatttatgtgaaatatctagagaaatggtttttacagtcttttttttttttgaggcggagtctcgctgtgttgccaggctggagtgcagtggcacagtcttggctcactgcaacctccacctcccgggttcaagcaattctcctgcctcagcctcccgagtagctgggactacagactcgcaccaccacgcccagctaatttttgtgttttagtagagacggggtttcaccatgttggccaggatggtctctatctcttgacctgtgatccgcccacctcggcctcccaaagtgctcggattacaggcgtgagccaccacgcccgtcctaaagtcttttttccaattcactttcacgtccttgtccctttgtggtaggagaggggcttggttgaggcacagcttcccaaagggcaatgggtcagtgcatcacacgtgcaaagcctggctgccctctgctttttccctggtgctgcctgaggtctgggttcctgctgcaggcaccctacactgctgttccgttacgttctgcttcacagtatagcttcccattccctgtaacaaaggtggtttttgctgtattaaaacatagtaattgatggctgggcgcagtggctcatgcctgtaatcccagcactttgggaggccgaggcggatggatcacctgaggttgggagtttgagaccagcctggccaacatagtaactccgtctctactaaaaatacaaaaattagcctggcatggtggccggggcgcctgtaatcccagctaccacggaggctgaggcatgagaactgtttgaacctgggaggcagaggttgcagtgagcagcaatcacgccactgcactccagcctgggcgacagagcgagactgtctcaaaaaaaaaaatagtaatggctcgttttttttcccttaaatttccttttttttttttttttttttttttgagacggagttttgctcttgtggcccaggctggagtgcaatggcgcgatctcggctaactgcaatctccacctcctaggttcaagcgattctcctgccttagccttcccaagtagctgggattacaggcctgcgccaccaagcccggctaatgttgtatttttaagagagatgggatttctccgtgtgggtcaggctggtctcgaattcctgacctcaggtgatccgcccccccctccccggcctcccaaagtgctgggattacaggcgtgagccaccgcgcccggcctcccttaaatttctatattgagttttattagtaactgttttccattttgctttccccacgtctgggttaggcattcctcccactcagctctccaagtacggtaacctagggcatgtgaacatcggcgccattcaggagcccctcgcctttatcctgccaaagagagagacgcttttcaccctggatgaccaggcgctggggcccgagctcacagctccagcaccagagcctcccgccgaggagccacgcctggagcccgcgggcccagcctgcccggagggagggcgagcggagacgcaggccgaaccgcccagcgtggggccctagccggcgtcccctgcctccagaacgcggtgcgtgaggttcccggcgcggggtggccaggactgcctcgccctggaaggtccggggcgggttcgggaggcgggaaggcgctcccgggaggagagcggaagggggcggtgctcactgccagtctaagcaggaaggcggggatccagtcgcggcttcgctgtgtgctggccgacggcgcttcccggcgtgccccgcgctgcggccggaaggggcgggccgggtcactgttaagggggccgccatggcccggctgtggggcgcgctgagtctttggccactgtgggcggccgtgccgtggggcggggcggcagccgtcggtgtccgggcttgcagctccacggccgccccggacggcgtcgagggcccggcgctgcggcgctcctattggcgccacctgaggcgtctggtgctgggtcctcccgaaccgccgttctcgcacgtgtgccaagtcggggacccggtgctgcgcggcgtggcggccccggtggagcgggcgcagctaggcgggcccgagctgcagcggctgacgcaacggctggtccaggtgatgcggcggcggcgctgcgtgggcctaagcgcgccgcagctgggggtgccgcggcaggtgctggcgctggagctccccgaggcgctgtgtcgggagtgcccgccccgccagcgcgcgctccgccaaatggagcccttccccctgcgcgtgttcgtgaaccccagcctgcgagtgcttgacagccgcctggtcacctttcccgagggctgcgagagcgtcgccggcttcctggcctgcgtgccccgcttccaggcggtgcagatctcaggtgcgggcggcggggaccggggctgctggagcagcgcgcgcgtctcttctgcccgactccgcgagagcgcagaagtggtcgcggttcatacgccggacctcccgcaggagcgaagtgggatgcgggagcggagaggcctcaggacggatagaagctcctgtggggtagagcccgctcagataggacgcaggggcgaggagaggtcccctagttccgctgttacctgacagcctggcgtctgctttctgctcccttgctctctgaggcaaacacgctcttcggccccagttagatccgccacggtggagttggagaagtgggggttagcccccgccagcctgacccagcccagggggctaggccattcccccgtggtaccacaggatgcctcgcggaatgcgggctctgctggggtcggggtgattgttcctgcacagcaagcccgtcggttcaagatggtcagaaaaacaagtggggtctcaagctgcagaacctctgttaggagttgggagcccacaggtacctcagaagtgggaggagtgttcggaagggtcgcaccgtagaaagatgatttctcatctcagctctacagtgagctcgataacctaattaccagagttgggaaccaggttgaacgcttggtaatggaccgagatgagggacgttttccagttagaagaggagctgctgtctacatttgccatctgctgttgcctcttgtcaatgggaacagccaggaccgggggcaggggtagggaggttgaggatgatgcagttcagctgttcccactcaccagggctgtaacttcctttgcagggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaaggtgaatgactaaagctttgctactggggctgaggattccggataccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtgactggccatttgtgccgagttcttatttttacggagggcttgtggccttagacgccagtttgcttatggaaatgaaagagaatagtccctgttcaaggatgtgtttcatgacagcacgagtgtaaatgagtgcccacacattttaacagccttgggcaggattttgctgctgagatccctagagcagctggttcttggctcattcttggggtagaggccgtggatcagggctgggggcaggggtgacaattgagaagtgcactgagccctttcctgttaacaattgggcatagaaagcaggattagtacttcctggttatacacttattttgtaaaaatagaattaatatcacagcaaccaatgtgtaggtttaagaaagtggccaggtgcagtggttcacgcctgtaatcccagcactttgggagggcggggcgggtggatcacgaggtcaggagctcaagaccagcctggccaagatggtgaaaccctgtctctactaaagatacaaaaattagccgggcgtggtggcgagcacctgtaatcccagctactcgtgaagccaaggcagagaattacttgaacccaggaggcggaggttacagtgagctgagatcacgccactgcactccatccagcctgggcgacagagcgagactcaaaagtatgattctggctgtagagttttctttttttctctgtctcaaaaaaaaaaagtgtcagctttgtcttgtcaagaggtgaaggaacttgttttattcttttattttttttttaagatagagacgggggtcttactatgttgcccaggctggcctcaaattcctggtctcaggcaatcctcctgcctcggcctcccaaagtgctgggatcagttgtgagccacactacccagccaaactccagttttagttaaactgtttcacctcatttttatgctgagttttgtaaagtaggtattcttgctgaacagagtcctgaaaatcaaactatacaagtagtaggaagtccattaagctgtttagaggaaaaagtgttataaatggcagttaaatgaacccaggaaagacccatcctcctttgtggctttctctgaggccccatgaggccaagcagaagcaaactggctctaggtgcagccagactttgaaaaggaatcccggccaggcttggtggctcatgcctgtaatcccagcactttgggaggtcaaggcaggcagatcacctgaggtcaggagttcaagaccagcctggccaacatggcgaaacactgtttctactaaaaatatgaaaattagctgggtgtgctggtaggcgcctgtaatcacagctacttgggaggctgaggcgggagaatcgctcaaacctgggaggcagaggttgcagtgggctgagatctcgccactgtactccagcctgggcgacagaccaaggctctgtctcaaaaaaaaaaaaaaaaaaaaaaaaagggaatcccaaccagatactggtgcaaggtcagagatgcagccaatggggagatttgtagaaagctcatagatgctaaaaacatgggtctttaggaaaattagaattcagctgagcctcctttcatttggacaatgttcagaagctcttacagggggctatggcaatcttttgatgcttcttatagctttctgaggttaacgcttttgtggtgggcatcggtagcaataaaatgcaaactttattgcatttccagtaaaatctctcccactttgagcaggaagcactcacaaaaaacgcatatacatgtcaacgttgtgagctcatcagagttttagaaatcaacttccacagtgaaagccaatgtaggcagaaggtttataacagaatccccaggcagagaagtgaatttcagagcatttcagggaggaaactcctctgcacatgtcagcatgtttaacatcgatgatggcaggttgtgtgctggcagccagagtctgaggccactgtccaaagttcagcgtcagtggttcctgttgctggtcatggagagagacaactggaaagtcaggtgtcttcacgctctaactagagcacagggatggaccatagccatgctaacctttgttaacccctaggacttgtcaaggtgtttaagcagtaggaatgaggaaacaacgttctgattcaagtaaatgtaactagaagtaaaaatttaaaaacttgtaagctcactaaagtgaagctctgcagacacggttcatatcctggtggctgagggcacataaccaagaacttacacaagcacccccaagccacaaagatcccagctgctatggttgaggggtaacctgccagcactggagccaagtgttggagctactgatccaaagttagctcacttctgcagaggctctgaaccagagcaaagaaatggcccagtgcaagcccagtgtgagccaagagttggccatgtaatcagttctggcccaaccaggtttgaaaggtagaggagcagtactgggttttggagagggaaggttggaacaaagccctttgcaggctataagcttcatttactaggccaggtctttctgtgtgaatgtgctttgactttggtctgtttatatgcatggggtaaacgtgggacagcctctgcagcttcactgcctgccggacgtgggtccagggctgccagctctgggtccttggtctgttgggggtcgcaaactgaaatggccatggggctatctgggcaggcaacacagatgagtggggatgggggaccccttctgtacagagcagcctctacttagtggccgctgacaggctgccccatgaggacgcaggcccaacattacctaatttaatcttctagaagtcagaattctgaatttttatgtcaactctcgactttttttttttttttgagacagagtcttgctctgtcgcccaggctggagtgcagtggcgcgatctcggctcactgcaagctccgtcccccgggttcacgccattctcctgcctcagcctcccaagtagctgggactgcaggcgcccaccaccacgcccggctaatttttttatttttagtgagacggggtttcactgtgttagccaggatgttctcgatttcctgaccttgtgatccgcccgcgtcggcctcccaaagtgctgggattacaggcgtgagccaccgcgcccagcaactctcgacttttaaatgttagcggcccaaagtgctgggattacaggcgtgagccaccgcgcccagcaactctcgacttttaaatgttagcggcagaccaaaccaaacaaacacagctgcaggacgggtctggtacgcagggctcccactttgcagtctctgatctgtaggccgaacaacggcaagaactgtctggatcccacaaacatccccagccaaacttctgaggccttaaggggaggaggccttgcacacctgactggagaacaggcctaagaactgcagtgttctgtttcctgctctgctttagaaaagagaggagacagaaaaccagagggtcttttaattggaagcaagggtggcccttcagagtctcagttaagagtcaaggaaagatgagatcacttgggtagctcaagaagggaaaaggatttattagaccatttccaggacagggacccaggggcagtggctgggttcagtgttctcacgctcagaggaagaaaaggcagtggtgaacacccgcctgactgccttaccctgatctaaacgacaccatctcctcccccaaggaagacacagccctggatgtgaacctaggagggtgggaatggcttatgtcactcggtctttgaggcagagcttgggctggggttgcaggggcatcagccaatctgctctcaaggagcaaaacttgggcgtaaaaggaacgggcagtggggctagccggctgtctggaggtctgggtgacctggcagcacggctgcttctcccccgccaccccgccccactccttgacacttccaggtgattttatctttataaataagatgaaaatccaagcagcattaatttaggggaacaaaagatggaaaaaaaagggggggaggcagaaggagctgatgagcatccaggagaggaggaagtaggaagagcagtgtccactgtgtgccccagggcagtggagtgtctctgtggctgcaaggcccttccttctggctccctggcagacggccagacagcagagggaactctgtattgactgggacaagccctggagccctgtctggctgttgacatggggagtgcctggatttgccccaatcaacctcccaccttcaccattgcccaagtgaagcagcttttaactctcttgcccaaagtcctctgagaatttcttcactttcaggaggtcgtctgcattcaccgtgggccgggtggtggccagagaccgcagcatgtccgactgtgaaggcaacagtatgtgcctgagcaggagccaggctccaggtccccaacctcccctcagcacacaacaggcgcagctgagggtgggaagaggtttgccttcaaggccaccccagaggcctgcttgaatctgcctatggcagggaccctcttccctctcgaggcagctcagatgggcctcctcctggtctgagaatctaagctccatcatctcataactccccttacgaacttgctttctttttttttttttttttttttggagacggagtctgtcacccaggctggagtgcagtggcatgatctcggctcaccgcaacctccacctcctcggttcaagtgactctcctgcctcagcctcccaaatagctgggactacaggcacgtgccaccacacatggctgatttttgtatttttagcagagacggggtttcactatgttggccaggctgctcttgaactcctgacctcaggcgatctgcccgcctcggcctcccgaagtgctgggattacaggcgggagccacggcgcccggccaggagccttcttagctgcacacccccaacaccagccacaagggcagacccttgccaggatggcacgggccaggctatgcaggtgaggcgctgcctttgcaactgcgtcacagtcttgacacattcactgcctcactgcaccgcaaagccaaacccatggattgacgtcatattatctggacctgactttacttgctaaagaatataaaatgcaggctaggtgtggtggctcagctcatgcttgtaatcccagcactttgggaggccacgctgagaggatcacttgagcccagcagtttcagactggcctgggcaacactgtgaggccgtttctaaaaaaaaaaggaaaaattagctgggcatgatggtgtgtgcctgttgctactcaggaggctgaggtcagaagattgtgtgagctcgtgaggtcaagcctgcagtgagctatcactgcaccactgcatctagcctttctctgtatgtacaaaatgctaatgctgccacctgcattctgggcccccagtgagtgtaatgccagcttccctgagctacaaaggccattctcaacagcccaggacatagaagaagactattttttatttttgagacggagtctcactctgtcacccaggctggagtgcagtggcccaatctctgctcactgcaacctctgcctcccggcttcaagcgatccttctgcctcagcctcctgagtagctgggactacaagtgcacaccaccacacccggctaatttttgtatttttagtagagacagggtttctccatattggctaggctggtctcgaactcctaaccttgtgatctgcccaccctggcctcccaaagtgctgggattacaggcgtgagctaccatgcctggcctggagaagaccgtttttattctggacccaaaccctcaattttctgggctctgtgcagccctcttccctcccctgtcaagtcacttaccatgcaaaccacaggctctaagagtttgtccccagggacatccatccaagtcatctccatggctcctgggtcccctggtgagcatggagtcaggaggtcatcaatcatcatgctggggttggtgcgagaggggccacagacctgaaaccaaatggatctgactggggcagctgcccctcagtgtcagaggggctcgacccctccggtctctaaggaagtcccaaagagaatgctctgtgggtccctagcatctgaggaggacgggctccttcagaactcgggctgggtggtccgagcgactcatgatttgcatgggactctggcaatctgtagccccaatgccttgatgtcttcctcattaacactgtcacgtctcaccaggaatacagtgacattaaaagtgtgatatggtttagctgtgcccccacccacatttcaacttgaactgtatctatctcccagaattcccacatgttgtgggagggacccagggggaggtaactgaatcatgggggctggtctttcccgtgctattctcgtgatggtgaagtctcacgagatctgatgggtttatcaggggtttccacttttgtttcttcattttctcttgccaccagcatgtaagaagtgcctttggtctcctaccatgattctgaggcctccctagccatgtggaactgtaaggccaattaaacctctttttcttcccagtctcgggtatgtctttatcagcagcatgaaaatagattaacacaaagtggttttccaactgaagtccgctgccttggcaaaacattcccccaatgtccacaaggctcattccctcacaccttcacctcctgtctcaggcatcaccccagtgccatctgcccttccctccatgcccgagacacctctctcctaaccctgctccatctccatcctctgagacactcactgactgtgttgactgtctccccaccaacaacggaaggtctaggatttttgtctgttggtcactcatatcttcccagcacttaggacagggccgggcacacaggaggacccacagcaaatactcagcagagatctgctgaatgaatagacaggtcttcctggtcattttatatccaacactttccaaacactgatttggtgtccaccccgcacaagagcacacagtgctgacggaggaggccgcagcagggttaagacagtaaagtggccctgtcctctgctttcacacaccctgagatggccacactccagaagagctgcagggaggggacagtgggtgcagcccccatggcactggccctcggctctccaggaggcctcagagactgtgtcacctgagcagccggggagcaggaccaggagctgggaaaaaaaaaaccgaacatcccgctcttactatgagatttttctcagcagtggccgcgggcactcacctttttgaagtgtgtggccgactgcaccttcctcacgggctgcatgagagagtcccgcacgatgatgctgatgtccgcgcccgagtagccttccgtcttccgggccagctcgtggatgtttgcatccgtgaggttgtggggagtgctcccgagatgcaaccggaacatctgggcgcgggcagcttcctccggcaaggggatataaattcgtttttcaaacctagagagcccagcacacggcaggagttgacagcggatgatggaatggtattcacggaaggggaggcacgaagatttgagtgaaacggacgcatttcatgggccagtgatgctggcggcacatcctcaacaagccagcctcacaaagggctctgcttggcaggcagacgggaagactccagggaaaaggggccaggctgcacccgggctgccagcagcaggcggaccgtgaccatggtgggagga

SEQ ID NO: 2009 - DNA, 1889 bp, Homo sapiens
gttcggagtcagcgccccttgtggtccggaagggaagtgacgttgttgctgggaagatggcgaccgcggcgactatcccatcggtagccacggccacagcagcggctctcggcgaggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaacatccagcttcctgcctgcctccgtgtcattggctacctgcggcgcatggacgtcttcactgaggctgagttgagggtgaagtttcttcaggcccgagatgcttggctccggtccatcctgactgccattcctaatgatgatccctatttccatattacaaaaaccatcgaggcctcccgtgtccatctctttgatatcatcacccagtaccgtgccatcttctcagacgaggacccactgctgccccctgccatgggtgagcacactgtgaatgagagtgccatcttccatggctgggtgctacagaaggtctcacaattcctgcaggtgctggagaccgacctttaccggggcataggcggccacctggactctctgctgggccagtgcatgtactttgggctgtccttcagccgggtgggagctgatttccggggtcagttggctcctgttttccagcgggtggccatcagcactttccagaaagcaattcaggaaacagtggagaaattccaggaagaaatgaactcctacatgctcatctcggctccagccatcctgggcaccagtaacatgcctgctgctgtgccagccacccagccggggacgctgcagccacccatggtgctcctagatttcccacccctcgcctgctttctcaacaatattctggttgccttcaatgatctgcgcctctgctgccctgtggccctggcgcaggatgtgactggggccttggaagatgcccttgccaaggtaactaaaataatcctggccttccatcgcgctgaagaggctgccttcagcagcggggagcaagagctctttgtccagttctgcactgtcttcctggaagaccttgttccgtatttaaatcgctgtctccaagtcctttttccaccagctcagatagcacagactttagggcatgtgaacatcggcgccattcaggagcccctcgcctttatcctgccaaagagagagacgcttttcaccctggatgaccaggcgctggggcccgagctcacagctccagcaccagagcctcccgccgaggagccacgcctggagcccgcgggcccagcctgcccggagggagggcgagcggagacgcaggccgaaccgcccagcgtggggccctagccggcgtcccctgcctccagaacgcggtgcgtg

SEQ ID NO: 2010 - protein, 617 aa, Homo sapiens
SESAPLVVRKGSDVVAGKMATAATIPSVATATAAALGEVEDEGLLASLFRDRFPEAQWRERPDVGRYLRELSGSGLERLRREPERLAEERAQLLQQTRDLAFANYKTFIRGAECTERIHRLFGDVEASLGRLLDRLPSFQQSCRNFVKEAEEISSNRRMNSLTLNRHTEILEILEIPQLMDTCVRNSYYEEALELAAYVRRLERKYSSIPVIQGIVNEVRQSMQLMLSQLIQQLRTNIQLPACLRVIGYLRRMDVFTEAELRVKFLQARDAWLRSILTAIPNDDPYFHITKTIEASRVHLFDIITQYRAIFSDEDPLLPPAMGEHTVNESAIFHGWVLQKVSQFLQVLETDLYRGIGGHLDSLLGQCMYFGLSFSRVGADFRGQLAPVFQRVAISTFQKAIQETVEKFQEEMNSYMLISAPAILGTSNMPAAVPATQPGTLQPPMVLLDFPPLACFLNNILVAFNDLRLCCPVALAQDVTGALEDALAKVTKIILAFHRAEEAAFSSGEQELFVQFCTVFLEDLVPYLNRCLQVLFPPAQIAQTLGHVNIGAIQEPLAFILPKRETLFTLDDQALGPELTAPAPEPPAEEPRLEPAGPACPEGGRAETQAEPPSVGP

SEQ ID NO: 2011 - DNA, 96499 bp, Mus musculus
  misc_feature (1)...(96499): n = A,T,C or G
gcttatctttaagatgaaccagagatataatctcacttagccaccctctccccccgttttccccatttcctaacaacactacaagaaatgatgaccagacccaatattaggaagctgaactctgggttaataacaatatcattgtagctagtaacaattatagactgtgcaattcccaagctatctgtttaaatcaataaatgattaatattagcactaaacattgctgttaagactctaatgtccatggcataattctgacatataccaggcatatcaactagaacctaagctgtagcgggtgctaaagtatttgttgagcctatgagttttgataagaatatttttatttttctacctcttattcatgattttgctattattatttaaatacaattcattgttttaatattggaagccagataaacttggattaatataattattatttccatatccccagcttggtctgtagtatctgaacattatcagtgtctaataactattcataggagagacggacataataactattcataggagagatggacataataactattcataggagagacggacagctttgctcggcactagatgaagagcataaggtttaatatttataacaaagatgcatttttcctttctgacttttcatggcactactgtttaaaattataacttttactatcaacataaatatatggcttgattatagcagggccccctagagtgtgaattaggtacagaaagctaatatgtatccagtttattatgaatgattggatttaatcaacagacaggaaggatttctgtgcaaatattatttttcccaatttaaatcctgtttgctcagcataactgaagaagatgtcattagtataggagtgagagagagtcttcgagctgcttcaagtacttggggaaatttgacgagtaggacatattcggagtgaggtgatctaccaaatgcaatccagagtggtgctttgaccagttttgaatcatactaattttgctatttaagacaagattttccacttgactcccagttttatgttcatataataaaaactataaattataaacataactgacacacagaaccagagcagaaggcttctgctagaatttagttggcagcggagaatgttgtgggtcttacgtatccactagaattattgaatctcacacacacatctagtcctttctttacttttattttatttttatgtgtataaaggttttgcatacacatgtgtatttgctctaaattgtctgtgatgcccacggcacctagaaaagggcgctgaatctgcaaaagcagagttatggatggctgtgagcttctatgtgcatactgaggacctaagagtggttcctttgcaagagcacggggtgttcctgactacttagctatctctctgtcctcactggccctttcctgaacttacaaatactttacaatagtcatttcaaatattaggtttaagaaacatcttacgttttgtctctgaataacaatcagagacaataataatctttctttgttctagaattcaaagttctttcttagcataacaccggctttgcattctgagttcctgttcctcaggcagcactgagtggatgctattttccaggcccctgctaaatacttttcctgccatatctcatctcagtatgacatttatctccaggaattaaatgacttgcccagggaaagccaggctgggggcagtcatgctctgggtctgcattgagtaagcatacagtctattcttcattggcaaaatgatgctgaatttgagtccagctgagagacactgactaatgtgtttataagacggtgggctgctaagagatttgctgcttagttcctgaccacacatcttgtaacaactggtgcttttgcaatttagtggcttccagtcatcatctactgtaccatcatgatgtgtgagacccattccctctctactcaccgctcaactcttggcacgtgaatatgatcttctacagtgaacagtggtggttgtatcgttgccagaacagtgtaggtgatattacatgatttggatggtgcgggtcaggcattccacatggccttttgattcagccaagaaacacagtcaacatgagtctgatgaggctgctgctaaaatttcatggcacgctgctttatagtaaatggaaaggaacacccaaatcactaatggactcccttgtgttactccccctgacatgttactcccattggtgtatgtcaggcgctgtgcttctacacatcttacaaggctggaggtcagtttacaggcagcatcaccacagaccctgaggaatgtattgtgccccagtatttgatgtcctcgctgctgctccaccctggttttaccgtaccaccttcaatatattgaagctttacctgatagagattatttggcatgcagcttgtaatgcatagaccaggaaacctagctggccaggctattttccttctttctctccatctctttccagcgcctcttgtagattatatagtacttagcagcatttctgccactgatctcctggtgtgtcactgagagaaggggacagaggaaggtgtgtttattttcctcagcaaccaagaccatagccagggcatcttgtgaagtcacctttgatagctgaatattagggtcnnnnnnnnnnnnnnnnnnnngatcacacacacacacacacacacgtgtgtgtgtgtgtgtgtgtgtgtgtgtttcctttcctcagtctactcattgcctcaaactcatgatcttcctgccccagcctccagtgctgggattataggcagacttttttttttttttaatcatttctttaaagctgctaaagctgctaacagtaacagagaagcccatggtttttctttttagtgagtcaagagtcagaggaaggttcaccattcgaagactgtactgtaacgtcagacagtgaatcactgaccccttcacagcagcttcctgcttctacttatcccgtaaggaaagcgaaggacattttatcaaatttctcatattatcaaaacagcacaatcatgccagggcccccaacttcctgttgtctcagcctctcgacttacacaggttgtgatgtgctagctacaaatacctatggcctactaatagcagatggccgacccgtcactgactttgacacctggacagggacttcttttgaagtgaaccctaggagacagaaggagatcattggagctagggaattaatctgatgtattgattactaaagaaaagagccaaattaatattttaaatatttatcccttcattacctgcttaaaaggtccctgcagacacactgtgagacccctgtgcacccctatgcattgccgttttatgcttaggacagatgtttttataaacattaattttttccccctagctgtttgcataagcatcctctaccgaattgcttaataatgttggggtatcagtacgtcagatttacctgcagtaacctaattctctctggctcatcttctcagccttgaagggcttctctgggtgccagggacagagagctagctgtcttccagaggaggttgttatatcattgaggcagcaaggtctgctcttggatggagaaagaaatagaaacaagatagggaaagataaacgtgatggagtgctattgagcagtgatttctgcagagaggtagtcattaaaaatttcctctagtcatgctgggacactttgaatagaactgcagttccagctcctgaagcgttgttctccagtctgtcatctacaaaaagaagctgtgctgagcccctttaaagcatctacacaagcatatacatgtgtgtcctgcttacagcactgcgttcctttttaattagttaaatgccttcattagatcatacttaatacatctctgcttactggttttcatttctgtcagccatttgtccagccttcctccaatcagtctagaaaagatttatccagcacttgttatttgccaggtactgagaataaaatagatatgtataaatacatatgaataaaataaatgccaaggattctgcctgctaaaacaattacaattttgactaagtgttatcaaaggaagaagtcagcaccatttgctgagacaatttaacccagaagtgggtgtttctgccttaggaagaatggtcagcgaagacttgccagagggagagagacctacagaaactctaatcccagagctctggaggcacaggtggctcagatctctgtaagttacgggataatcagggctgtgtagagagacactgtctcaataaaacaaaacaaaacaaaacaaaacaagaacaaatttcatatccaagggggaaggaaccaacctgggtggagtactaagaagggggcggggagtgtggagtactctgggcattcctcttctacatgtctctttgatagagtggtttgtgtcagccatggagaacagagtgtctccagtcttcatttcagtcttgcacaatggcacaatgtgtgactcagtagacgttcaaggtggagggcccatgggaaggatttcccagcatacaagcttcatggtgttaggcaagaaagatacgttgatgactattgaaggtgctttttgaattttgttaccacattcttggatgacctaaggattttgtcaatattcaaaacatattatgggaatttgtagcggatactttacagagttaaaatttacgagcaagttttattcagcagttaaagagagcagcttacgttcttcagcattttcctgccttctctagagatgacttatacagaatgtattatacaggactacatctacattgtatttatttaatttttaaaaatttggtctggatgggtgtcttgcttgcatgtatgttcaggcaccacttgaatgcctggtacccacggaggccagaggagggtgtcagatcccctggggctagagttacagatggatgtgactctctttactatgttaatgctgagaatcaaacctgggtcctttagaagagctgccagtgagtgctcttaactgttgagctacctctctaacctctatctatagtatattatatatcaatggttccagtgttgaactctaaagatgcccttctgcaaatagagtattaaggcagacccttgaagagagagtctcattgatttatcttaagggtatgatgtaagtagaaggtgccatgagttcttttgatacagacactgatttgagagcaattggctagggtaacaactcggtgtttgtagatgatccagtaagtcccacattgtgtacaataggtagtcatgctggggaggtcattaaaaagggcaatgactttcaggagaaagaggtgttctttggggatagtgatcatttaatctccaaataaaataagaatcccaagctttgataaaggcataactttgcttttcttgagatatagtttagacaggttagcaagtgaagactcttatctcgtctctttagtgattggatttttccttccgccaagatcccagtttagctccctaggaaaaggtagctgtcacgtggatctttgagtgttttagattccgttttagctaaggccctgtttttgaaaggtcaccaagctttctgatgactctagttgatttactacaatttaggacaaggagaaataactcttatttgaaatgaattgggcagtaattttattctgcttttttttttttttttttggttttacccactccacatacatactttcaactcattttttaaatatggttttcaagtaaatgttacatgtgtgtgcatgcatgtacactcactcatatgcatgtacaaatgtgtataaactcaggacataaatacagattatataaatgtatcgatgaaggtgctgacgagatttgcttatttatctgtggggtgggaaagatggctcagtaatgaagggtgtgcactgttctggcaagagattcaaatttgtcttccagcactcacataaagtggctctcaactgcctgtaactccaggtttaggggtccaataccttcttctgggctctgcagttatctgcattcatgtgtatgggtgcatacacataaacatgcatacacataatatgaataaaactttacttttatttgtgtgtgtatttgtgtaagtgtatatgcccacatgtgcacannnnnnnnnnnnnnnnnnnnatgtgcacatatgtgcagaagtcacaaaatgacattgagtactatcctctatcactgtatattcctttcgagacaaagtttctccttaaatctgaggctcgtgttttcccatcaatgctgaaagccagcaaggcccagagatcctcctgtctccagggaccttggagctctaatcacaggtgtccagaagtctctgggcttgttagcttggtgctgggacccaaactggtcctcatgattgtgtttcaagcactctttaaaaaaataatatttactactgtatttaatccctccatgtgtttatctgtctctctctgtgtttgcacacatgcatgtgtgtgcagacacatatgtgacacaacatacatgtggcggtaagaggacactttcggggatccatttctggttctgtagagtgaactccagactagctggtccgtgaacttccagccacttctgtctatgcttcccgtcttcccatagtggtgctagaaatactgatgtctgccattgtatctggacttttatgtggcttcagtgattgaacttaggccatcaagcttgggcagcaaatactttttaaaatcagtatcttactctgtaaccctggctggccaggatggaactcaccgcggagatcaggctggccttgaactcacaagacccacctacttctgcctgctgagttctggaattaaaggtgtgcatcaccacacccagcttgccaggtttcactcactgagttatatgctcagcagatagcaagtcctccttcattactgagtcttctttccagcccctaagacattatggtttcatttcaataaatcactgacagtcaaaccatgggctattcatcccaagacaattactgaataattattagggtggtggcttgtgagatgtccttgtattggggatatttgcatgggtgatatgtagataatggcacatatgcaccttcagctcaacctttggtccattcctgtgtccatgaagtttctttgagagcattagtaccatagaaatctttgtaagataccataaatgaactatacacgtgtccttaaacagtaattttatttagacatatatggaagtaactaaagggaatgagtctttgaggacagtgggttgactaaaatgaaaagtcagaccaggctgaaccaaccagggaagcatttagagttgtgttgtagtaagtgcctggaattgaccccatggctttcatggtcaatgttttagagccaatggaagggactagccttttttttgttgttgttgttgtgggtaatcattagtaagtcacacttttagacattaaacaatgaaataacttaacatagcttaagctagtatccaagcgggatagagtctgactggatcctctgaaagcacaacccttcacagagcttcacctgctaaggtttacctcctcttactgtcttgcatctctttctccatattttctctcactcttttctgttccctgggttctctaggtgggtcagcgttgacccaaaataggcactgctgaccacagtcagaactgtacaggatattttcctattgattttttttaatgggtcacaacgaccatgaacacgttggctgcattatcttactcctgtcttaggtcagcaccgagactgccaattatcccttctcctttgactggtgaggaaacgggtagaaaaagttcagtgcctttacacaagtctctgaattagtaaatggtggtatctaaacgtggattcttgaacaccaacaatgaagctgtgtagggctgcttcagaagaggagaggcatagcttcttagttatcttcttaccgtacccagggaagttcctgcatgtagaaagaacctagtaacttatgtatgaatacaactattcaccaggggtgtggtacaatttaattttctctgtctttctaattactgtccactagctttaccaaaatatgtatgcacctttcttggcttttccctaatttggcattatctttcttaacttcattgggctactataacctcctacactgggactactgtagtagcttatattggctgtcttctcattggttctctacatagcaaccaaatataaaatcccaccgtgagctcatcagtcctccattgacaactttttggtgatttcattcttatccagggactaaatcagtgacacctctcactggcttgacagctctggcatggtctggtctggacacctcttgggtttcatacatatcaacgattgcccctcgttctacgttcagcaacttttcctgctaactctcccccttcagacttttacatgtattatcacaactaaatggaagactcttctacgtcccactccccagctccagcctcagcccagagattcttgcctagggaaaaccccagctgacctcatgtaactgttttcatctccttgtagtaacttccatataagtaatcatggactgataggattctttaatatgtgtttcccactgggctataacatcttaagaatttatacagtaattaaactggtgtagctattcagtaagtatttatcaagcaggagagtagacaaaaattaaaaaaaaaaatgaacatggagcatacagtttctttggctaaactccctggctgactattttctattattggaggctcatttacagaatataattttattacattgtagaattgtgatgtatagaaacagcaagcttttctattcaattagtttggagataatctctgagacacagaaaggcaaagtcacttgcccgggggacacagctagtcagtgtcagatgtctttgttgtgacctttgaattgttacagggagaacctggctcttttcagaactctgtcaggcagctctggtgtgttgagcctgtagcataaatatttgataatattgatgttgtcatgtctgcattttaaagtgttttctctttgagaacacgtattactctttttttttttccttcttgtatactgatgtactcagaattgatcagatggcagtctaaaatacacaggcgtttggtctaaagatttgtgtgtcctgaaggagactgtcaccagtagaagcagcttgtgtgttccctttaccaggctgaggtcagcactgccctccctctactctggggtaggtagaagggtgaaaaaaagccatgtgcatcaatagcctattagttgtagaatgtgctctgtgtccagcaaccaaaactgtgtgtatggtttcaaactagacagagattcgtgctaggctgtttgatacattctagctaaaatggcagtgactctcctttatagcctttcttgcctacttctatgagtgtgttaagtgttaaaaatccaccacgatgtgacttccttctcctttcaagttctctgatgacatatgtcccctgcaagcatgcgtccccctgcaagcctgaactggtgcccaagctggggaaggcacagtcagcattgccagagcttgcctggctgctgtgtacattactggcctggcccagctctcggagtgtcccccctgtgcagatcgaggagtgctgtgcccctcaggtgccataggtactggattaagcaggtctgctattgcagacagacaccaggctccattctagcgtggagctgtgtttggattggagtttccagggccttatcaggagccacccctagtgacacagccggtgccagaagtaactttgactttcactcttcgccaagggcttgcagaacaccttaaaggaagaaagatggaggcgcttagatttgagatgctcatcccctgctcctttgaaagcttgtgtctgtaagtgaagctttattctggagatagttctgggaccacttaacagaagcagatcattctctgatcgaggaaggaaggcttgcgaattagaaatactgcctggtactttaaactgtggctttcaatcagctgcagctctaacctcttgtgcctgggtgtgataaggggcaagagctcatttggggaggagggatcaaaacgggagccttctcatgtaaaatggagttttggtcattaataatgacaggaaaaaaaaatcctgagtttgaaagatgggttagggcagagcagagcttgatgcagttatgaaatagatcacggttttgttatgaataaaaaggcattttctttaggaacatgcatgctctgtggcacgtttccccaaactaccctgctgcacacattgtaaccctccccctctgtgtgtgtgtgtgtgtgtgtgtgtgtgtgtgtgtgtgtgtgtgagtgtgtgtgtgtgtgtttgtttgtatgtgggggctaattccctgactatggaatattgtaaaatgttctgatttgtatttttgtagattaatttttttccttgaaggcaagagcaaaacattcagacatcagcatagtctccttgtcatagaaatactgaacaagatgaagtagcagttttacaggagtaccaaatggaaaccgactaagtagataagaccccttctcctctggcacctgctttccactttcactattactccctcagattaggaaacaatactggaagctgggtctccaagtgaaccggctctcaagcagattaacttatgcaaaagccacttctggagcttaataattatttactgagtgttcctgggtcaggagaggggttctgattaagtccgagaagctatttgttccatagctggtgaaggtgtgcttgaagacagcaagaagaatggaaaaatactaggtgtagcagaactattcttagaatttgattcttaaaaatgaaattcccataaattgaagtgtgggctaacagtccgtcatttgcagctgatgggtctttaagaggtcctgtaaagggtaattttgaaaatggtttctatttctgctgaagtttgcttttatagataccttgtacattctcatcccacgtgtcattaaaacagctaattattcatctttctaaaatgatcgagcattttatgaacaaagtacatataattatgcatttgaaataccattatgctgaaatttttaaaaataaatctctgccttataaatcagataatagttgggaagacagtgcctgctcgttgtgagtcatgtcctgccggaatgtacctacaacctgcacatgtttttagttctttttttttttttttttttttttttttttttttttgtatgatgctttattgtatgctacagccagtgtatataaaatagttaaaccttgtgagacagaaatccatgaaattcagagaggtagatgttaaggactgacgagcagaagatagtgtattatggcacgtgttaaagagaagcttttgtacagacttcaaatttagttctcttgaatattcactggttcatgaaaagtggtttgagaaacctcaagatagatgactacaaaaaggagcagactttcctggggtctgaagggattcgtacttgaagacactccagtcagcagagggtcatgttgagcattctgcagacagaactgtttcaagtctgcagctgcctgggaaaccttcacgcggttgagcccggcctccagccggagctgctggaccaccttcttcatggcggcgacgctagaagaacccgacatggcgctcgggacagccgggccgactcgtcagtccgggcagggggcggcagcgtttttagttctttttaagcaagttgagggatgacacccaatcaaatgtgccttgaaggtgcagcattaggacagactcgaatgtgtccccaaattaatccttaagtttaaatattttcctaggtaactataatatttgtcacaggaatatgtatccctccaaactttctgaatgaatcttctagcaaatgtctttgacaaaacttgtgcactgagctgtttgccattaactatttcccctgcctgggaattaattgtgtatttccttccaggaaagccagtgaacaccaaagcagaaaggaacattctagacgcttgtctgtcttgaaaataatccaagagctttcactatgtgggtgggggtgggggggggagtttgaagatgttcagcaaatgtgtttctctgggattaaagtacagtgttgggctggagtgttgggctcagtgggtaaagcccttgcagcacatgggtaaggagctgtgttcaggactctcccatccatgtaaagccagacttggtggcatgaatctgtaatctcagagttgctatggtgacatgggaagtggagcttatgggtcagctagcctcgcctgtccaatagagaacaagaaaccctgttaggagcaagatgggaagtaagcgctgatacccatagttggtctctgaccctgattctcatgtcatggcactcacgtgcctatcctgcaatgcagaaacatgtacaaatcatacacatacatcacacacatgcatgtgcacacacacatgatgtaaaataatttgccatgacttttgtgcattgtccagattatctgtgggctctgatcatagcacttaactgtcttaaggcaatttcacagttactgcatgtcaaaaggccttcttccattgccgttttgcacatggagaacctaagctctcagtaggtctaagcccgctgaggtcttacagctgacatgtgacagagctagaactggactccaagggtgctggaaccagagcttgttctctcatttgtcttatttgctatattgtcactggaaatgacaagtaacccggttcattcctctggtttgatgctgagtgagtcactcccagcttctttctctgaattaccaataactaacagtggtgagcttttaatgggttgtggttcctctggatactgcattttttttttgtcagagataattccataaatctaatttatggttgaatgtgtggcacctgtccaggggaggaggaggtcattgcatggattcattgatggtagggactacctccaacttgaaatagagagaaattcttctgtaaaggaaagaaatattggtgattcataggactcaaagttcttggtcactagatgactcaagcatgtctatcctttgaccgaagcgctcctaaaactcaggttctggtatcgatgattccatgaagtggagtgtttgctagaagagagataccaaatttactcattgaacaaacacttgtctgtgtgccggaaagtatacagtatgaaaaaacaaaacaaaacatgtgatcatctctgctgtcaatggaaccaacttccgcagggctaaagggtcaaacattactagacttttaagtcctgctcatccttatggcccacagtgactcccagaactccagccagtacagccacatgacaggagacaccacggcagatgcttcaaggacaagtgtctattcagttcctggagccaccacctgacattgcttcttaagcatcgttgaccagctttaggcatgtagccatcatagttcataaaaagctgggcaagaccggtagcagtgtgactagctaaagccagtagaaggaaggacaggttgaaaatctgcagtgctctgaaatccaaagctttttgaatactattatgtcataaggaaaaattcacacttgacctcttcagacaaattgccatcaaaaatgggcttagctaaaactattatataagatgacctctagtcgatatgtataaggggtacatgaatggatttcatgtgtatagttggttctgccctcaaggtttctcattatgtgcatgtaaatgtaaattttatagaattggttgacacccatgtcccctttaagcaccttagataagggacgcataaccatcacattatgggctaaatgctgatttctcttttagagagctgctaagatttcttgtacaccagactgtacactatttgcatgttcatttgtttgccaataaatattggctagatttcatatatgagaaagaataagaatattctatttatttcctgagattgcgtgatctcgcacagcgcatacagatacatacacacacacacacacacacacacacacacagactttttaacttcaggtttgttttgttttgtttgttgtttgagctgagtaatattccatattttttctagttctaatcctatcatggagtttctgattttggtagtggacaagtgcataaaatatattctatactgaagctgtaaaacttaatgtgaagcttcacagcttctgttctgaatgcctattctaactggacagatgatcagtgacttattgtatagatttgaatctagttaagttttggtatgcgatattcttatttcccagttgtggaattctaagacatatcaaaacaagcttgagctagagtagagatgggtcggcctttctgaaccaatgtttaggggtagtccagagttacgcagacttcagggatggcttgatccctttagtgctgtctggacacagtgctctcccttttgttctttggttcctgcagcccttgctactgttttgtacttcacattcttgtttctagtctgagatagatgcacgaaactcagtgttcgcttcctgctagatttctggttgtcaaggagagttatcttaccgctacagttctagtcagaaatggaacccactgtaccactgtaaggttcctttctgaccctgttgatagaggacagataggctgattagctaggcctgccttgtgcattcgtgagctgaaagtaagagatgttggctttgcaaggtgaaattggtggcacaggatgctaagtgggccatacttaacgggtgggcacagtaagccttggtggctacttgcatggctgcctctctactgcatcaggtacacccattcaccaattatttttttagtttgtttgtttgttttgttttgttttgttttgagacagggtttctctgtatagccctggttgtcctggaactcactctgtagaccagactggcctcgaactcagaaatctgcctgtctctgcctcccaagtgctgggattaaaggcatgagccatcaccgcccggcccattcaccagttcttatatgataatgtgcctatctggatttcaatctggtgttataatctttgggtcttggtggatatattctaagcatgcagtgattattaactattataacctgaagcttttaaatatttgttaaactagtacaatgttgtctagacaagagacaacatgatttataactggggaattgtgtcagtagctatagaataactttatgcctttaaaaagttcttcttttttgtttttgttcttttcttcaagacagggtctctttgtgtagccttggctattctagaactcgctctgtaggccaggttggcttcaaattcatgaaggtcctcctatctctgcctcataagagctgggattaaaggtatgcaccatcactgcctagctaaaaagttcttgcttatagctaggtgtgaatgagaatccatatgggacagagtgagcaagaattgatgagtatggaactaagatgacttcaaggttaagagtgttcttacagaagacccgagtttctagaatacaagccaggtagctcacaatcatctctaactctgtctgaagatatctaaaacctttggcctccactcagtagtgtcacataggagttttatctcatgaagtaggccttaaatccaattttaaaaatggctggctactctgataacatggcacactcttgttccagtgatctgctttatagacagatctctgctctagctcacagggtttgtagctgactgagagtgatggttatttatcttctctggtaacatatacaacactgccctggaccactaatgctactcagtaagggtaaggcttccagctcatcactagctcaacctctccatacgtgatgacaggaatatatgctgctttggcaatagggtcttactgtcaggttgtgaagtgtaactgatcagattggcaatagcctatagtgttggtttggggaggcatctgtgggactccttttgccaatgactcaaaaagatgtagcccagtcctggtactgtcaagtaaaatgaaattatacaattcacacataagtggatagagcaatgacccttagtgaggttacgcagcaaacattgtatgtttcctcttacttctagatgttagcatttaagctttaaattgtgtatcattcatagcatccgcagagattaggtagatagtaagatatcaggggtggggaatcttccaaagaaggagaaatagaatatagttttatgaagggataaagaataaatttgaatagaagattaagtgggaagtgcttgggagggcaggttagggtgtgtggtgtcttgttaacaagagactggcagttccacttgaaagacataggaatgagaaacacttgtgaagcagtgaagatcccaatctcaacccagtctggtgttgaagtgcctgggacagcgtcatctctgtgttaattgtaaaggtctctaagtatcgtttttatccctcttcatcagtttaaagtaaatcttgtcagcatagccatactttgtcaattacatgactatgccactgtaataatatactaaatgagctaagttatacaaatagaaagtgaaaatgagatcaatgtatataatggaatattctacttgttttccctgtgcccaagggcatcacactatgtgtactcttttgagaatgtgatgtactgtcagctgaattatggttctgttgactttcaatctagttgtttttgagcttactgttgcctgatatctggtggtccaacttagagaatatagagagtattgaatgctgtctctactctctacctaccaactgggcttttggtattggttaaataaaaatgtcaagtttgaattccatatggctgagggttcttaatttgtaaagtttcttccttatgtgcaaatgaaaagcataaatctccaaagccagtttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnatagggtttctctgtgaagctatagctgtcctagaactcactctgaagaccaggctggccttgaactcagaaattcgcctgtctctgcctcccaagtgctgggattaaagatgtgcgccaccactgccctgcaagttactgatatttttaacctgtcagtaaagctaaaggaataaactatttggacttaggaatatgccttgtaagacagaaccctgtccagtagccctttaccatcatagaggaggctttgaaagctaaaaatataaattcatcaaaaggggtgggaactgagaccacacggagggtccaccccttgccagtatactgtattccaactgctgcattgaacaatttaacatttactcactctgtccccacagtgtctaggggtagttttggggaacactctgggaggctgaatggctcattaaagctcacattcctcaacagtggctgaaggagaactcgagtccactctgtggccctccttgactagtatggagcaagccccacactcagggaacgagttcagctccagggtcagggaggtgtcagcatacttgtggccatgcctgtgggtttatctttctgagggagaggggtgcacctttccatgtagcactcgatcagaagctagcggtccagataattgacatcatgaggcatctgggaagaattaatctggccagggctttcaccatggggttgggagctaggtgtcccagcacctagcaacagctatttgttgaatcaatgaacttcacataatcaggttaaaaggaatcatactcacggaattaggattaactagctagagctcaggttcatgggtccaaggatgagcttagtcagcaattaaaatcagacacactggacatctccatgtgtgtcactagtggcgtggtcagtaagtcctcgtttttaaaagcagtcattctggccccttggaatatcccttacatgaacttgcattctttactaactcttacccagtctttcacaaactggcacttttgtctttgtctatgaggagataattacagattcagttacttctaagagaagtggacactcaaaagatggtgagccaggctaagaatctggtagtcatgtctcacaatgtggaaatagccgagagagagagagagagagagagagagagagagagagagagagagagagagagagagaatgcgcgcgtgtgtgtgcacacagagttctgttgcgctatcccctttagaaacctttattcagctgtcaattagctgagctttgttctgtttatatacatatgaaatatgcttgctattgtttctttcatgtggtttccctgtgtttgttccgttctattgtataggtcagtattatttttttcctgataagactattatagaagatactttaaatgatgttgttattgtggttgaagcatgaagccttagtgagcttgctaactagtcattttaatttgtctccaggatgctttactattaattgaaaggattttccccctggtattgcagccagtgacgcgtcttgtgcagttaattagcacgattatgccacagctccttttgctcctgcacaaaggtttgctcttgtttttatcaaaaggatcattctctccgagaatgttgggacctgacaggctctgaatagtaagaccacttatttatttttaaatagccacccccaatctttctcggtttaggaaagtacatttgagctttgaagagctactctaaaatgggaaatacattttctttagatgctcattttagcagattctgtgctagtgagtggttttaggctaacagagcaatggctagggaacattttgattgtgtgaatgagtctacaatgttaagataataagcaaagtatatacgctgcttggtcagtgttccctgtatgtctgtagggaatgccggggaaaacagaagaaatgggaggatgttttaggtttgggggctactgaagtcactcaggggtgccgtggtctcttcctatagttaaagtagtgtctgagagctctagtctcctttctaatagcctcgtggtgaggttgatcacctgtcattttctttagttagtgtctattgtatatattgccactggaaaaaatactttggcgttattatagcttaaaggagaaaagctgaaagaaaattgattttcctaagttcatccccactcgggcaagtgtgtttgccccatacatcattccctgctaggtgctttgtggatttccacatacatgctgagcttataagccccaatcagcctgtaaatccactttggaatctgactttatgattcatacttactgcgcgtgtatgctactttgttgttcatttcgcattttcaaggaaataatgtaatgtgttaatgagttcatattttattaattaaccatagttattattattttaaaaaaaataggtgatttaggatatttttaaatctgtaaaagcctttgtctatgtgaatttttccacttttgatttccttggacaactacatgtcaaggaagcttctgaaacaaaataaataacttatttttaacctttcaatataattttattagagcataataataataataatgaattttaattatgcatttcttgtcaagaatgtgtttttaaaaattggacactacgtagatatttccaccttgattaaaacattattttattgtatagttttattcatatcaatagtcttattttatggggttttagtagatacatggtattaaattttgtgatttattataatttactgagccagttttctatatggaaaataaataaacttctaggatctcttgggggatgacacgagagtgtgactcagacctttatcttgtagcacatccggtcatttgtgaagtgttttgtccttaggctatgcacagagatggccaggggccttaggacttctgtctttggtaggaaggtaaacacggtactggggtttgcagttaagaggaaggataagttctgatgcctcccctggagtctgatagatgcaaatgttctttttttctgttcccagaagctaatatcttttatcataaacttgcacaaaaatctgataattataattaagtttgcttctcatactagatggcaataaaagcaagcataaacatctattggggtgatgctcactgtacacgggggttataagcactgctttatttaaacttcatagcatcagtccttaggagggatgagtggtgcagcagatatttaaagaacatgccgccacttttataagtggataaaatgctgtatacatctcttccaggtatgaagacccaggcagaaagaggtttattatttgttcatagcacagagttggcaggataagcaacctaaagccacacctagggaaaacaggaagtcttttattcttacctactgactgccatgtaagcctgttagataatggcgaacagagtgtgtccctggcttttagaagtagacctgatggggaatagacagaaccccgatgccatgggcatgctcagatgagtcgaaaggaaaaacacacaaagagaaccaggaggaagacttgggctgtcacttcagcttctcttctgtccccttgtttttggacaaggggaggatgccgtgtccacatctggtccatatgcttctttcgttaatgatttgggtcatctcttgtcttccaaacctttccagtaacagtgtttccttatgagcaaccatattagacatcttcaaggaatttagataacatgtaggactcattggttgtttcgactgagctattttaaaaaatgaaaaagaaaaagcaaatcaagtaatttgtttttgtctgtggagagttgcttgccattgagaccaatggctcctatttgttggttatatcggcattctattcagtggtgattaaccgtgtgtggcataaagtatcgaaaagaaataagtgatttgataaaaaccccagatgcaatcagcctgacttattttaattttactcctaatgacttgaatcctgtcacctcttgatttccaattacatggagtgccatgccgtgccttgattatatctgtgcagactcacctcctagtttggtggcatttaggatacccccgcgatgcaggtgatgggtctcatcaggatactaaatgctgtgtgccttctggtttccccacagcagttctgcagagcattctggggcctccaagcctccgttaagctcctccactatgacatcacgcatcttgctacgccagcaactcatgcgtgagcagatgcaggagcaggagcgcagggagcagcagcagaagctgcaggcagcccagttcatgcaacagagagtggccgtgagtcagacaccagccataaacgtcagcgtgcccaccacccttccctctgccacccaggtgccgatggaagtccttaaggtatgtgagtgttgcccttgtgtttggacctagcctgtcccttctccacaccctaggtatcacattcaatggactgtgtctttccttgcattgctattagtcttatttataagcattgcttccagtggttcctataaggctttgtattttaaaagaagtatttaaactcactgtaaatattatggcagcctgtgagtagtggggagagtcaacattttcatgaccaatcccaaatgggatctgatgtttgttataacaaagagcatttctctttctttcttttggaaatgatttcagagttacctgaaagagtcctcttctagaaacttatgtgtatgtcttcctaaatgcattccaggccacactttaactttgctcttcagttagcaaaccctgctggccctagaagctaattgttttagaaagtctcttttcagaaagagaactgtggtcaagcgttctgcctgtgccttaataaccagacttcataatccctttactgaagcgagctgtctgctttgggtctctttgatttcttgctagggtgaagactgcgggagcttgttaacatccttctagcagagacacatagcttcctaattaccagaggaagttgtagcaggtcaaagcatagagcgctatcccctacattgtctacatgccacatggggagttgccgtgtttcataaacatttcaatttgtaaatatgactggttcaaaaaagactagaggtagagaaacttccatacgttgtgtttacgttttacccattcacctaattgatccattctgaagagccaagtgttcctgttcattaagcaatgtgagctctgcatgctgcaaattcattgttggtctttgcttttacccttgtgcagaaaaaaaaaatccttccatcttccctacttaaagtttattattaaagtgaacaggagcagtgtgcagcactcaggatctgtctgtgatcttttccatgaggaaaggaattctttaaaaactaactttaaagcaccacatagttatttacaaagattttaaaatttaaagaccctattgtagaactctttgatggagaaaccagttgaaattctgctaaagcaaagtgacccaactggttcagcataaagttttactttaatatgaccaaaattctgaatattgccgcaattatgactcttttattcttccaccatcccctgtcaagtaaaaacaacttttggctgtagaataaactctacatgaaatctctctgtcctgcttgggtagagccaattgtccctatttaagttgtaacagatttaattattgttttctgtttgcaagagccatggtcattttgtttatactttatttaaacactgtgacttttataataacaagttgcagagaagaagacctgttttataaaccataatcttaagtttgttaactgaaaaagcaaattttagaggcagtgccggggatttgagtagagtggtttacattcaatttgaaggttatgcttaattgtagtgaggtgtattggcttgaaatggattttcctgtaagagtgattacatggggtggtggagaatttaccacaaaatgaatgtgtggaaacatcatttcaatattatacaagaatttttacaatttctgaatgtttaaagtgttaatttctagcctcattacaattaaaatctatattaaacatttgaatactttatgtattttcccttatactctgcttatccaggtaatattggattgaactgcagtctccccacaactaaagagtgccagaaaaaaatgccccaagttaaagcaaaaataagttactaaagctagaagacatgagctggccgaaagagccaccggttaaatttgtttattgtgctctcaggagttgttacctctgtttaagtggagagtgttaaatagaaatatctccttgggctgtataagcgagccagccatgtctcataacgagaagggcttgttggcctaacaggctatagagagctgatagctatctagacaaccttagggactttgaagccaaagaacaaattaaaacgggatcgcattcatcagaggtaatattgtaagacagtcaaacctcaatgttcaggtgaatttcctattgatgattccttgagaatgactgacttcacactttataaaaatagtttcttaagctcattgtatggaatactgaatgaagaagggcttcatagacacacacacacacacacacacacacacacacacacacacaccccacaggttctcctttccttttctcatttgtgactttcaaatcatagaacacagtttcataaagtatggatatagagaaatagctgatttgtttcatcttggaccattttatacatttttaaatcattagtgatgcaaacataggctaattgtgtgcattatgatgtgatagactccattgaacacatttttcggacagtatatccttagtaaattattgatttcatttttatagttttaagtagcagggcaggtgcatatccacttctccttgaaggcaggcagctgtggaagtggagaatgcccactcagtttctccattttccagtgtgtttttacaaacacactggaagaaaggccaaagcctaaattttataaacacacatactcctgtcaccagtaacccactgccagtagattgagctactcattttgacagtggtttcaggttaatccctttctctggcagcattttactcaaacaacggaactctctgaagcatgtttaaaaattgttgacatctgaaaactttgggttcattggaattcatattagagtggaaattcccatcatttcttccccagaacatgccagaattcatgagatacagcctcagtattctatattaatttcataaatttgtgcatttaatccttatattgattttcacagtggatagcatgggagtgttggggcttattgtgggtatttgcacattagtgaggtgttgacttggtttcttaataacactataataacaataacagtttaggatggtaactcaaggaggcttctttactgtaaatagtgacatcaggggtgcataatagatttttttcacagttgtgagcacattctatgtttcaaatagtgaattaaaaactttgctaagaactgtttatggctcgctttcttctatatgtagaatttgccagcaggtgaaccataagaactgaggctgaacgtgatctaaacaaaatcagtcaccagggacagacttttagccatggtgggtctcacatctacagaagcatcacagtcaagatggcagcacacacagacacacacacacacacacacacacacacacacacacacaaatagatggacttggtgttgataacactcactgagcctctcctgtccctggtttatctatttatctgtaattgattattggagcagatgctactgtgatctgtcaaattcttcaatttaatcccctgtcaccttttccatagacccaggcagtgtggagcattatagtagtttataattgatattcctttctctgttgggaaacttgcaagctccttcttccaactctcttccttctgttaatttaaggatcaaaaggccagctgttctttctgttgtatattaaatttgctcttctctgttttgaaaaaaaaagtgttgatggaaaagaatttttgaattattattttagtatattattgacttttgaaggaatttattttcaatatttctttttattttccagaccatctcaggaattgggcaaattgcttaccaattagagataatgttttctgttcatcaaagctaggcatgcattttccaggatcctgcatgtggcagactgttaacctgggcatttatgggtggttctctcatcgatactctgcacgtttaagcagaaactcttgtgagtgctgacgatagactagtgcattgtgcatggtatgtaaacagattaggtgtatctccaactcgacacttaacttttgttcctgatttatttagctggtattgagaaatctgaatctcatcacagtgaatgttaaaggtaggaaagctatggcctctctcaggtcagcttgcgttggtctcctgagtcaggattcatagctgtccccagaagatatggcctgctgcatttgagttatcctctatattcatacacttaacctgccagtcagtgtgacatacataagcctccatttcaaagagttttataaatattgaggtcattgtgattttgcataaaactatatgtcttcaagaccacatcatgaagtcttttttcttctacaaacaggctcctgccccataccacctaatttctccccccaccaccccatctcgacctccccccccccacagggactttatttcatagagagtcttagacttgttcattgttacctataaggtaatttccctgatttttaagacctattgagtaatttttagaaattggagacggcacttgttatcttccaacagatttccacagctgaggtaaaatccatcaggaaaccatggcttacttcctgtagaactatggcctttctgccgtttcctctttccagtgccaccattgtctttcataggagcacagtgctgagcatgtagagatgacccttcgtattttctctatgttgtgtctactcttgagacttcacaatcccctactcttctctgggccgagtagggactctcgattgtctacaaagccaattgatggttctgctgtaagcaagtgccagcttgcttggcaccacctgggagtcattcatgtcccatgtagcttgggaacccctgtgaataggaagttgctaatgtcagggctagcccaagaaggtattccactgagctgtcttaaaaggcacaattcatatccttattctcatagtctctgtctccacagattttgtgatgagtaattagcaattcagtgtttgctagacaaagcctttcttgtttacatttgttatgtaagcattacacaaaaatagtaattgcattactagccacaacaaaatatccagccttataaattaattatttctcaaaatattgagactttaacatctagttgcacttttacctgaggatgtcagcaaaaagaggtggtgtgggaatgggattctctttttatgacctctaggccagtttttgttttgttttgtgttttgttttttagtgtaactggggttaatggagccaagggctttgattagaatcttagatttctttttggtttcttcagtttggggctggctgggagcagctatacctggtggatatgttaaccacatagcagcttatcttagagtagacaggtctttagtttgtctccatgacccacctggagtccctgcagatgtcttgtgtgagaggaggtgccagctccccattcctcatgttattgtgtcaaaggaagattcagtctttcatttatcacttatccctattagttggggtaagggcaatattgtcaggaaagtattaagggatgagactcagggtgagggcaagtacaagccagggggtagtttagtgaactctacaatgtgatttccctttgatgtgataagttccgtagatcatacgtcctcaacaagggtagcatcatcccattacgggaaacaagattggttcttagagagcaaaaatccaggtttatgagatggctcagggatgagagagcttgaggtgcaaacatgtggatctaagtttaaaaccaaagaaaacacatacaaagctgggagtgactgtgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcctctcattgtctggtgtctcgaagaaaaatgcagagcgatggagcagtactcccaacatcttcttccggcctccatgcatacaacaagtatgacatgtgacgtctgcatatgtacacatgaacacacacacacacaccccatagatgtcacagttatttgttgctctcaacagcttcagtatacagctaggaaagcagtgttattatgtctgttaaaggtttgggaaagtgagtcagcagaacacctgaaaggtctcagaggctcactcatgaggaaagggagaacaacactgctgctgagtcctcagaatctcctgctccctgccagttgtacttcaagaacattggccaggattcctgtagacatggcttctgcattctggctgggccttcccccccccccccccgaaccctcattacaatcacactcatgtttagcatggggccgtggtactgaataccacagatacaggatgctgccctcatcactgttctgtgaggctgttgttagcacccccattcaacagatgcatagacaggcgtggaggacttaaataggcctggtaaagtcattaaaggctgaggtgttagcaggacttgagcccaggaagttggctacttatagtagttagtatctttcttagagtaaccagagaagcttctagagaagagatagatgttcaacccctcaagtgatgtggccacatatgagccaatagcacttgtccattgcagacctcctggctatggcttataacgttggtaggaattgctttgatggcatggagggaaggcaagacagcttcgctggcttctggaactgattgtagccacattcggtgacaggtgaaaggaggacatttcagttcattattctcttaccaaccctgtggatctgtaggattagcccaggtaggcaaacaggcatatggagattgnnnnnnnnnnnnnnnnnnnnnnnnnnnnnnnnnnnnnnnnnnnnnnnnnnnnnnnnnnnnnnnnnnnnnnnnctgcatgattttcattggggattagtcagggccttctctgttgaataattaaatttccttccctagtctccaagatacatgcaacctaggaactgactgtgttcttcctatgtgagaattctgtctcagcacactgaccatggtgatactttttggtttagtaactgagttgtcattatgagtgaaaaagcagtagtacggagtttcctaaagcaacatctgaaaatctagagctgggatctttatagtctaagggtctcaatggcccagcctactccaatttaggtgcttcgtccctctctatgttcagcgatgccttggtgcagttctaaatggtttttattcactccccataggaatttgcccctgaagttatggtcccatttttgttgttgttgttgttgtggctgtcttttctcctcccttcagtatcagaacttttgacattgctctagcacttaaaatccgaacttcagatctgcttggttttctatttgcttttaagtgaatgtcaactgtaataataattatattattgcacaaggaggtcacagtccccttcacaaactctgcctgtttcatctcagttaaagaaaagataaacttgaaagactagtcatggatgtcagtgggctttagaacaggagagaatttggacgcatctaagcaaaatctaaatttaacttcaccctactaaaataaatggctggaatttgtgttaaaaatatgtaaattagtacggcagctttgctcaaggttatagctgcaatcagtactagaatattggctcttgttccgaatgtgtctcttcttattgcttttttgaatatcagcctaaacttgaaatctgtagcatcccacatgcatctcccagcttgtcaggtcttgtttatagtaccctaactacgtgagaagatgtatagaaagcatgtaaactagaatgcagttaacatagaatgttctagaaagagttgctttaatcactatgtttaaaattgattaacacctagagggcagaggccactggaggcatggctcatcaggtaagaatactgtctgctctcccagaaatcctgagttcaattcccagccaccacatagtggctcacaatcatctataacgggatctgatgccctcatctggcatgcaggcaggcatacatacagtgaatgtatgtacatttcattcatatacgtggatttaaattttttttaattgataatacaagaagatggtccagatgaatcaaaggcagattgttcctcctggagatcctgggggtgctgctacggttggatataacagtagtgaaaggctccgctactattttcctttaaactagatttgcgattttagggttttggaataatagctcagttggtgaagtgcttgccttgcaaaccttagaacctgagcttgatacccacacccagacctgcaatctcagctctggggaggcagagataagaaagagcacagtagcaggcagcccagctgagctggggagtcctgggtccaggagaccctgtttcaaaatataaggtgcagattggcagggaagacagctcctgtcatcctctagccttcacatgcatgcacatgcacacacatgcacacacatacatgaggcacaaagcctaggagactgggttcgtgtagtatttatgtaactgaccgtgggcatctttaacatattttacctaagagtttgatgaattcctaatcacctactactctctgaggagcacactgcttctacgggtaggcctatcagactcacgttcatcccacagtttctgaagttttcctagaagcaagataaaaaggttcagggaccctggtgattaaaaatgagccgaaggaatctaatcatccggttgtgaataattttagtgttgcaaagaggcctaaaacaaaaggcgcgactcaggttgctccctcccttaccgtggcatacataactgtgttgtaatctcccctgttggccctggtttttatataattaaaatttagaggctggaaattttgttgagacttaattagaagtgacaaaccagagacattcctgccagttaggaaaggcttaacaagttcttattggctaacttacaaatatgtagcattttcacactgcctaaaggtgacaagatcagctctgtttttctagtgaactagtaaaaattagattaataagtaccaggcaaagaaccttttcttttgtctttttttttagccccaaagagatcttacctttgagtacttctggctgtggagattggtgccttaattagccacatgttccttttgcctcctgggaaataagtacaggctaaaattggggatcaagacacaggcgtacattgacttagcacacgccgccaagtaattcatcaaggaatgttggtaattagtcctgcctctttcaactcttggcttattttataaaaccggttgatttaaaataatgcctgctgatgtattgcccacacgtttcaagaccgggacttggctcctcaacaaaagagagattgtccagggagggaaatgtgccctcctggttttgtgttttcacagattttgagactccatctatgtcacctattaactcgggtgctctttctctttaccctattcaacatttcatggggccttctctttttgccttgatggaaagaataggggagcaaacttaaaaaataaaataacatgtaagctcctgggaggtgggggtgggagggttggatgtaaggagcttgtcacagtgtgtcacctcagtgtggcttgatggaatttaattcgaatccttcatctggtgcaagctgcagtaatgatcttcttgtattgttaaatgcttgctgatatttatggcagacagactaatcttaagagactgggtttctggggttcacaagaccttgtgattacagcctcatagcatgtgtagttaactgttttagaaagtaacctgaatgtcaaattcccacgctaagtgatgcatttaccgttatgctttgagatgtggccacagtcagagctgctcttgaagatcagtgatagcccgagcccagtaccacactgagaaaccatggctgttttctccttagaccatggtatcctcatctgtaaactgtgggcagtaaagtctactctgggggagggggggctttacagatgaatgaaggatcccccccaggccatatcactcaagtcatatgccaagctctgacttcagagccttgagtcctcaggggaaaacaaaaagaagcagacaaaattaatttcaatatgttttatacaaccaagtatatccagaacgtcattatttcaatctattacacgagaattatctgcagagtttcaactttagccccctcatcgtctttgtaatgagtctcatgctgtcctctaatttgggtatatatttcttgtctcctacatattgtagtttggagatgaagtttcatctgaatgacttgacctggggtttagatctcataaaattttcactcatttgcattcatttgctaatgttgttttagtcctgtaaagaagctttctagtgactggaatggggtggaggctagctggcagagtgtttgtcatgcaaaggtgaagagccagagccaattgcaatccacagaacctaggaaaagtctgacaaagcagggagcatctctcttaaccaggtttttataaggagatgggaggtggggatggcagaaccagggaaactcaggagccggtagtcaggcaggcaacagctggaacctctgtttgtgagaagcaagcattgaagttttcctgagtctacatgtgtgtggtgacatgtacatacataaagtcgatcacctgaacacacacatacatacacacacacacacacacacacacacacacacacacacacacacatgcacttgagtgtacacatgggggggatttaaaacaattttcttccagtaattaaattgattatttgtttcaatttaggtctacatgagatataaaattcagctccttcttaagacttggcccccgtccccgggctcagtagtttcaatgccctgtgacctttggattggatagcacagaccctgaaggatttagcacagtgttgagtacaaggagcgtcatcaggaagatttctactttattggttataataaatttataatgatccaggaggggagactgtgtacttggtagagtggttacaggcgtggagcatgtgtagggtttactggccgggccagcctggtagtgaactctagttagtgtcagacattgtctcaaaaaaccaggtggatgaccctgaggaacaaaacccaaggttaatctctagcatctgcatatatttacatgtacatgtgtgtacctacatatatgcatgtacctgcacactcatgaacatttacacacttaagaacatacctgcatgttaagaacatgtacattcacaatttccggtgacttatatttatttaatcactgtacacagtaattattattatcttccctgcaatcttatacccgctcatacagaaacaatttagttgttagtttatttctgttaattttgacccaagttcactgtcacataacattcccggctgctgccatttcctgtcctttttttttaaatcagctcctgtaggagagagcagtgaagagtcaccctctccaaaggtgccaagcgccttccattgagctatgagtgtggaggcagctcttgacttgtgagtcacacatcttactcatgctctgaggccagggtccttgccaacccacacatgtcacaccttcctcacgcttacccagcctgctgaagagctctgaatggcaaggaatgcatgagcggtttgtcagtgcgctgagtgtcaaggagacactgaagagtcagacgatgacaagtcatctctcgtttgttgtatagtggatgttggatgatggcttgcctcacacaaaaggcatcggaagccttttgctttgcatgaagttttaggcacgatgtttactgtcttctctcactgaccctttggaatattttaagaaatttccagcactgcctataattcaataaaataggcctttttcttattcaccagggagcccatttttttttctgttctcatggtaattctcaaccattttaaaaccagaaataacttaactaaggtgataatttattttgttaagtaccttcttattcctagtgcaaagaatgactccattatattgggattagtgcactgtggacaggcttgtgttcttcctgttattccatgagcctaccaagtcctggtccacttacaagcatggaagccaacacagcaaaactgttcgtgattctatggtttcgagagagaaaaagtattgtttccttcctatttcaggtttccctaggttgggaattgtgtgcatgtatgtttgtatgtctctgtgttaattatttattatataaattatattaatatattacataatgtgtgtatgtgtgtttgtatgtctctgttaattatttatcatataaattatataaatatattacatgaattttaattacttaaaataatatctagtcaaacttcaggtcattgtccatttcatttcagcttcctggtagcttttttgaggttgttttaaaaacttaagagctaaattttcttctcagtttattaattgacataatcttgataaagctaccatgaacttgggcaaatgtgctcattttcttttgcacttgggtcctcttctattcataaggaaaagacagcctgactcctgggaaaggactcagaatcctctctagaactctccatttggcttgactggaatctgaggtgctcatgacttaaccaccactcccatctccgtgattcccggaagcctgttcagggacccaaaggccttgcatcacctggggcctcattaaatagcagattccctccacctaccctccacctcctgggccattctgaggtaggttctggaactttcaacaatactgaaaagagaaggaagtagagtcaaccaggtctctttcctggagggcttattgggttcctttagaagtaaggatccatgatgtcccaccatcaggactgcaccaggtaaaaccaagaagagaggtaggaagcagatggcgaccagcagcactggggtggaacaggccagcagagactgcaaaattcccagcagctcttgaggatgttttggaaaaaaatccatcatatgcaaagttgattcaaaaaatagatgaaacctttcaaatttagagtagatgacatgagggtaataagaaactccaaacttttgcacattagctacagaaagcactgggctttcgagagagctgcaaaaggcaaatgaatccctttgttcacacaacttgtgaattctgtagagctcttgcagacacactcctcctaaatggagacactgccgacactaccttacctagcaaaatacaaatcaacaggaaaagagcaagagtggccttatcattgctacctcaagtagggactttacccaaggtcaccaggcattgtaccctctgtgggttgagaagcacatcgggtgaatttatccattgtagtattggataaatactacccacctgtttctctgctgtaaaaagccactacttccttacaggcaaagttctcttttttttttttttaagattgtactttggaaatccattcaaaaaatatatatagttgaatataaacacataatcacctttttttttattctggaattctgctctctgatatcaagggtctgtctttctaaggatgtgggactatgactataatagggtgtttccttgtcactagagtgacaaaagttctctgccttccagagacatacatccaacatagcttgctccctggaaaatgattgcttaataacttgagacttgctctgtgtgtgtgtgtgtgtgtgtgtgtgtgtgtgtgtgtgtgtgtagtgtgtatgtgtatacatgcattcttgtctgtatgggtgtacatacatatgtgtgtgcatggcgaagaaagcacaccctggggtattattcctcaggaacagaacagcatccatcttttttactgagacatgatctcttactggcctggagttcactgaataggctagactggctagccatcttaccacaaggatcctcttgtctctgcttcccaggtactgagatcacaaaggcaggccactgtgctttctatatgggtactggaaatcaaacccagaccctcatgcttgcacagtgagcacgtcacacagtgggccatccccccccccccacctaggctctggagtcactttattagtttattagctttagaaggtgcacttatctccagtgagccatgtttcatactcagcttctaccacgagccactgcttgctttcttactccctgtctttcttccttacacatacattattaagaagaataggaagtcaggggagttgggtatatggctggtatgcctagctcttatataggtggtagggatttgaactcagtgtctcattcatatgcagtagctgctcatacctgctgcacaatcttctagacccattaaaagatttttcagtcagttccttttgaagtgcatttcagcaacaaggacactttcattcttgaagagcacctggcttttcgggttctcaaaacagtaagatttgtggaaggtgaattttgagatgcctggccacaggtttcactcttccgccccacataatgaaccatgaggtcctccttgaagtattcagttgttttggagattaatagcaagtagaaaattctggggagcataataacaattggaattaaattttcaagggaaaaataatagagatattggactatcaaaatgctcctggttcagaaattaaacttttgttataagcccagaagccatcatcttgattctggagctcatgttaacgatgaatgattatgcctgaacctgttaatatttaactttttaaagcattattttcctgcaagtagagattcaaaatacctttaattactgcctctggttaagccctagggcctacagtgcagaaccagccagaccatagagacaaatggtctgcattctgagagttttcaacgttacttggcttagaatttcgacagtttgtttcttatgtggtaaagcacagctaaattgcttccccccatctaggctgtacgagctttgatccttgtgttctggacttgccttgcttcgtcctcactcacatccacttctttctctgtgttttagtctaatcctacccaaccctgaccgccgcctccttgtcatttacatacagttggaatctttgtgtttgtagttagctgttcctctttatcttccattctagaagcctgtcacccctgagtggtctgtggtcaggcatgctgacttgatggcctctctgttcattctagaaccatttactctactttcaccatattgtccccttgagataagaccggaggccatagccttctgtggatcttgcaaaggtcacggcttcaggttttactaccgttcctgcagccttgaagtcaaacatgaattgcggcacgccctgccgcagctaggaccaaaagtgtgaccttggggaagttctggggctttgtctccacctcaggtcctgagacttccctcccaccctcccaccctggacatgaaagaacccacccccttttccttaaggggcatccacctccaacgcttaagttgcttaagttgcggcagtgataagacaaaggcaccaatgactttaaaacctctccacagaaaacacctttgagttttagctatacgtaccagttgttaagataaagagcctctgtgtgtatatcagctcccctgtggactaagtcacccgtttctccttgagggtgactgcaggtaagtcagaaagtctcttctacttacattgaagcattctaattattttcatctaactgtactaaattaattaataatattaataataattaataaaattaatccagtctatcgcttactgaattctttttttttgaagatttattcattattaaatctaagtacactgtggctgtcttcagacgcaccagaagagagcgtcagatctcattaaggatggttgtgagccaccatgtgattgctgagatttgaactcagcaccttcagaagagcggtcagtgctcttaaccactgagccatctctccaacccccacttactgaattcttaacccttccctgatagtctgtaaaagtgagaatgatcagaaacacccaaagcgaaacaggtgaccagttgtcaacccagctgccaccattcctgggcagcggctcctgaagcccccatattgactctttaattctcaggtttactaattctgtaaagtaaaaccgtatctctagtccaattcatgatcactgaacattcttaacttttttagacagaaacaagtacagcctggagtgctcgtttccgttatgtgtcatgcccagtttgccctttaccttcagctatatgctaactggttacatgtacacaccgatttttgttgtgtcgttaagtgaggctttgggttatgttgatcattgtttgctttgaaggcttccttcatcggtgatcttttcagcctgcccccttacttctcagccttggagaataactttacagccactgtatctgtatctctccttccatctctctcctccctccctttaccctctttcccgcatgccatacgcttttctgtattcaaaatgtgaaattgcaccacctaccttagattccttactctatccttagccttaaacatggaacatagtttataacttgatctcagtgcaaacctcagcttcgtcacgttaaattgacctgctggatcctcttgcatgtggcctaccttacagtagtcttgattaataagaaagtcatgtttgcggcatccgagtgtcttgtgggtgcatgcgttataaagaatgctaacgtggagagcagccagggataagcttggtcataaagagaacatcttaactggtcgtatgtccagaaaatacctgctccttctgtgggctccgtcaggcctgggctgcaggagttctaaagggcagagtcagcagccctgagctgttcctctgtgagcacgaagcagccctgtggaggcagaatacaagctcttcttagagtctgaactgtgcaagtgttgggtgtaaggccctctaggaaggcaggtagatgtttaaccagctactgctgacttaggtgttactgagtgctattgtccgtgctctgcttacaaaactccatgccattttggtgggctgccaccaacctcccttgattctgtatgcccttctttcataggctagaattcttgcagaacactgcagttctgttttgttttgttttgttttgttttgttgttttgtttttttgtttttcagaactgtatagatggaattagagctgaaacacctgagccagtgtcacagttgaggaaatgaatgaattaacatgtaaatgaggaaggcttcctcctgagctttaagcacagtcctggacaagaaagaaagactgggtgggtggcttttatttctccgtccatgaagacccttgtttgaacatacagaggagccacaactcagcttcacaaggtgaaggtcatgcttaggttcccagagggtctaatgttgaagaagatggagggttgtgccaccaaaccctagggtaagacatgtagcacaagaagatggttagagtatgtgttcaggacgtaggtcagagcaaggcagtgggacatgagaccaagagaatattgcatagagccaatgcttgcattgtgccagatgcagtcgatgttgaatgttcaacaaccattggctttgcttctctgctgcacatttatttttcttcagcaagtatgggatatttagatagacttctctaagagctggtacatgcgaacctttggctttttaagaatagaattggtaaggaaatgagcaaaattaaaattaaagtattgattccagaataaataagaacactaatggataatttaaaaagaataaggcctaaaatgaatggaatcttgctatatgacaaggaaagggaagagagcctgctctggtgggtatttccacatagaatgacattgaatatagcagagtctatagaaggtcttctccaagattggtcaggcaatgcctgtaatctaaattctgccttccacttgtttttataaggatgccttcacgatattgctgtgcctatctgttcacagatggccaagagatgttcttcatgataagtctcttctcctgctgactgttctctactgattctcataatatgtttgataagtcaatgtaccaaacaaattcttattgactgcaaatggtatgaggacaatgttcttttactgaggatacaaatagcaaatagattttgatgtcatgttgtggaactcagtggtaacagaggacataaatgctattcaaataatcacacaagtgagtttgtagtttcagattatctggcaggcaagtcccatagagctagtgattggaagatttgtgtgcagagcctagagctactgatgaggaacttatgtgcagagaatggagatatggtactatttatccatatgcagagtcagagaagactctcccatgttctcttgtcatgggaagagtaggtagacttcagcttaggaaagaaatataaaaagggaattttaagccaaagaaaccatgtgggcaaagtcccagtggcaagaaggaacagacacaggacagacagctatacttactatagggtggtggttctcaacctgtgggtcaaatggccccttcatagaggtcacataacagatatcctgcatatcagatatttacattaatatttatagtagtaacaaatttatagttatgaagtagctacaaaaataattggttggggattaccacatcatgaggaactatctgaaaacatcagcatcaggaaggttgaaagccactgttaccgggcaacattgacgggaagagaggcaaattagaaaagtggagaccttgaagataagatagagaaagccattggctctagagccatgtcaaacttcagcaacatatctgggctcagcagcataattaatgtttcagccgtggagagagatgtaggagagcacatgagccctgggactctaacccaccagcagagcacagggcagagaatagagctgccaacaagatgtagaacccaggagcagcatgcagagagcctgaggtgatgggaaaatgagaagagcaaatgatgtgtgagaggctgaggattagacaggaccactgagttggtccttgccgtggtctttccacacaaagcaggctgacgaaagtgcagctgcaaaatgattgaggggttaaggagaagaactggaaacaagtatgtattcattcttttcttcactcactcattcattcattcatttgttccacaaatcatcatcatatgaacattatttgtatattgggagtctaaaggtgaggaaaaccactggaaggccttgttatcctggggatctcgggtaagtcaggagatggtcatctattcaagtctccctaccaccatccaaattgctgaggggtcaataaaagctatggtaaatggcaaaaggtgtgtgggaatatataacacagatggaaagagttgagcagaagcgatcacctatggactctggagctgaaagaggcatagatattaagtatgtgaagtttgtagaaaactcctctcaagagactgagcaaagctggtgcctgtggggtcagaagatgccacactcgccaaggtggtcattaagcagcaaatccagagccttataaagcaatttaatgataaatatctttgtccccacagcagtgggaaacccggaaagacaagggcagccatagctagcaacttaatgataaatgtctttatccctacagcagtaggaaaccctggaaaggcaagggcagccatagctagacttggaggttcagtggagtatgtttgtagagagcgtggacctactgctcctttttgatgggatctgagcatgtggtcattgaaaaggcttctcatctgcttttcattatagtgtcatcggttcgatgcactcttaaaggctgttttgatagaacgaggtttcttttggaacctcctgagataaaattctcctgtgagagaattgtatcctctggatactgtgcaagttgttattgtaggagccatggctttctaggcctactagtgtcaggagaaaagggggaaaagaaaccaggaggcttctgaggggcctgattttcagtgagtttaatttttattttattttctgtatatgggtattttgcttgagtgtatagctgtacaccatttcatgcctggtgcctgtggaggccattagaggctgttacatccccagaaactgcagttagatggttgtgagttaccatgtggatgttagcaatccagcccaagtcccctggaagagcagccagtgctcttaaccgcagaacaacatctttccagccccaaggccactgactttaagtgaaatttacatctgaatgttgcctccccccagctctaccccactccctttgaaagctcttccagtaactctctctgctttctctcttttctgtccaaatttgaggactcttacttactcactcactcactcactcacgcactcactcactcactcacttacttactgggttcctcccaaggtttttgcataaaggacttgatcactgctgggttgaggcagaaagggaagtgatggattttcccagaaggtactgacaggcccgagctggggatgggggagaaattgcctcagtgtcagtggaaggctgggcctcactgctcccagacaaggctcacctatctaccctctggctgctgactcgatcgccctttctttcctttcctccccctccctctttcccctccctctcctttcctttgcattgacaataagttttctgtggaaaaattagaatgtgacaggtccctgttgctgatcttgcccatactctgtttctccccatttgtttcaagagcatctcattaattagtttttacagaaaaaaaaaaatgtgtggcacaattagtggagtttctttgccttcctcctggccctgttaactaaacacctcccacatcctgttctctgctcccaacctgattgactcatgaggtgacactggctgacttggcaagtcagtgaccttcttttggagctagagttgacagagctgataggaccagagagagtaggtgctcagtcatgtctccactgcagaggaagtctctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagagagagagagagagagagagagagaggcagagagacagagacagagagagagagagagacacacacagagagacacagaaggacaaagacagagtgtgtgtgtgagagagagagacagagaggtaggtgaaagggggagagagagaggaaggagagagagagggagagggaggaaggaagggagagaaagagagagatgaacgtgagtacaaggaccctcatgtcagaagcgttagatcccctagaactggagttacacaacatgggtgctgggaatagaacctgggtccctagaagaacagcagagactcaatctctgagccgtttctccaggcctggcataatcgctcctctgagacttgggcttttgcagtgagctcaaccagtatcctctcaaccataaaagaattattgattgcagtgataggaatcaatttagtttttgaaaagcctgcaatattcgaagaccttagttctgcattacaatctgcagcacttatctttgttgagagtagtttaaaatgtgaatcttgtattgttactaatgcaaatgttttaggtcttatttccccctgctcctttatgacaaggactcctgtaggctgggctcttgggcttggtcttgttatgtaggtggtagctgaaaatgcctgtgatttctgatctaccagcctttgcttcccaggggctgagatcataagcaccaccacacccagcagaatataatttcttttttaatgtgaagtttttactatttctgtccttccaaggattccataagtttcatagatttggcacagtctttttcaattatgatggaagccttggtgccgtaacgttctgacctgcctttcgcccatgatccgttcccctctcagccccacagtttagctttctttaagactgtctctgtcagaatgcatttaaaaggagtagagttggcaccagtgagcttggtctgtctactttttttcctccccgtggcttatcatctcatttcatgtttgagacaggatagctaactggtcccaacctcacagtaactccatatttttatgtacattataaacaggctaagacaccaactaatgcagtagaattctgagcactggcatttaaaatagccttgcctgtatgattcagaaatccataagaaaacttggccaatactttaaacatcttctagacatgttaaatgctgactgcaccctcccctccctgacttctccctgtgtaggtgatagctgactcttttagtccacaatacgggtaccatgcaagtggaagtagcccctactgggaattgtcctcaattttgcatacccgagtgagagtgagagtacaaagggagaaagagccctgtccagtcaggcaaggtggtagcataggccatagtgatgtaattcattcgatacatgtctgatggacattagaaagtaaaatgagtatggcgcccagcaggaaaagctggaccttacttctacactatgtcccccatgttgtttctctccttcacctcttctttttctcccctcccctcccctcccctcccctccccttagtgtgtgtgtgtgtgtgtgtgtgtgtgtgtgtgtgtgtgtgtaatcttttgtcagcctctcaggcccactcaggttttccatttatataaacccacaaggccacagcagccagccccatacttagttagagtcagtgcagtttgagcttcttgagagcacaggctgtgtgtgtttggtacccgactgtatctctagaacctccaggaaaacaagaaacttcctgtgagctcagaaaaatcctccctgaagttgaatccatccctcattcttcaccccttggttttctcatgtgaggaaggacctggctgtcctggctgtgtggatgatcgatgtcttcctcctcagcaagggttacactggtggctcataggttactgggatctaaaatagacccctttgaaaaccagcctgcggctattttttgactatatgtatacaatgctcttttgatcatcagacaaaaatactacttttaattactgtgcagttggtagttacacccctagactgtggaatgctgtcatggttctgtgcacattcaggactttgtgtctgactgggttttattaactcttgtcattgacagtttaagctatttactcgaaattgcctctgaaccatttcaatgcatactttgtttttagagaaaatgtgaaaacaccctcaaatgggttcaaatttgaaaatcaaaataagttacattgctttattttattttactgtttttacaaaaaaaaaaccaacagtgctattttctatcatatttcattgtttctagctttatttgtagcaactttaaactgtggattcagccatctaagaatgtaagaactatagtttccttcttagagtttcagcttcagttgctgtgaggccatggggtgaaaattcggtatgtggctcaggagcaggttttctctagtctgtgggttgagtttgtatctgaggatggtgatttccatgctaactaatatctggggtgctcagctcttaaatataagctagctaggaccagatctggaacttgagagtggcttactctctggagctttacaaaaattccagataggtcatactacagaactcccattttagaatattgaatggaggagttcagggacatcatgtgagttttctattggattattgttgttcctctatgctgggccagccatcttgccaatggatggtcatgatggaaaacaggtaagagtatggactgggagatcttggtctactcgactatactccattcatctcaactaccactaagacgagacaagataaaacaagacaagaccagaccaaacccagccgacttttaaggatggaaagtgaactttctgggaaagcatgaggacttaagctcagatcccaacagtgctatagaaaacctagcgagcgagcattcccagacacatacagagcaaatacacctccacccaggtcatagatgaggaaacaacaagagtcatctcgaagggtagtcgcactactaggaccaggtagcagtcttgtcattgggtgtttcttttttcacctggcctcatctgaccttttcaaaatgagtaagagacagaagaggggctgtttggttgctaactaattgctagtcagtcgtctctcccagtatctgttatggctgtaatcagaaacacacttcctctctgttaggtatgggtggccttgtgctacacccaggtttggcaagtatttagacagcttggaagcaagcggcacagggataagatggctggggtccctactgtgctgttcccaggtgctgagtgatcttagaaacaaaatggcctaactggtaagagcccttgctttcctacctgtcctacctggggaaagcagtgtttctgagccggggcggctggagggtgctgtgatacaatgtccatgtatggatgaataaagtcatcacatagcagatgtcactgtcattatcctcattcatatgagtaccaacttgcaatgacactggaggaataacctgctgtgttcagactgaagccatgttgtttgtcacttttcatgaatttctgttcctgtttagagtatctgagaacttactatattatcatgagaggtccaggcatagggggtatagctgtatgcaagagacaaagcataaatgttgaatttagaattaatatctcactgctttttaatttttttaggtttttaaatattttattttaaattttaattatgcctctgagtatgtgcctgtctggctgagcctgtgcacgtgtgtgtgcatgtgtgtctgtctgtttgcacttgagtgcaggtgcctgtagaagccagaggtgttagatcctgtgcagctggagtcctaggcagttgtgagatgccagacatgggtactgggaacctaaccgaggttatagaagaacacaaatgctcttaaccactaagccatctcttaactcttccttgccgttgcattgacccacatttaactacaccaaagctgaactgacagaggtgatcatttttaggttttgcttatttgcctgtccaccaccaaccaccctgaagtcaacctcagaaatgctgtgtgctccatgtgtctgtccttacttaactattttttgtttttcaatttagaagccatctctctagtctcctacttggtcaaatcttattttaccaatgaggcccaggccaactactgcttctctgtgaggcttgccttgtttacttcttcttctcactctcccctttcatagaatagtagtgcttatatgactatggtctttgactcttggttttactgagatcaaattcatcatggaaacaagttaagaggagatgcatttgactcagtgtttcatgggctactccatcccttagggtaggccaggcatggtggcaggaatggacaagtctattgcagcaggaatgtgtgaatcaggaagcagtaagacaactgaagtatactagaattgacctcaagtccttccatgttcctaagctggaccctacttggccaaaagcctaaaacctccccaaacagtgccactagttcaggtgtccaaatgtttaaacacaagaagggaaagttgaaaccatatcactgtcactagccattcacactttatacattggctgcttctgtccttacagacagcaagaggcatgagaggatagtctatatccatattgtctctgctccttcttaggatgcccctagttccttttatatagtcagggcagcactgttgagacagacatacatacaggcaggtaggcaggtaggtaggcaggcagagagttattttctaagagttattttcctcttttgtcccctttaaaaggagagtgaaacatgtttacttcatgagtatacctgttcatgactcaatacagatgaatggaaatgctagcacatttctgataatcacagttattattgttttcaaatgtcgaaagtgtgaaataatcatgatgaccaaggtgcctctttcttgcccatgtttccctcccagctcaacttttctcacttgtctgtagataactcctatttgacttatttcactgtagattagtttatatatactttagagaggagggtcctagaatccctcacttagttccattaacttgagattcaggtatgtaatggtacatagtaatgtcttaatcccttgtattattaaattctatatagaggtaccccgacattggttgtccattccctcttatggatactgggccctgcttctagttctggaagatgataaattaagctttggtcaacagatacttgtgagacatctttcatttctcttggtaaacacctgggagtggagtagtccagaagtataactgaaatgtgcttaacgtttgaaggaagaaccccacttcattttatattatcagcagtcatacacaagattgtatacagcactcattttctttacatctgatagtcttgctgaactcagccatgtccatcatctgaaaggtttgtatattattggtgggtgtggactctaatttcactgggattgtacttagcatctctctctttttttaatatttttattaggtattttcctcatttacatttccaatgctatcccaataccctcccccataccctccccaccaaacccctacccacccactcccactatttggccctgacattcccctgtactggggcatataaagtttgcaagtccaatgggcctctctttccagtgatggccgactaggctatcttttgatacatatgcagctagagtcaagagctcaggggtactggttagttcataatgttgttctacctatagggttgcagatccctttagctccttgggtactttctctagctcctccattgggggccctgtgatccatccaatagctgactgtgagcatccaattctgtgtttgctaggccccggcagtctcacaagagacagttatatctgggtcctttcagcaaaatcttgctagtgtgtgcaatggtgtcagcgtttggaagctgattatgggatggatctccagatatggcagtctctagatggtccatcctttcgtcacagctccaaactttgtaactccttcccatgggtgttttgttcccaattctaagaaggggcaaagtgtccacactttggtcttcgttcttcttgagattcatgcgtttagcaaattgtatcttacatcttgggtatcctaagtttctgggctaatatccacttatcagtgagtacatattgtgtgagttcctttgtgattgggttgcctcactcaggatgatgccctccaggtccatccatttgcctaggaatttcataaattcattctttttaatagctgagtagaactccattgtgtaaatgtacaacattttctgtatccattcctctgttgaggggcatctgggttctttccagcttttggctattataaataaggctgctatgaacatagtggagcatgtgtccttcttactggttgggacctcttctggatatatgcccaggagaggtattgcgggatcctccagtagtactatgtccaattttctgaggaaccaccagactgatttccagagtggttgtacgagcttgcaatcccaccaacaatggtggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaggtgcttctctgccattcggtattcctggtaatgaccttctcaagcacctacttgctctctgcaagtcttcttctaatgaagtatttgtaaataatgtgctcatttttaaagtgggctgttggatacagttccttgccttggctctgtcaagagcatgccatatgttttagctgagtttcatctttaatcatgtatttggaaaaacaagagttgtcaacaaggatagaacccaatttgttgatgagttccaccattaattttagttttggtgctgtgtaaaccccttccttaactcaagttcatgaggatcttctttgttttcttgtagaaactgaatagttttaggtttcttgagtcaatgtgagttaatttgcacatgttgtatgatggacataaaaaagttccttgtttgtggatctagtattattctaacatcggtttccagagacccttccttctccatggcgtttcccttgaactttgttgagaatcagtgcagccaggaagtccattagccacagactttgcacttttttgatactttcttctatatgatctcattgcaaattgctgatgaaaaatctggtattatgtagagattggacttagtgaatcaaagttgttgaagtttcagttttgagcacttaagtttaggtagacaatctgctttaatgagcttggaccaaagtggctatcttttcaaaaggtggctttgttagggagaaggctcagtcaataaaacgttgctctgtatgaataaggatctgggctgggttccctagcatcaccaaaaaagttggctatggcagctcttgcctctggtcccagagctggggagggggaaagctggaacttgttggcttgccagcctaacactcttgtcagttccaggccaagtgagagatcttgtctcaagaaacaaggcagaaagcaactgggaaagacactagatattgacttctggtccactcatgcatgtgaaaacacacacacacacaccacgcggatttttcttcagtgtcatttatctactgatctttctaactctgaggataacttaccagaaacagtccttgatcatgagaataagcagatttctgtgaatagggtatgatgtttccagccaggtgtggtggcacataactttaatctcagctctcaggaggcagagacagagaagaggcagagaggcagagaggcagagaggcagagaggcagagagacagaggcaggcagatctcagtgattttgagggcaaccttgtctgaatagtgacttctaggtcatacagtgccttatctcaaaacaacaaacaaaataaacaatgatgaccaaaccaaacctaaccaagccaaacaaaaccatcccgtatttctgtaaggcttaatgggagtttttcactacagacagacagaggtttagtagcagtaaacatgagttctgagatgaggaaccaatagttttcgtcttattttgatggtgttatcttaggagctgatgaaacaaaacaaacctccccaccctttcccttctaaagtcctttttttaggccatttcttgatatttgcccacactttttgccttttggtcttgctgtctaatctagggtgaatagagatgaaaaaataatagaaatggtctcagcgtgtttgggtctgtcatcccaacagctttgagatcatgaccagattttataccaggtcacacagcgagaaaaaaatcccaaatgaactctgaatccctgggcacaggaagggcttcttgtttccacagcagttacaaatgaccaagataccccacttcctcctttccctgatgaaactggaaatacaaaaaacaatctttcatatcacccctgcccttgtctgaagttttcaacgtagtaatttcttttccaccatcttttccctgatttattttaaaaagtttctttttaattagtataatgaagtcatcactctcttaatgagtcctattaaggtaacagtaccagggccaagagaatggattggtggataaggcagttcttgccaaagcatgagaagtaaagtttgagtccccagaacccatggtaaaacctggcaggtgtattgtctgccatgatactaacactcttgggacagagacaggaaaatccctggggcaacctgattagctagactagtcagcaatattgagttcctggttcagaaacagatcctacctcaataaaggaagtgtaaagccaccaagaaaggcatctagctttcatgtgcatgtatacacatgaaatatccactgatgtgtatgcctatatacatgcaaacatgcatgcacgttccataagtatgtaaatatgcaatcaaacaaaatacaaaataacataatgtgaaataagcaatgtaagttctttcctttaattcaccacattgatagctgtatttgtggttcacttattacactgcagcttacattgatgtgggaaaacaaactgtggcttgtcatgtggttggtggtgtaatttcctgggaatctggcaaaatgacttcagtggattttacatctttttatctggtaattgcacttaggatttatttttctccttggggacaaggagtaggcaataatcagagagtcacataagttcttaagatttgtatcacagttagttcctttgtacaaacagttctgctttaaattgagataacgtccttgataaagcttgtttaatacgaaataaggccttagggaaatatgtctttgagtctgatggcagtaggacatggggaatcttctttaccagttctgttcagtttttaactgatctctgggaggtcatgttaaaaatattgacttaaacaataagcaggctatagaaaaacagtatagctagcacgaatggcagataggagattagaacccctgtgtagcaataagaaagccatggaatgtatttaggtgtgtgtgtgtatgtatgtatgtgtgtgtgtgtgtgtgtgtgtgtgtgtgtgtgtgtgtgtgtataatatagatgctcagctttgccacttgttacaaaaaaagaacaaaaaacaaaagcaaaacctcagtctcattagaaattaggaaatcttgcatttaagctatagccagatactgtgcagtctggcagaacttagaatgtgtgatacatatttggtgagaactgggacatcagaacatacctctcagatactgcctgaaggatcttcattgaaaagcccctcaggggaccatttggcaacatttaacaaagctttctgcgtagcatcccaggagctggcaattccacttcagagtcaggacactaaggccactctgaaggagacacgcaggaatagtcaccccagcatcacaaccgaagtttacaaccaacgcccgttaccttcagcatccactaggaaggcacaactttcatggaacagagagaaactaaatgaactgcacagggaccatagtggacaaacgcttgctgatgttcagtggcagcatgttggttcaagcattcccatggtcaatacttacattgtgttaacggaaaagcacataaaacagcaggcgtgtcacagaatgagaattctaagtgcatacacccttggggcagatggttgcaaagcaaattctagatgagagttacttaggagaggggcagatcggtacttgagggaacatggtattcttgtttcctctaatctttactataaagcaaacatggaaagatttaaactttttcacctcaagggacagtaagttattatttttgtgtaccaattctaaagttaaaaaaaaaaaagttgagccggtcagtggtggcgcatgccttaaatcccagcacttgggaggcagaggcaggcagatttctgagttcaaggccagcctggtgtacagcgtgagttccaggtcagccagggctacacagagaaaccctgtctcgaaaaaaaaaaaaaaatcaaacaaacaaacaaaaaaaaaaaaagttgaaagtcctttaaagaaaacagtaacaagttccaccaccaacccagacactggaagaatgttgtcaggagctcactgtctggttgcttcatatacttccttctgtctcttctgagacagctttgacttctctctcactcttttcccttaccctatgttattgtttacatatttgtgtgtgacatattttatgtgtacatgtttgtgtgcatgtctgccagaggtcaatatttgtcttcatcgtctgtctgcaccttatttttaagaaaggtgctctcattgaaccataatcttaccaattnnnnnnnnnnnnnnnnnnnncattagccttacaggtgtacactggcatttaatggggatgctggagaccagggcttaagcctccatctctgtattttaccaactgagctgtcttctccactcctgagatttttttttccatttaaattgttagaaagtggcataaacttatagcatcagattgtgaaaatgtgactcagaggggcagttgtctcttctgtgggtgacagtgtaagtagaatagtctttgtgaatatttgaggccagaagacaacttgtgggaggcccttctcttccttctaccttgtgggtcttggggattgaactctagtcactaggcttggtggcaagtgtctttgcctgctgtgtcatctcacagacccaaacattaaaataatcagtactactatatatatattggatggcagcttttaaaaagagagatattcataggattgtttgtgtcattacttaccaataatctgaaagaaagtctacattatgtgactggaaactttctttaaatgtttgtatgtcccatatgttgttatattttatctaattatatttccattagccttgaaataagtgctgaaaatatatacaaactctaaagtcacaagagtaaaagaagggggccattttctttgcatgcatcagcatttgccttgtttgtagatgttttacaaaataagctttcaacattgtttctgaatacttaccaatactcaaatgacattttctgtctaaatcaatgaaggaagcatgtcatgtattgcattttatagcttatgccacaatttcctccaggagacaaatttttccttgatagctcacatctgcaattgtaagtcttggcaactgtcgaggcgcagctaaggcagtggagcagtgatgatgatatgtagttgaggtggcatgaaggtgactcagccctcagccctcgagatgctctgtcatcaggtgtagtgattgacggcatcccatgtgtgaccgtgccatcggctgcctttggctataggtaatagtacagtccattgaatagagtggagagccactgttccatagagccaccatgtataaactaagccagtggttttacatagccccaacaaatgtgttaatagcataataaaacagcccccccccccgaatcattgcatggggtgtctactcaacctgtccatattcaggacaacaggaagctataacagctttagggtagagatctgatgctgagttttactaactgtgacttgggggattgcagcactttaaacaagaaggggaattctttctctttttgaaatgagaccaacatgaatattctcgataaaagtttttatagccttcctcatgttcatcatggctaccctcctctcccaaccatttactagaacgacaggtatacagatattgactttccatctacatgtgcacatctgtggaatcttgctgttagaattaaaagacaatctccaaaaattgtgcaatggtctcatcggcataaataatgaatgtttcatgagggtttagttcattggtctgctcagtgaaaattctccacagatgaacttgatactcactgtgtccatattatgtgtctttgtacagactctaactttggactacgttgcccacttaggcagaaggactactgatgctttcctactgtgctggagtgttgggccagtagcatcattgtgcaatgtcagtgaacactggactcaatgtgagagctgcctggttgggagagcccaagctcaactctcttttcagcccaagaccttgttttttcttgactttcccctttagacactaagatcagttctactctaagaagatgacccaggggaatgaatgggaggggcttatgctgaaaatccaaagtcaactcaggacacttacaaacccagcctttgagtaggtattcctggaacatgagctgtgagcagcagaccatgccagtcatgggaagtgccactggctgctgaagctgaggacatatgccccttcacatcacagtggactctgctctgtagttagcatctgtgcaatatatagatataatcaaacatggccgaccatagtttatacccaaattatgcaaagatacttctggccttcataacttaaatttttagaatcttatttcatttgtttccattgtgaaggaatataagagacacaatttatttgaggtcttccagaagtgaagaattcatttctacactagtgtgtataggatagtccatttaaactcaagaagcatacattattataaggtgtaataaaaataacaatcataccatttggttcttgttccatatcttagtacatgaaaatgaattactactactggtcttttctattagatatattgagaaagctatttttatatttatgtatttagatacataaaaccctctatttgcacatatgtatttaaatatgcacatttatagaacacatactaaggacataaggatgtatgagtttatagaatcaaccacaaccctacagcagattttttgatagctagcaatgataagcaactgtagttattttgaagaaaataactctgttactctgtgggaccaagaatgttgtcttgcctggcctcactagttcctgcatcttacagtctagcgtaggggctcagtgtgagcctttggttggtagaacctgagtcctgtgatattccctagttataagggaggctggtaaagaaacatgttttaccacttctgtaagtggaggtgtgttctacagccaaaaagaaaaattatcaaattgtgattccaatatttagatcagaaagttagtaagttagggatgaaaataacattattttatcctgatggaaaactattttaaggtagaaaataatagtctttttctagtttgtacattgatgtattgtgttcttggacagtttcatatatgtacccaatgaactttaatcatgcctgttatcctctctcacccactccttcatccactaagacacgtctccttcccagcaagttccctatcacttccacatcttataaaccctctagtttagttaggtttgctcctgtggacctgggtgagaggctgcttaacagagcaagggcaacttatcaacttagaccactaaagaaagtgaaagaccccctttctccatcaaccagcaactgccagtatttgcttatggagagttggaatctgtaaagcccctttctcacccatgaagggattgtgttgggcctgctatcaggtaggttttatgtaggtaatgaggtcaggagtgcaatgatgccagtcatgtccagaagtctctttgcgtcaacccccatatcttccagctcctcatctttttagtttctctgacattcccaatcaccctgccttcactttgtttcagcagtttggccactttgagcctctttgtagcctgctgccataagatgcttgcttcatagatcaagactgatatagcactcatctatggataatggtgtgagaaggcacctggccacatccagttagtgaatagtagtaggtaggtaggtttaccctctaggcctatggcctccttagcctagggctgttgaccaggtcacaccagagtgccatgctggctggcttcctcaattggcctccacctagttttctgaggcagaatctttcagtgaatgtggagcttgccattttggctagactggctacacaatgttccctggggatctacttagtcctccaaaaagcacagcagtaacaaatgtcatatctgggtgtgctcttagagatgtcctgactgttattctctctgtgggtcatttcagagcctggcttagcatttttatataaaattgctatctatcatttatcatctatctatctatctatctatctatctatctatccatctatctatctatctatctatctatctatcatctgtcagtctttctatcatctttcttcattccttccatccatctctttcttctctctcatctctctctctctctccctccctccctcccttccttctttcctagttttatcctcccctccccctcctacacccccacccacatacacatnnnnnnnnnnnnnnnnnnnncacatacacatacacttcctgttactgtacaggacttgttgataggaaatcttgaggttacagtctcttgttcatagagataacatctccactcaagaagacaaaaagtctctctctctctctctctctctctctctctctctctctctctctctctttgcctgtcaagatgagggatgagatagcccttggctacctcatgcttagatccaggaagaagctgtatcagttggccctgcagtgtctgtgacttccctgtgcattttctggaatcttcttctaagaagagtgaggaagtgaagaggcagtctgtgtgccaggatcagattctacaccagggtgttactgacaatggggacagagaattctgctgccagaggctgtcttctcactgtgggacatctggcatcacccctgtactctcccactagatgccagtagcaacccatccatccccacccagttttgacaaccagatatatctttaatcagcacccagtgttctttctttggagggcaaaattgctggaagctaaggccactgtcttaaatatataattctgtgtgggttagcctcttccaaaccctggacctagtgcttcaattgtcagtcccttggggactgaatgacacacttattttctttcacataacagtctctgtgtgtctgctacacatgatatataatatcattgggaaactactaaaacactgagacctctcttcctcttcctctcttcccctctctgcctttctcctccttccctctctcccttggccctccctccctccctccttcatttcctgtgtgtgtgtctgtgtgtgtatgtatgtgtatgtgtgtgtgtgagagtatctttgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagccccgagctgctgttattacgactcggctcctctttgccagtttttagctcatgtggacttgaccttcaaaccactagcattcagctctcatgtctgaggggggcttgctgactgaccttttacttaggcccaaggcaatgttttcctctgtgacaaacttgcccactgccagtttttgaagagctctagtccttatgtggcagagcttgctgcctggttataatcggtcctaatacccgataaactgtgaacaatggcctcgtttgagaggaaatattaagacaaaaagacgtctaccatgctgaggccgtgctaaactggagcacacagagaagttggggcacgtgggatgctgccccagctactcccataaagagggggaggctcgccagccctcacaatggaccattataagggcaccattgaaaccacgtaatcacagcccttttcaaaaccagaaaaatgtgtcaagtattagacaaacgtaaactgtgcttgaatgtgagactagaaatttcataaatagcagagtccgtttaatctgatcaaatatttcaagagaaaaaaaagaagaaaacaaggcagtttttatgctgaacaacagtttcctggcttggtttatcatttgtaaaagtttcaaaagaaaagcgttttgcctgaatatgctttttatgtatttgaatatgcttttatttttgtggggtttgtagtttttttaaaaaaaaacaaaattagtactttatatattacagaaagtaataaatacaaataaaacattacttatttataattgcaacacccagaggcagacattgtaaagctttcccagtgatttgtaaatagattttattttgcccatgcatgtgtatttgcccatgcatgtgtatttgcccatgcgtgtgtatttgcccatgcatgtgtatttgcccatgcatgtgtatttgcccatgcgtgtgtatttgcccatgcatgtgtatttgcccatgcatgtgtagaaacgtgttgaagttgatgctctgttcttgcttaggttaaaaacttccccgctgccgggcgtggtggcacacgcctttaatcccagcacttgggaggcagaggcaggtgaatttctcagtttaaggccagcctggtctacagagtgagttctaggacagccaggactatacagagaaaccctgtcttgaaaaaaaaaaaaaaaaaacaaaaacaaaaacaaaaaaaccccaaaaaaccaaaaaaccaaaacaccttccccacctccttccataggtctatacaatatggaccttgaggactacgtagtgcccacctctgtgccctggttctttatggggacagctgtattccttccctgggaggcttctgacaattcctggagacatcactggttatgccagttgggttggggttaggggatgagtctcctggcatgtaacatggagatgccagagatgccgctaaatgcctaacaatatacagagaagcctccacagagaagagtctgacccattacagcagtatccaagttcatgcctcaactaggcactgcctcattattaatctaacccatgtctcttgttagatagctatgagcaaacaactgttttgttttcagaaattaatcattatcaagtattttccagaggacaatatgataattgtgacagcttctgggggggggtactaggtacattacttaactctgttgtcacaaatagtgatagatgttatgttaatgagtagatggtacttaatagggtggctacacactatagttcatgtatatgggtgtgtgtatgtgtgtatgtgtgtgtgtgtgtgtgtgtgtgtgtgtgtgtgtgtgtgtgtgagtgtgagtgatacagtttttgctctaatgggagtattaaaattactgttctttgagcaaagtaatggctgggtagacaaatgtatgtgtgttagccacatttatcatctttgtgacaaaatctaaatcaacttaagaggaaaaagtttgatttgggtgcacatttcttggagagagggatacatggcagcccggatagcttcttgcagaacagccttgttacatcatggcctaccacagagtctactgttgcagtaaggctggactctaaccatcaaggcccgcgctgcactgacccacttccttcagctgccctggccctcgaagttccacaacctcccaccatggcatcatcatttggggactgagttttcaaatccatgagactgtggggacatttcccatgtaattctgtgctttagtgtccgtttatcttcctttccgttgggaagttccacccatttggttggtcagatgagattggtaatttgatgtgcattgaatatgtactgtacaaggtcaaagccagaagcaaggaggagagccaagagataccttctgtcatctggagacagatggaggtggtagtcccactagagggtaaaacttggttaaattctgagtatatcctcaagatggtcaatgactgctgatgggctgtacagatgatacttgggaaagaaagatgtcaaaggtcatcaagttggttggactatgcagacctctgacctataaaaaacagcagtgtccataaaaccttaatggtacatgcctgtctataactccaactgctcagaaagctgaggcaggaggattaacaggctatggggagtaagttccaagccagcctaagtagcttactgagattttttttaaaaacaaaaccagaaaaaggggctctggtattactcaataatgtttctctagcatgagtaagggcctaggttcagccctagtacaaaacataccacccccacccccaaccccacaacccctgacccctaccaccaccaccactaccagtagcagcagcagcagcagcagcagcagcagcagcaggtttcatgtgtttcagccttcccactattgaaatagggcagctgacttgaagggcatgttaattgtgagctgtttgctgtgtagacagcggtatagacaggtagagatgagtctagaattcagagaagtctatgacaggccctttctagtcacaagactggcttgcttcaccagagctgagagtgtagagagttgaaatcaagcttgagccttcatggataagatgggaagaaggaggaactaacaaaacaggctcagaagtcacgatggaagagagaaggcacatggattgtgaccaagtgggtaccgcataaagtatgcggacttcttgctgtggctgcatcacatgaggcatgtttgcgcctgaggattctgtccttgcctgggtggctcctcctgctgataggccaatcgttaccaacttcagacctccacttaaacaccacagcttctctgtgtccttttcttaaacttctgaaagttccgtttcctgcttcttagctggggcaaaagcaagttatttgttaaatgaatagagaatataaaactttctgacagaagcaggtgttcagatgaaaaccttgaagtttatgaagaggatatattgttttcctcacatgaactgcatgtgcatctgttggaacaatacaatctgttgtactgttagtaatacagatgtttagacatattctgcccaacacccgtggatgcacactctgcatttaagagcatccctcaatggtttgctcatgtgcagcctagtgcatctgcatatttagtaatccaggagtgacagggggacaaatgaatatctcttgatggcaacaactgaaaccaaggtgctaaaactgccaaaatcagatctctttagttgtttggatattcattcagaagttgtttttatgttaacagcagcaaaagactcaacccggtgttgctgaggagtttccctgacagtcatctctttaggggagaccgggatcttggctttatccccgaaaatgaatttcagaatgagttactatgaagcaaagttggggtttgcaaagaggtagcatatgctgtagattttaatgcacatgtgtggggttctagtgtgtcttaatagttatttatatggttttttcttagctgtcaaaattacattgttcaaagggtataattttcaaacagagtcaatgactatgcagactttttaaattgaagtttaaaacatgagccctgttacgtgtttctcttaaagtatctctccttccacgtgctgtatgaactataaagctttagggatgagagagcagcgctgatacagacaaactcagaagtcacgtatggctttgtcctcaggcgtggctcttagctgttctctcctgctggagagctctctcagacgaggagcgttgtctccgcaggcaggcttctcagcagctctgatgttatcagtccgactgaagctctttctccctgtttatcttcttaattcttaagagtttcatacagagaaaccctgtctcaaaaaacaaaagcaaacaaacaaagaagtttcatacaatgtatgaacaatgtttcatatccccaactcctctcaggcatacctccaccttccctaatacccaactttatgcccatttttattttcttattaagctcattaagtcgaatttgtggtgcccttactcatggatatgtagccttccagagcttaacttcttaattcagctagtgagaaacacgagccgaatgcaccccagactggaagacttctttctctttgtacacccctttatctttatagactttctgtctgtttcagtcagttacaagacaggagcatacgtagaaactttgaaggctattttatagcattactcaagtggcttcatttggaaatatgatttgatttgacccactctaagactgattataaaatgtactgttgggcacacgacagacatttgtgaattgaatgcacacaagttctgttctctatattttctaaaatctcttggtatttaataatatgttcatatgaaacaactgaagcactgaataaatatagtaaaattttaatataataatactgtaaaaattgtaatctttactttcagtttatatgtaacagtgtttttaccagtgtgcatcatatgcatacagtgcttgggacggccagaagagggcgttgacccctgggactggaggtacaaaaagttgtggattctcagaattgaacccaggtcctctgaaagaacagctagtactcttaactgccgaactatctctccagtcccccaaacacatttttgtgaggtctctaaatatcatgtatcctaaaaccaaagcatacatccctcttacttcataaacaggcacattttaaaatagtttattatctaaggaaaacaaacttactaggaatttttcatagagctggtctggattctttagtataacattaggaacaaaacgttcttcattctttgtatatttactggtaccacactgctctgcctccagaagcgtagagagtagcagaaaaggaggccatgtgtaactacccagaccagtgaatcagcatgcaagtccatgtctgtataaacacgtgaagaaggcttgtgttcatattgcttgactgaaagcagttggtctttccttctttattcatatattttatatatgtatatataattcaaattgaaatgtgtctctccagtaggccactctggcgagagagtgaaaccaggtcccagcttgtaaccctggcaagtgtttgagtttctgatcctttatacgggtaattaagtatcccctgtattctttcacgggcacttatccagttaagacaatatttagaacacattaacaaactgaatacacacacatacacacacatacacaacttgagtaatataagagtgctaactagcttccttggtcttaccatttttcagagattactattgcatattgatttctctataaattgtcatttaaaaggcaataggagaagagtgttacatgacattagtgaacagcggctgatttagcttcctaaaatttatcggaccatttatttaaatgtgtatattgcacacacatatactatatttgtgtgtatattcttttcctttataaagttcctccttttccttccttacagtcttgctaaaatgtctatgcaatcagaaatctttattctagtaccttctataaaagtataaatagttcagatattggcaccctgtgggttcctcagacccattcttcccttgtattgtggttaatactcagctctgcagggtcagcaggaaacaaactgtggacactatgcaaactagcgtcaggagtgtgttctagtaaaactttacttgaatttcatactagcatcagctgtcatgaaacactatcattcctcttttgttttctcaatacttcaaaatacaaaatccatcttcaatgggaaggtttgggggcaaacccctatcatggagaaaggccccgggcttggtcaacttggtccttcgtagtctttctttattcaagtactctttatttttgtttgcagccagcttccactcttctcctttataccaggatttgtctccatgtccacttgttttttctttctttcttttttgtcaaggatactttggtatggatcatgtagaaaacaaggttatctatagcagacctagagctctgggctcatggtttctcttgtaacatcaggaatgtgcctagaaaagatgttcagattccgggatgcctctctctcaggctttccccaggtcacttgagaaagctaactttcacctttacaattgcacattgtccacccctggaaacttccgtgtaaaaagcagtgtgcacagaatgatcttagagtgtgtaatgaagaattctctcccaaaacacaagttaacaaaaccttaatgtttgttgttgcctttttgaacaacaacaacaagtcaattataaactgacaggcttgtgggaattcttcgtggttttgttcaaattcacagtagcaaatggtggggggtagaagaggagccatgtctgttcaaatgagctgtatgtacagtagtgagcctgggagtcagagagcatgatggtatctgtggccaccatcttacactgactggagatgggccacagagggaactaggctgtcagtgtcaccagggagtggcagagctgccctgtggtagtcaggaaggcatctagtccatctctgcaatcagtttgtgatcgtaataaagaaggcaggagcatgggagaggaaccagaacaagtgcgcgtgagacccccatggactttgatgtggacggctaatgtgagatacaaacgatgtcagtaaatacagtaccgtggtaaatgtgtagaatattgtcgccttgtcttgtgatttgtactgcaaatgctcacacacactcaatttttggacaaccttttatttatctgggcttttcctttagagccctataagggtgggtgtgggagtgagaacagagtagcatctttctccagcatcttcaggatgagaagagcaggccattcagggttagacctgttcacagtggcatgcaatccagccatgatggtgctaccatgctctacatcagtggttcagagtgtggtcacaagactcaaggaccctcaaagtatatacaagttgaaaactaactctatactaatactaagatactctctctccccaccccactcacacatacacacacacacacacacacacacagacgcgttcgacatcttagaaagtcatcattgctatgttagcatgcattcttctcttttctaagcgtcccattatcatgctatgctggtgaatattgatagaattcacccgaacagcaatttggaagaacttaaaaggctcctatgacaaaactttgtggcctgccctttctgatatttgatgggcctcatctgacactgaaaacaggctgtctcactctctgatcatccacattggtgcatgaggactcaaggcctggagaagtagtgacttagtcatttttactgtctgagtctgaacatgggtgttgagtccttagctccttttctgaccgtatgatccgacacccaacgatccgggaactggaaacagtgagctctgagcactgtcttcccagaaacagcaactcctctcagcccagcccaactttcaggagtgtcagtaagatcgtgtccacagacactgaggcagaaagcatacgctggcgctttgcttcctgattccacttccagtgtgtctgccttgtcttatactacgtgaaaaaccgaacattggatttttttttttaattaaaagatttcacttaaaaattgcacattgtcagctacttttgaaaatctgggcaactaagctgtatatacactggtgtgcccatagagcgagcaagtcagccgcagtctgaattcgatgctcagctgcagtctgaattcgatgctccttttaggagaaatgagtggcctccagtggcctcagttctcccctctccttatcacctcattcactgctatgcccctcagtcatgttacctgtgtatggttaatgctctgtccccagtgtagcattttcaggctctctccccatctccctcagcctctcctgtatgtgcataaggaggccagaggtcaacctcagggtcttcctcagttcctgtccactgtttttgtttgggacagtcactctcactgaagcaggccctccctgatatcaatggtgtggctggcccatgagtccagcacctgtctgcctccatgaccagtgctgttgggattacaagtggtggcctgcttttgacgatgtgtctcctggagatgggaccctgctcctcgggcttgtgagagacgcattactcaactgagtaccccccccccccccaggccagaaatgttgcaaagaaaatttccctctacttccaaacttgagtgtagtaaagacctccgtgtcagagctggggagagagcgagtcccttccttactgaagcatggcatcctgattcattaaaaaaggggggctctgccagtgaattagtgtttatttttaaacatgcagccgtgtctcttttaaggggagtagtgaaataagcacattctgctcctgccctcatttcgtgtttattttggtcctgtctattgtcccatcattatcgcgtctggacccttttacaaaactgaaaatgcctgcgaacctcaccgtgcgtgtcaggccagacaggtttgcggtggtcagccggaagtacttcagtggccacaggattttgacagaattaatgagttgcaaatatttgtgcttaaaatagtatcatcccatttcaacagtaagcagcatttatcctaatttctaaatatagacttgtctcttttctacctttacttcaccctgggcggcaaattgttttataaagctagaaattgtacctatattctgactgcttatggcaaacggactatgatatacatgcttagcatgaaataacagtaaacagtgggatggacagatggaaagggacatgcatgcgtcaactgtggatccctggattgtatcacagtttccagtaagaatttgcatgcttcctaatttgaggattagctgagaaagttttttcttttttcttttctatgtgcgtatgagcccaggtcactgtgtctgtctgtctgtctgtctgtctgtctgtctgtctctctctctctctctctctctctctctctgtgtgtgtgtatgtgtgtgtgtgtgtgtgtgtgtgtgtgtgtgtgtgtgtgtgtgtattagtacccctcccccaccaccatttgctgacttcaggtcaaaagacaggttctgcatctccttaattctgagtaagctgtctgttgagactcgggtgcaagatgaagcgggtgagaccggagggtgtcttcgacactaaaagtctatctctttgcagccacacatggcatcattatttggccattagggaagtctcatgtgtgacagtagcttttaggcaatgtcccctctgaagagggcatccagctcttaacctattgctgaaagagaaacaccattgtccattaatactactggaacgaaagatgaatggggacttggccttgatctgacagtgagcttgactttgatagctcatcctttaaaaaggttcttttatatctatgaaaaaaagcatgacgtcaagccagcagggaaactgatatcaatatttaagaccaaactagtaggaattaaaaaaaaaaagtcccttgtgaggacagcttttttttttacatgcataactaattagcttaggttattataagctgctgctgtgataacgtctccggcggtgcctcgggatgccttgtttatggtgccttctttatgccggtcgctcttcgaattggaattacagaaagtagagggaggaggactaagtggtctgcggtgtctcctgggcttggggctgcctgaaaccttgctatgctggaaatgctagaatacagtcactaccaggtgagcattcccccctgtccacacctggagcctgactgcaaggctattatatacctgggctaatcggcctctttaatgttactgcactaaggacccgattcgaaataaggacagatctgctcctttaatgctatttattttctgatgccctaagaagtaatttactatagctttagacatagtaaatagcaggaagatttctttccccagtaggtaactgctttctcccgagcagctcttgtttagagtggataagataaaattgtgtttgtcagtgaaaagtaactttaaatcaaatgtcattgattttgcttatttttttttaaaaaagcatttctaattccctgttagtgttgatggaaaacgacagcaaatactgtgctggtttgtcaataagtaagcctttaaaaactcttacatacaagtgatatagacttgaatgtaactgctttgtgtagaattgctttctccatagagctcattcataattaaaatcctgaataatatttttatatatgaaaggaagtaaccagtaattccttgatttaaacatggcaatatttctgattatttctatgataattttagtcagtacttaaggattttgtgtgtgtttgtatatagatttgtctctgtgtgtgtgtgtgtttctgtgagtgtgattctgagtgtgtgtgtgggtggggagtgtgtgcatgattgtgtgtttttgtacatgcacatacattttaacagaaagctattctatttgccaaggaaaacaagataaaacagagttgtgcgttttcaagtttgttgttttgatttttgtgttggggagattttcgcctcatagatacttgcaaatttaataattagccataagaagaagggcactaggatagaattaaatgtatacttaattatcagggacgttaaacaggatagttagtaccctggattctaagagctctaaatcctgcaatttagattctcagcttcagtactatcaattattttactattattattattattattattattattattattattattagcacaatggccagtaccttacaggggattgataatctgttctgttggtcaactggtcagtctcacaatctatgctacaggaaaagctacctgaaagccccgaataacactgctatcttctcttccctccacggccatgctcaggtgcagacccacctgggaaaaccccaccaagtaccacatacagcaagctcagaggcaccaggtaaagcagtacctttctaccactttagcaaataaacatgccagccaagtcctgagctcaccatgtccaaaccagcctggcgaccatgccatgccaccagtgccggggagcagcgcacccaacagccctatggctatgctcactcttaactccaactgtgaaaaagaggtaattcacgtctcctcttctcctctgtttcttacattccattaactgtctgtgggatactcctctcgcccttagcaatggactgtcttttgtccacctggtcattgtcaccaacctctgtcctagatctactggtgtgaccgtttatatttcagccttcggtcacgaagactaggttactgggtttattgcacacgacaggagacctgacttgctctaagcagaacgtggaggcgaggatgcttccgtaactcccatcaccgtccttagatgagtgttttcttcccttctatgccttccaatttgtgaagcagcgaacatacagacaggagaaggggaaagtggaaagggaaagcaaaaatagaaaaggcgtgcggcggcaggaggcttaggagctctgcttgctgtgaatgtctgggatattatttttatgtttcatggagttggagaaagaaaaaacatggagcaggtatgggtggatttgaatggtatggcatatgaggcttttaaagaaagatcaaggcttattacagcatccagtcggtctcaaaatgaatggctgcctggtgacactggtctgggcagagggacaaagacttagtccctctggtgactgaaataacccaaaagttgtgtgacagtcacttgtgaactcacattaacacttccatacttagtaggaccttactaaaacgagactcgagttctcataatttgggaatatcagacactgaatcacagcagcacccctgtccaatttatgctccaaattttgatacaaaaactagcgtgagggttggagtcttgtctctaatctggcctctaccaaagcacatacttcttatccacccatatctgccatatgcttcacccatgtctcccaccattattgtgctccttggttagcatctgcttgtttgagagttccatccatcacattgctatggcactaacatcctgtgaatgtgttgctgaaaggcgtttgcaaatccgagtcatggactgtctctgcttctgtttctgcaggcattttataagtttgaggagcagagcagggcagagagtgagtgcccaggtatgaacacgcactctcgagcgtcgtgcatgcaggtactgaatggccgggcaggccaaggatgtaacacttgataatgagtgagaatctatatttgtgaatgatcgcagctcctgatgacttcaggacctcctttcctcccattgatacttttttgatagaaggatctatgaacagacctattttcttcatagtaactcatgaatgactaggtaacaactaagaagattaaatatgtgtaccctttaagtttcccacagtcatacggagagggaaatatccatagattgtcgtaaaaaatgcaggatgatttagttaatgtgcataaatctccagcaccttttgtatagcattgtaccagccttctaagatatatttttgaaaccaagctgtgccaatctctgcattgttttctaaatggaacctcctgttctctgtattatgaagcttcagtaagctaataatagctcacaagcacttcccccaaggatctgaagatcattatttaaattctatttagcgaataaatggaagcatttatttatgtatttatgtgcttattcagatgtatgggatagaatataatacaaacaacaaaatggtttctttgcctttatatatatgctaaagtatatactattttaatgatacattaaggacactaattttgttcccctaaaactaaagtcaaaatttataaagaaaagtggtttatatgtctccagcctattttcttattcatcaacccagtcaaaaagccatgtattgcaaataaataagctgatatgccaggaacgaaaactaacatgaagtatactagctctattcaaacctgaccaccagttattttttagagaaatcacttgctatgactcattctttagatcagacgttatagtatattccaattttctgagcattttggaaggtttctcctgaaatctcatctgtccccagtgagacaatatatgctattgtccccattgcgtagattggcatactgagatttctgaagactggaggcgttgcccttgatccaggaagagggtgaaactagatttgaacccaatgcgcataatgctggagtctcacctctttaatgggaggtacacatgaacacaggggtgccctgggcatttacagagttcactgagaatccgtacagcactcttcagacccaggcacaaacacatcagccgggaaggagcacacggtgtttacaaggaaatgtttccgcagactccaccactgctgcaatgcgtgtgtaatcaccgttgtttatgatgctaactggtgttttggtacttcagcaataaaattgatctagagggaatgtcagctccacagccgtaatgataacctcgtcctagtgcgttcctctgggagcaccagactcactggcagctgtacaaagaggtgttttccttgcaagtgactacaatccagccagtggtcaggggccccactggaaagcaagggccatgaaccagctatatttcctttttctagaaggctgtgggaaaggaaaagggaagtggtagctttgtgcaagaggggcttcctggctcatctttccagtgtcaagtgttcaacagaatcacagcccagctgtgctcgtggtgtggctttaagctgcttctcatcactgcacctgaatagtggctaccctgctagtagccctgctccccgacttcagggtgataatgcactggaaggaaacacccaggctcagctcttgctgcctactaatggctgaaatgctagctgtgaagtggagttttcatcaccgagtcctgttagtgggtttcactaatatcctgattttacttggggagagaatactttcacttcttagactctgttgctttaggtaagaaaggaccaagaacgtcctttagggggtggccttacacctgtttctcattgtggctctttttatctacagatggatgatgtaattgatgacatcatcagcctggaatcaagttataatgaagaaattttgggcttgatggatccggccttgcaaatggcaaatacggtaccgatggcctttttaaaaaatttttgttttccaagaaaaccttgaggtcattctctgttcattctcttctccccaccctgccctccatccctagaactcagtttattcacaaggattctttgaaaaatttattagtaatcaaatgggaaaaggagtaagtagttttgacatcagaaattaagaagcttgctcgagtttatcacgagcactataattaagctctgtgtgcaggagtgcaacctctctctccctctctctttgtgtgtgtgtgtgtgtgtgtgtgtgtgtgtgtgtttgtacaggtatacacgtacacaggtgtatatgcaaaactgtgcccatgtatgtagaaagcaaatgtccaccttggacggatgtcattgctcagatgctgtctggcttagcagtttaccttggataatgtaccgtacattatcaccctggaggagaggggtgctagataatgtaccgtacattatcaccctggaggagaggggtgctagcagggagccactgtccagaggggtcctttggtatacagcccctaggatctgcctggttcttctctctcagagccaggatcactaatttgtaccaacggggctgggctttcattgtgggggtgggggtggggtggggctgggaattggactcactcaagctttgtgcctgcaggagcaagcactaaaacaaactgagctacctccccaggccccttttgataaagtgttaaacattttcacttttgataaaaaaaaagttccacttttgacaaaataattcagctctttagcccaagtgactcactgtgacttgtgctgctcaaagctgtgtcagtttgaccccaaaccgtgaataagatgtgtaggcggggtccgatgtccccaggtggtagggagacattgagatttccattgcccagcagaagagcagttaaagttcataaggcagtcctcacggatttccagctgcttacagtgctcatttgagttacctcgtcctctataacttgcagggttttcccatatagtttattctatttcaggccttatatttgtatttatattcctgtcttaccaaggactttaaaaagtcccattcgaagttgtttttagtcactgcctgtggtggggtggcaccactgctgtctgagataccgctgggttaggcagtctgtgggaggctgggtaagcgcagcctgctcagtttgtcctgagatgagctgtaagctctcatattctccaataactgctgtccaagggagtaacctgtattaaggacaagccataagggggataataaggacaagccataatgagggaatgttaaagtgacttttgtgcctggttgtgtatctgtgtatccatgtgtgtcctggtatacacgcaggtggcttgtgtgagcacatggaaaccagaggatgcagtttcatcttcaaggagaaaagtgccatttctaattgtatatgagtatgtgtaaccagagactgtatatgttcaaaaatggtgacttttgaattgtgtgagtaaacactgcttcaaaaaaaaattgctaacttctcatagtaaatgccctcagccagaaacagtgcagcccccatttactgaccaacacaaaaattcagttaactcagttttttttttaaatatgtaccgacttctttttgatcatgtccaagctgtttttgaatttctgtggtgtctcccaaagtctcaagacgtccccttaaagagctagcatctctttccaacccagctaaactcagtttgtagttacttttgtgtggtgtgcctggttgtgtatctgtgtatccatgtgtgtcctggtatacacgcaggtggcttgtgtgagcacatggaaaccagaggatgcagttggatgtctccctcagtttctcacggctttgtttgtgaagcaagggttctcactaagcctagagctcactgatttggttggatttgctagccagcttgccttggagatctctctcagcctcctgaacacttgctgcgatttcaggtcaagatcgagactcacaggtggctttttatggtggtgctggggacaccgatattcacgcttacgtgggagggttttatccaccctaccacttctccaaccccgcactgtgattttctttttcttttgctattttttttggaagaaccacgtgatctggggttctgatcaaggtgcctgtgccctgtgtgccttggctccctggaactcttagctttcacgctcttgtactctgtctgtagccagaattctgggataaatataaataagatactgcaggaaacttccactagagaacttaaaaatagacacagagacttgggcatatttgaggtatgaactagcaacggcatggtcatctcaaagagattctgtcgaggaagtaggtggtcttttttgtcaggttgatacatgcatacctgggcacactcaaaagtactgcgaaatgatggatttcacgttatcattgattttaaaataaattttgcaatgatggggaactttgaactcaccagacccaaaccaatactctgaccactaactttctcttgcatattgtccaaattaatacaaaacatcagattccctacttcttggacatctcaaaaaaaaggatatacagcaagcagttcacagcagttcttgaaggaagcagtgagacatagtggttaggacttgaaattagaacccatcctgggttcagatccaaggtgtgcactgattctgcaggtttgcatgcgatctacagtaaagtcctgtgtttccacatcagaaaagagaaagggctactaattatttctaactcatttatcttcttacctaacgaagaataaatagcatttagctttgaaaatagaagctgcattcaaccttgctgtctaaatttttccttgtactttgttcgttgcaagatcaaatactttattaatagtgtgcgcttattcagctgatattcattaaggctcaacaatgtgccaaactctgtgttaggaaagctttgctttataaccatcgtgcccctcacagtgatttgtacattagcaccaccagtcccagcttgcttccagctgaactgtgcttggccaatccttctgaaggcaattgacatgactccaccacttgcttctatagactagaatgcacacagtgcttctccatctacactggcactgaagtctagttcctgcattagctaatcagccctgagaagcttgccccaaggttgacagcatctatctccatctatccagggggctggggtcatagctcagtggtagggcatttgactaggatgcatcctgggcaagataaaggagctgtaaagggaaactttctatcctggagctcacagcctggagggaccactgtactaccccgatagtggaactcagtagctgagtgtggccatttccaggggattcccacaaagcaatctcccataggaaatggtgacctcattcccaaccaggaggtagtatctaggagctgccgttagaagtcactggccatattgccatatttgcctcccttccatatcacaggctagatcaagcaaactgccacctcaagggtttcttgtcctgacataattctgctgatagacagtgttatgtagaggttagaagcagactctagatgttttgtttgtttgtttgtttgtttgtttattatttcatgctgggtgtagaaccccagacctcatgcatgctatgcaagtggtcctacactaagctataacccctgcccttatgcatctactgttgagtgagacatttgacctctctgcctcagtttccttgtctataaagtgttatatcaactgcagtggtcttgatgctagaacttgagaatttcatccacaagaagtggcttgaccctaataagctcctgtcaaagcagacctccactgggtctttatcatcttggaattcagttgtctactttaatatccccaccaccaccaccaccaccaccacagtaaagttgaacttgactgttaagtttagtttaggcattttttcgccccgcttctttgattctttgaaatgctttgtttcaagttaactacttcttcaaaagtggaaaggacgtaggaaggaagctgtcctaagggaattgaggtctagaggtaactgttcctagggcacaagggccctcttgtactctctcaaacaaagaagaaaagtccccgtttacttgggttaactgcgcaattgatattcagacgaagaagggcccttccacagagaaaaacaatcacattttacagtgatcacttccttgggaaaatattccttttggtggtgagaggcaccagtgcgctcagttaagactatgactggggcacaggcagcagcaccctcacctcacctttgcctgagctgcccagactgtggctttctggaagggaaatcttgtccagaggtataaatgctctgcatagaaagtccagcaaagatgcagatcggccaagtagacatgcatctcttcgtctctcagtccagggggttattctgaccctgttataacttaactgtgtgtataagaggatttttctaacccagaaagagaactacaaaattttgttcttttcttttttcctttcccttttcttttgctctcctccatccccaattttattttctcctcctctgtcttctcccttccctccctttttttctttctcttctctcttcccttctctctcttcaaagtatagtctgtgatgacctagagatttgctttgattttgctttgggatttttgagataggatctcatgtagtcccctgctggccttgaactcctgatcctcctgccttagcttcttaatggctggatgacagatatgtgccactatgcccagttttgagtgagttgtacctgcacgtgcgcgtctctcatttgtctcttaaaacatgaacatcgtaacagaagtgcatgtttatatccagttcacatatgaggacataagacacacacagttaatatttctagagctactggattaatcttgtagctcactgtttccaagttttaatttgcatttttggtttattaatgctcagatttggacctgggaaatgtgtttagacttcagttcctaatagctttgtaactttcatctttttggccttttacagtgctctatgcaaacatgctaatgcctctcgtggccccttaagttgaacaagaacaaaaccaaacacacagagagcaaggttgacccctgaggtgacctgtttctcaatagaacctctcagagcaatgactgctaataatcaggcaccagttatcagagcctttgctggaaggcattgaaatgtggcccaaggacattttaagttagcgcagtgcatattcactggcgtgtggcagggtgtgggtgtgagtattatgcttatgaagattctacaagtgctcatttccccaagacctacccacctgcccgccctgcctgccctgcctgcctgccaccaccgtcttactaatatacacatctgagagcagcttccactatgtacaacacctcccagccccatctcttcatccagggctttagctcatgcatatacagaggccagagaccagcatcagaagtctcccacctattatttttgagaccttgccaattaggctacactggctggctgctggtaagcttcagggattccctgtccaacaaccacttcagccctgaggtataaaagatatgtacccagattttatgtgagttgggaatccaaactcatatcattatgcatgaacagcaagcagtttatccactgaactgttttccgtctcttggatctaaaacttaaaataaccaaaaagttctacagcccttatctgtctgtctgtctgtctgtctgtctgtctgtctgtctgtctctcatttaccttcttatctccctatctacatagtgtgtgcatgaatgtatgtgtgtgtatttgtatctgtgtgtctatgtgtttgtgtttaggtgcatgtgtgcaacagcatacgtatggaagtcaaatgtcaatttggaagtcaatacaggggccccagggaattgaactcaggttgtcagccttggcaaatgtcttacccactctgccattttgttaacctccaaatcaaaaacatttttagtgtcaacctgatgctttaagtagagtttgataaccaattgcatgaactaggttacagtccaaatgctggtgaactaaaaaaattaaatacaaagttatcttttggccatgtgtatgtatgtataagatgtaaataaaacataaataaatttcatgtttacatctaggtattattcccaagataaatatgtgtataaacatcacaaaattataaagaagtaaaaaaaaaaaaaaaaaaaaaccctaagtccttcttgtcccaaggttttcaagtaaaactagcttatcctgtatgtggagtaccaccttgctgtgtacctctgggtccctccatggtttaattcctctttgatgctttctgaaattacttgtctaatacataatagagagctatgatcaggtaaaggaaaggctaatctgcaacgtggtgtgatgcaggtatcaaggaatcattatttgaaatcgtctggcaatgctgagggtccaggatggaaggagtgatgcatagctattgattgtctaggaagatttccaaggcataagaagaggaacttgtggctgtcctctctagctagctttgagaaaatccatgtccgactgggacatcattgtcaagaaaaaatgaaaatgaggttgctgctttaaaacatcccaggagaaccggaggagacagcaccactctgaatagttaaggctaagttaagcatttctttaatcctgctttaagtgctgtaaatatttttattaaagtctttgagctccctcttgtggctctttggataatttcaatctcaaggaagccagcttttgccataaggacaccgctttacaaaagggaagtatttgctcattgcttttctttatgaatgaaagcaagggaaaaaaagtagggagaggtgaaagatggaggaagagaaacgtcctctgatggaagccacgcatggactcctatttcacaggaatacctggcgcccaggggacatttgccacttttggcagcaggtgacaccttgccaacatgtttggaatgtgcccaccagacagaagtcagtgcgggcacccttcttactccctatataaacagatcatataattctgtgtgagtcctcagactttcctgttttaaaaacacagttctttatagcaaagagtgttgtttccataaagcctgaaatagagtatgagttttattgaaaaaaaacaaaaacaaaaacaaaaaaacctctgcagtcagtcaacacccattgctgttcttgtctgtgtctagttacccgtctctggaaacttgatcgacctctacagcaaccagggcctgccaccgccaggccttaccatcagcaactcctgtccagccaaccttcccaacataaaaagggagctcacaggtacgtacctagcacaaatgcttcttactatgatactctgttctcttccccactggggagcgttaccaacggaacagcaacgtttcctgtgcagctagtgggtgttcttccagtgtgttcgcttcctgagcctctgtgcagtaatttaatatacagtattaagacgttaagttgccagtttccagggttgctgggagccctttgggttgagggttataggcagtacacgcccctgtaaagtgcctctcccctacccgctgtgtatcttgcttgccgagcccctggagtcttgacttaggggatcctgctttgaattttccatctgagtccacacttgggatcgagtaagaatgtatttcttacatctttcgatgccttctcctctttctcctgtattgtgtgcatgagatttattatagaaggagaaataaatcataaaatggagccatcagaatgtttgctcttgaggcaagtgtgaaattacctattttgccactttgtttgatgctttagggaaggcatttgaccaataaaacatgacagaaactgtattagaaccggcattctaccatggtgaattttatggtccttgccccaaatccctttttattatttagttcttgcctcttgcaaaacttgggggtggggttgagtagatggggtacggattgttgcaaagactgttctgtccaaaagcattacaacaaaaactatttcagaacattttaacataggaaaaacagggtttttttccagaaaagtgttaattggggctcaaaaggtaatttactaataagcaaaaacttaaaaaccattaagaagcagtggacagtaagaccttcttacccttctatatgagaaagcaagcgagaaagtggcttggattgaccatctgaatttgggagattctaattttaattctgtctgcacacacacacacacacacacacacacacacacacacacgtgcatatgcagttaggagtttcatgattacaggttacatcctgggaaatagttcacctgatgattttgctgtggtatgagcttcacagtgtggctttacgtagaccaagaaggctgtaatatcattaaacggtgtcatcttaattacacttattaatttatattcagtgtacagcctctctttgactatttcaatgtagtgtgagatgggtatatacatttatgatatataaatataccatatatatcttgcttttagaaaggaaactagcatggtatgataagtctcaaaatcaataaacagcacaatttgtttaatacttttatttgtttctcacatgataaaaaaaatctcttgacactaaaatataatgcaacttctcaaatggaattgccaccaaatatatctagacccttcctagacaagttgtaaatacacagtgactcctaagaattgtgacatgaacacgttctagaagatgctgacagaacctgactccacattctggaaaaacaaaacaaaacaaaccaacactaccaacaacaacaaaaacaacaaaaaaaaaatcattctcgtgagttaggcaaaggccatgtaaacagatccagaaatattccctgccagtttccatgtcactgcattacaaaggcatacaatactggaaagttatttgtcctgaaaataaagtttgactcttaataatagaatatgccatcaagggctggagagtgtttaagaacacccacacagtggctctcaactatctgtggctcaagtctctgggatctgatgccctcttctggccaccttgggcattgcacacacatggtgcacggacacacagcacataaaataagtgaatcttaaaaatgatatgatatcaaatagtttctattcattttattctttttagtactagcatgtagacttgctgtactgtggcttgtcatctggtttgtagagactgagcttttcagagatttggcatatgtagcattaaaagaggcagaagtctatagaaggtgtaatttgaaaagtcacattttcattagactccagtgagttaagtttcaaatgttcagaagagatgctttgtaatttacattgttatgtccctcaaagttccagtttctaatgacttcattcacgtgcacagcgtgtattttccccacagagtctgaagcaagagcattggctaaagagaggcagaaaaaggacaatcacaacttgagtaagtttgcttaatttatatccatggcattagacattaaagtcagtgttcttcatgtatcaaaaaggtgattccagcaatttcacaggaaagttactatttctcgttgttaaaggtacagtgagagtattccagagagattctatttcagatcaaactatatccatatctctgtctatatatatttttttccagaatatacatttacatatatatgttttctctgtatacatatatatacacatatatgtatatgtacttatatgtgcagagagagatagagaggagagagtatctatgtgtgtatgtacatatatatatgtatatatatatatatatatatatatatatatatctgtgtgtgtatgtgtgtatgtgtacatatatatatgtgtgtgtgtgtgtgtgtgtatgtgtgtgtagagagagagagctacagagagaggagagacagagagacaaagttttatatttttgaagaactgtttttgtttgtggtagtaggtgtggtgtggtagtggtggtggagagagagagagagagagagagagagagagagagagagagaagggagtcttgatcttgatccccaactacccaattataagtactgcacattggaacttattagcagaagggtatttggagatcatcttttccaatgagatttcaaggttaaaaaaagacaaaagaaaaggagagaagcacagagaaggttgtggtgggtgaagtagccaaatgatgtctatctgttactctgaggcattatgtaacactagaatgtcttttcgtgtggggcttactcttcacagaaccttgaagcttttacctgggaaaactgtatgcttaaggtacacattgacgagagactacactgtggaaataaaggttgggtgcagaggtagggagtcccataagggggctccttttatgctgtttcttacattgaagtttaagagtgagagtcctgtatagaaaccttgctctcaatgtatgagagagaagagcccctctctgttctattagccaggagaaagcatcgctagttttcaggtaggtgctgttttcctgacctttccaaagaagctaggtgcacatcctcctgctcaggtccccacagagccttcgctcagcattgtcagtaatcgcagatgggctcggctctcagctggagagctgtgaatacagtcttcaagtcttggctaattcctgggaagtaattctcagggtcctgttgaccttgactcagccctgcctttctaggatttagcttgtaacaatacttacttgctgaaatgtgcaatacttaatacttaatacgttcagttattctttccaccactacaagttattgagctccattttgatacaaggaactttctgtagaagcaaactggacaaacgggttttctactggtgggcatgttcagatgtcaggtgcctcatactaattaccgagaggaacaaggaggataacaatagatatcacaccccattatgaaaggaagcatactagagggatgattcgtgggtccactggccaagatctagaaaccagcttgtctgtgacagttgccccaggcatgtagaagttggtaatgtgaatgttcctttgacctttagcttcatacactttagggtgttgttttatactttataagttttataaagtcatatcacttttataataactgtttgaagaggcaaatcctacccaaaaggtagctgggtcatctctaaatgttgacagcaagagaacccagaggcatgcagggaagtgagagaaggcaggtgtgggatattttagcaaagggattcttgttacacttaacatgccagctcacatcattgcctgggatgcaaaggtgacagatagtaggtgaacaatacgtatgagattcagagttctgtgagaagaagaggtggagcccagtgaacatagtatcatgataggcatggggctcatgggtgaacttgagttgctacttacaggaggagagggctccttaggggtctggaagaagagtgttctaggcagaggggatagcagaggaagatggccaatgcatatctgccttggatgtatgtgggactaacagcatcagtgaatccatcagcagaagagcacaggtccattgccagagaagatgctgtcacactggaaggggagtacagggagatatgggcagggcagggcggggccaccagatctttgtaggactcctcaaggacttaactttcccttggataaaatgggaagtgatgggggcaaggatcaggttgacgtccctccccctggtcaaatggtagagggtgcagtgggctcgtgggactcacaggtgccggtgaagactgttatgctaacccagacaaggggtggcgttccacagcgggaagcaggagaactgctagaacacagagtcaggaaatattttaacaacagaaggtattagatgatagatgacggaggtggaagaaagaatggtgtggcgccaatttcagggttccagcgtagacatttgaaaggatgtcgatactaatgaggtaagttaccatttagcctgaggtacagcaaagctaagctgaaaattgtgacatctcgtgtctaaaattcccttcatcagcaccactgactgttaatgtagtgtttctatgtatgtttcttatatttctagaactctaataataggaattagcattatgtatggatatatatttgtgtgcatatataatgtaaaataaatatatttatatttaatcattggaataattactcagctaaggcaaatagtaatttgcattgggaagattatgtatagcattagttatctacatatgcaaaatattagggggcaaatataaataaaatgttagggcactgaaagtaaatccattttattagaccttaacttacttggaatttatttgttagattaggtaaattgggaacatttactatcttactaggtcaccatcccctgagagtgatagttctggtgggtatagagtacagggtgaggacctgagagtgatagttttggtgggtatagagtacaggatggggacctgagagtgatagttctggtgggtatagagtatagggtgaggacctgagagtgatagttttggtgggtatagagtacaggatgaggacccgagagtgatagttttggtgggtatagagtacaggatgaggacctgagagtgatagttttggtgggtatagagtacagggtgaggctgcttgcaggatgtgtggtatagatgtgtgctgtccagtgtggtagctacttgccatttgatgtctagaacatctgaattgtagttagtccagattgggctgtgctggtctgggagctggcctgtgaaacacttgattggcatgtgcaaagccctggaattgttccctagcattgcacacaaaaaatatgctcaagtgtaaaatattttgattttgaaagcttagtgcgaagaaaagaatgtgcaccttctaatttaatttttttatattcattacctgttaaaatgataatggcctatagaaaatggatttaatggaatattaaagttaacttaatgtcttttcctttactagtttagcctggccactaaggaatctaaaattacacatgtaatgtatattatttatttttgtcagtcctgggctagaagaggagtttttatatatctcatgagcaaaaaccaaatgttttattattttaagtggttaaaaagaaatccaaacaagagtgatgtcttatgatcagaaaaaatatgtaaaattcaaatttcagcatccaaagtaagtctgttgctatgcatgagcaggtgtgtgctgcccaggttatgctaaattgttgttgctgtgttttttaattgtgtcattacagatctgtgcacattttatgagcacaaatttgttttctctttagttaaacaagtacaatacagatgtgcccaattttgatgtgcaactgagcaccctgccctggtttcagggctgttgtagaatgaagtgggaaattgcctgcctaagagcttcataaatgaggagactccaaagacagctcatctcttcttaaaagttcattcccctccagtagcaaaaggaagatgcgctaagataagggtgaagtgggctcaagtttccattgtcctggctggtgacgtcagtacgcacatgcctttaatgagatatgctgaacacccgggtgtgcctcggtcactaatggccctttcccatgctcttttcttggaagttgaannnnnnnnnnnnnnnnnnnnctctctcccctcaccccccccacccccgcttccttttctcagcatttcctctgcttaatttcacgaaactaaaatttcaagagaaatgtactgaattgtacaagctgagatagttagctttgaatgtgggcagtagagtttatgggcatctgagaactcagcagaaaattttgagcttggggcttgaggcaggctttcacggtcacacatacatgatcccaatagttgttaaggcaagatgggtggcatgtaggaaccccaactacatagcatctctaaatgggcattgatgagcagacactgaaaacatcaagttcaatgatactggaaggcagaaggtcagtagtttttatgaaaacgtgcagtctttgtatgttttaccagtctaggaggagagaaagcaatggttaatccccttacaaactacaagtcggctgatctctgtttcagtttttggtcctctctgcctcctctcttggagataatagctaacagataattttcgagtctttcctaccacgttatctgccacgtcagcaaactggtcaacaaatatacaatttttatccattagaaactggcccatttgagatgaagagctggggggatgtatatattttaatggcccccacaggcattctatgaaattagcctttgaatatgaccttttagctatctaataaaaagtaaagatgcaatcaggcattattcattcaaggcttattaaattcacgactcacattattgtcggggaatttgtagcaaaataaaataaaaccattacctatcgtgaggtggttttgataaatgtgcagccatttctgtcttctaacactttggcttcccaggcttcaaggagaagcgtgttcaagctggagacatccagcgtctccattgtgccgcacaaattcatcctcctaagggctgtgaccttcatttcctacagtcagtcttgcatgagagctgaaattgaattcccaatccctcttctttatcagcctttccccctttttttagcatattcttttaaaactgtagtgtgtaaatctcttcagtaacagattatgaaattaaggcgcgctctagtgtaagcttggatttacatgtctcctccattgtaatggaaggcttatgtgtttacagagggggctggtagggagatcgcttggcaggcattgtcttaagataaaactgcactgtgggttttccaagccgggtatttggaatgtgccttggaactgaaatagagacacactttacctgattagtgtcccagctccttccctagaacgagtgtacttcagcatttactgacttgcccatgcagaaagattcctctaaattacccaaaacacaacatttgaatctaatttagccaaggaacataattaattgagtctcaagtagacatatccccagatgcctgagagaagtatgtcttgaaaaattgagtggccaacagcttggcttgagaagcctggctctggcttctccctttggtggcctgtacaaggcatggtcccttacagtggtgtttctggctggctgctacagcttttgttgctttcaatttttagtcttgagaattggtcccagtgctcactctgagtatcttgggacacctccctgggctgccgtttttggtgctcagatacgggggatccacctcagggtcttctctggggaggctgtagctgttcttctccttggagaattcctgttttgttcctcagccagcccatatgaggatcagtgaccaggtggctcatttaaatggcctgctcctcacctattccatatgacacttctgatcagctcttagtcgctgtaggtgatggggttgacggttctatttacctcggagagatttttattttatcactatagtcatcatcagtacaaattgtctactaaagggactggaaagattacttccacaaatgtagttcactctccatggtttgttctgggctactcaaagatttttactgtaactttgtccttgtttgctttccactgctgtgataaaaatattgacaaaaaagcatcttgggaaagaggagttttacttggctttcgtattccaatcatactccatcactgaaggaactcaaggcagggacctggaagcaggaaccgaagcagaggagtacagaaatgctgacttgctctacaaagcttgttcagcttcttaatatttccaggaccatcttcccagaggtgtcatagcccatatagtctgggccaacctaccaccatcattaattaagaaaacgttcccacagatgtgtctacaggccgacctgagggatgcattttctgaattgctgtatcctcttcccagatgaccctggcttatgttagatcagcttttgtccacagttagcacactggtgccacaatgaagaagctgaaagtcacactgttggcagccattgatattggaaatccagggcagtatctggccaggtttctaaccatggcagttgccgtgattgtgttaaacacttaaacacagtacttggtccagtattgaatgatattctcaagttcatataaagcatctcctttgatttaattactcatttacaaggctgctcaaaagcacatagtaacatcatttcacagatgagaaaatggatacagagtgagcttagataatgcccataataattcatgatgaaaattgaagagggtgttttcacaccttagacaagtggtgtgttctcacaggcctttggttcttcttatcctatcccagtgactaagtctttatagttccaggtatatacaactgtttaagacagtttatacataaggtatggtcatccacacacataaattaaataattgatttcacctagtgaaaggtctgtgatctagatgaaattgtactgtactggtttcaacatctgcacaatgtctccaccttatgtaaggtgtttgtcaggagaaagtgaaatgttatataccaaataagggaccagtggccaatgtggggtgagcactaattgggatctagccatcacttatttgtaattgcctttccaactatacgtcaaatactgaattttctttgaactcctaattcctgaaagggtccattgtcttgttttatcacagagacatgcggtggaacaagggaaccattctcaaggcctctgtggactacatccggaagttgcaacgggaacagcaacgagctaaggaccttgaaaaccgacagaagaagctggagcatgcgaaccggcacctgctgctcagagtacaggtatccaccctctgccatgtgaactgatttcaggacaataggaagtgtgatgtagtaagccctaagggagctggaggcagacttaatataggtagtcctttctgtttcttggtcctataattgtgagtttgcctactggtaaaacattattggtgattccagactatcaatggcacgtttgcaaccactcttggatgacatgcacccgttagtagatctgagttgcttgcagctctttgcccagaggctaagcccaggtgaagggctttttgtggcagccctctgaattatagactgttaaatgactcgttcccttatagtgttgtcattaggttggggacttctcatcttaccctgacccccaagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggaggcagaaagtggtcctcctctaggcctgggctttagaatccaggaggttaaacaggggttagatgtaaattaagcatctttcttcccctcccccccacatacctccttcttctcctttaatctgttctttgtcttatgttacttacatctcttctataaaatggccttaggtatctggtacttggtgtatccatttgtaaggtagcttatgttatttccttattaaattatttaaatatagccagtttttctaaggaaaagctaagtcgtgtcttatgttgaggttccccatctcacatatccattttaaatatgaatgttatggaatttgggccttgggaattccatggcagtgcccgcttggctttcttctgttgactgcaaggctggctctaccacttttgtatgttatagggaaaaaaaatcattaattaggcagtagagctctacagtgccacaaggcctcagagctctctacgagatttaaaagctcatttagaaactgaaggaactattttaatttgttgataaacacttctagttagacaacagaggggtacagtaagatgtttgcgtctcccctagttaatgtattttcttgcttcttttgaaaagacaaactatactgctactcttcgtgttgctgtggagttaccagaacctgtgattttcagccaaggcccggggcctttccttcatttcagtctcagtggtgcatgcagaaatcttcatggaagagagaacaggaggccttattatcaggggaatggttttattaagtggcccagggcttcagcgtgatgcctggggaggcttatttctggagctggtctgaaggagcaggcatacatctggcatcgcatgctctgggtttctgactcatactgctcccaaagtaagggctcacagatgcagccattggagcacagaccggctatggttttcctcacacttgccagccaggttgagaggccatgtcatgtgcaaagtgctttttctatccaaaggatatacttcctgtctgtattttattttcatatgttgttttatcacaaacattggcaggcattaacatacagaaggagaactggggtatccatagggaatccctgatgtccgctttaggaatatggggattcatcagaagtcagggttgggggaggggatgacatggttctaaggcaccttgaaatgaggagatctgagaagtcacagacttacagggtatgtcagtcagctaataccactgtgacagaaggccactgagcggctgagattagctagcagagattggctttctcactggcttggtggctgtcagtctaagatcagccctgtcatcaggattggcttcttcttaaccctcatcctgtcttcaaagactctgtatgccgttctactcccagctgaggtccatggacttgggagcacagtgcagccagtagtgagagagtgcacctgctaagcaagtattcatggtatagatgagaacttccttgccgaattaaaagataataatctccctttgccagggagaggtgagtcacatttcctggaactctggttgtacattcagaacctggagagcgtttgcttccccccccctaaactttacttcctgtcaccattgatgtcttagccacttcctcatcccatccagaagccagaggaaatgcctactgttttggtcacacccaaacagaatattgaatatttatgccctaacagcttactaatgggtgttcaacttttaggactccaacccggtttatagaaaccttggcattagattagataagccgcccttacctccagttccatgccaatgctcaggaggcccttgtcactacagtccctccagaaacccattttacagtactatgaggcaaccaaaaagtatgcattgtacaaagtcactgtgaacgtggagactggaaagtgtgtagcacacttgccctgaaacgggggactga

SEQ ID NO: 2012 - DNA, 661 bp, Mus musculus
atggaggcgcttagatttgagatgctcatcccctgctcctttgaaagcttgtgtctcagttctgcagagcattctggggcctccaagcctccgttaagctcctccactatgacatcacgcatcttgctacgccagcaactcatgcgtgagcagatgcaggagcaggagcgcagggagcagcagcagaagctgcaggcagcccagttcatgcaacagagagtggccgtgagtcagacaccagccataaacgtcagcgtgcccaccacccttccctctgccacccaggtgccgatggaagtccttaaggcattttataagtttgaggagcagagcagggcagagagtgagtgcccaggtatgaacacgcactctcgagcgtcgtgcatgcagatggatgatgtaattgatgacatcatcagcctggaatcaagttataatgaagaaattttgggcttgatggatccggccttgcaaatggcaaatacgttacccgtctctggaaacttgatcgacctctacagcaaccagggcctgccaccgccaggccttaccatcagcaactcctgtccagccaaccttcccaacataaaaagggagctcacagagtctgaagcaagagcattggctaaagagaggcagaaaaaggacaatcacaacttga

SEQ ID NO: 2013 - protein, 221 aa, Mus musculus
  VARIANT (1)...(221): Xaa = Any Amino Acid
MEALRFEMLIPCSFESLCLSSAEHSGASKPPLSSSTMTSRILLRQQLMREQMQEQERREQQQKLQAAQFMQQRVAVSQTPAINVSVPTTLPSATQVPMEVLKAFYKFEEQSRAESECPGMNTHSRASCMQMDDVIDDIISLESSYNEEILGLMDPALQMANTLPVSGNLIDLYSNQGLPPPGLTISNSCPANLPNIKRELTESEARALAKERQKKDNHNLX

SEQ ID NO: 2014 - DNA, 248436 bp, Homo sapiens
  misc_feature (1)...(248436): n = A,T,C or G
ctttctactggtccttcccagagtaaacacatggaaagaagtagacagaaacctcaataaccttttatgacctagcctttgaagttggtcgcacaaaacagccctgattcaacgtggaaaaatgccagtagtaggccaggatcatcggcgccattgtggaaactgactaccacaatttcatttatagaaaaaaatctaaaaatagggaaaaatgaactatattgcttagggaggcatatttaagtgtcaaaacttaaaagcaaaaaaaggaatgattagcttaaaagtggttatctcttggaggaaggaagttgtaagtgggcaaggatcattatttgtaaaagaatacatttatgttttatgcacttttccttaagtgtgatatatttcataattttcaaggaaagttcatttcaaaataataaactaaaagaaaaatgacatgagaaaaagaaaggattcatttctctaataataatataaaattagccaatagttcttatatgttccagacaattatatttatatctttatttagtactcacaacaactaatgtggttctattaacctgttttcacaaataaaaaaattgagaagtagggtgagttagatatcttgcccaaggtcatacagccaataaatggtggagccagggcccttctgaggcagaaaaggaggccagactattggtatacctttaaaaactctatttttgcctaaactaaactttatttatatatttatttatttatttatttatttatttatttatttttgagactgattctcactgtgttgcccaggctggagtgcagtggcgtgatcttggctcactgcaacttctgtcttctgggttcaagcgattgtcctgcctcagcctccctagtagctgggattacaggtgcccgcctccatgccggctaattttttgtatttttagcagagacggggtttcaccatgttggccagtctggtctcgaactcctgacctcaggtgagccgcctgcctcggcctcccaaagttctaggattacaggcatgagccactgcacctggccctaaactagaaaaacttttaaaatccttagctgggtgtgtcaactagtttttatcagtatgtgactggcaccagtatgtttagtaccatgtaagtactaaatagatattgttttaaatgaataaaaaatacagatttatttattttgcaaaaatcttggatgatgctggttatgcgtcaaacactgttctatgcaccttacatgtattaactcattagtcctctgactgtctcctggtgtccactctaattcctttctaagagataagatactgggtaactttctttcttcacttgtccctaggtgttgtgtttctaagttcttgaaatttgactcctggatcttgctgttttaacatattactttggcaagtcaattcaatagcagtacattgagcacctattccttactgggttctagtggaaaattaagatgaatgtattttcctctgtaacctaataaatgaaagcttatcttttaaaactttcagacaacgttttgcattaacatggaggggaatgtcaaatcccttgaggtttatccctgtaaacttcaccggaggaagtgtatctgcatcttggcttattgtgcttcctatttcagtaaccttaataagtgctaaatatgcttctttcagttatttttcagcatatttctccaaatcacccagtagcaagtcttaacatgtctgcctgttgttttaacgaaaaaatctcagctccttatcaggaatcccactgggacacaggctaaattctatgctgataaatcagttcaggctaggatagagccctagtgatgaagcagttattttgttcaataaatatttgcctatttgctacatatgaacactatggaaaacctagtcaaaatcccattttcatgtgcattatctttgttattactgaaaggagccaatgtgactttgctagaaaacattttttcttttacttacagctaattcattcactcattcaatagacagctactgagtatctatcatgggcatggtcccagccctgtaggagctcacagtttgggcaagggcagctgtgtactgggtatgtgtgtgatggtgctggtggatgtgcatgaaaagttatgtagataattataatccagtgtattacagacagtgtatgtgaaggacctaggaatggggcccaaaaccaacttggggatctggtgaaggttggtagagttgggcaagacttcctgaagaaggtaacacctgattgggttctctctctctctctcttttgagatggagtctcactctgtagcccaagctgaagtgcagaggcacgatctcggctcactgcaacctctgcctccagggctcaagtgattcttgtgcctcagcctcccaagtagctgggactactggtgcgtgccaccacgccaagctaattttttgtattttagtagagaccaggttttaccatgttacccagggtgttcttgaactcccgagttcaggcgatctgcccacctcagcctccccaagtgctgggattacagctgtgagccaccgtgcccggcccaattgaggttttaagtccaaataattgcgttaggccaaaggggaagggaaaaacagactggcaaattctgataacttgaagcagtttggggttattgcagttgcttaatatgaaactcagggggtgatctgagaggatgaaggaagggtgggtggacccaggatatggagagttgggtatccagggttaaatagcttggcctttactctttagcaataggaatcctgaaagatttcaatcaggggaaaatggaaggtgagatacgtgttctcgaaagatacctcttcacaaaagtttcaaaaacaggagtgctttttggcccagcaattcaatttctaggaaattaatgtgaatgggaccaaagacttagctactaggaaaacagcgacactatctttacctataagagtgaaatcttggaaatcaaataaaggcccaacaatgcagagattaaaaaaataaattctagtaaatatatatagtggaaaaattatatattctaaaaatattaaaataaatttatagacaaggaacaacatataataaattcaagacagggaaaagtcagggacaacactgtatattcagtgtgatctccttttgaatatttatttatatatctatacatatatatgaacatattgaattacatatgactaggtataaatatctgaatagtaggattaccagtgctttttttcctttttacttatccgcattttctaatttttaaagaataaatattattacttttctaatataaaaataagtttatttagaatattttacataaaagcaagtaacgttgctttggtagctatgtaaaggaggacagagaagcagaaatgcccactttgaagtttatcttccatcttttgctatattatgttgtgaaatattttgtgttctccttcttgctccaatcctgcgatctcagacactttggaataagaattaaaagcatgagccttccgttactgctcagtgttaggtttggagtctctaagtctacattagggtccaacccctctttcgctcctgccttagtagctctggggtgacaaccatctcttgccatctgcctggttggggctcatgagccacaaggcacttatttgttttaaacaaggtaaagccatccccaagctcactgctgagttctgaaccctgttgactcttcacagttgctccattgcaatgagttactcttgagacctatcagaatatcatttctaacccgtttaagccaccttgcagatcgcagccagtcctttcctaatccctttatgtggcctcttatattcagatccaagctcctcaaacttcacattggattattttcaaattgtcttcttctcatttttgttgagatttcattcagcctggtttgatgtcatcccttaaagtagtggttctaaaattcctacatgaataagaactagctggggagtttgctaaaaatgcagattcttcatccccaccccttggcaattctgatttaatagttctagctctgagtttggagctctgcattttaatggacgccccaggtgattctcatggacatggctcatggacgtcgctttgagaggggcacaacaccttcctctcctgatctgcacaacatagcactcttcccctgcccccttgccctctgcagtggctctagaaaagtacattatacagcactttcaagaataatatatttagaagttaatagttcatgatccacagaatccaggaggagccatagtagaccacagggtggtccttggtgcctctgagcttgcagatgaaatttttattgtgcactttttttttctggtaagaaggtctgcagctttcaacagtgtcagagaaatccataatccaaaaagttaaaagaccctaaaaatccgttaaacatatttatgccttaaaaattaagtaccttcctatttgacatgcttcatgtctaaagtttgtgtagcttaaattattttgggggggcagggcccatgccttggcatatatccactgccttggcacacatagaaagaatatatacgctgggaggatggtgcagaaaactctgctgttgatcatcacctctccccaaccctaacatcctgtttccttggtattttcctgttatttatatttttcttcatgtatacctatctcaccctctttctagataactggatagcctcttcctgttcactcctgtgctcattagaatgtatttcaaataacagaaacaaaagttgaattgtgtttaagaagggaagggaatgggaagatttttgggtttttggacacatgactgaatattcatgccagggaggctgcaaaataggattttttattttatagtctttaaaatagagaaagagttttggatagctagcatcttttgcagttaaggcttgggcacaaaacctagatccaccaattggattggaagataagcaggtgaagtagccaggactttgctgaatccattttggtggtggatggtggtagcagcatttcgacagtgtcctgtgtgcagtactggaggtgcaagctacgatgtttagtgatacaatagtggtgggaggtgtagtggtgtgggtgtgccttcactagaccagttctatggcatagattttggagttgttcccagttgcatggcttatatgttagggtctgctgcctttccttaggtttggtgagctactcagtagacttttgaagattcctttctgctgaaatacaccctagttagtttctgctggctctttttttccaaacatatcagacacaatcctgcttccgtatcttcatcatgtccattttctctttttgaatgacatggcttttaatctaatttcatcagaaatcataacccatttaagaaattgttatgatagtttcctctctcttttctttcttactttattttttaaaaaatgtttgatcatgaaaattttcaagcttacactaaagtagatagaatagtatagtgaattcccataacctgtcacctggcttcaacattttaccatttacatttcatatttcttttcccatgcctttctggagatagaaggagaggagatgggatattttatgacagctccaagacatcatatcatctcacccatacatactttatatgtatttctaacagaaagagtataaaaatgagataagcataatatacttatcatacctaatacaaattaacaatacttttaaaatgtcattcaattccagcccacgttcaaactctcccagttttccccagaatgaatttttacaattggtttgttttaatcagggtccaaataaagtccacataaggtatttcagtgatatgtctcttttttcctgtttatttatttatttataatttttagtagatatgaggtccctctgtattgcccaggcttgtctcaaactcctgggatcaagcaattctcccaccttggcctcccaaagtgctgggattataggaatgaacccccaagcccagcctctaattcattttttattgatatataattcacatgcctaatatgtctcttaaatcttctaaagcctttacaagttcttccttcccctttatttcatgctatttattttttgaagaatttctcaatgtcttacagaatttttaaatctctgggttgtctgattctatttttgtgatgttattgacgtggtcttctcttgcattttttttcctgtgaactggtggttagacctaggggcttgattacatttagttttcatataccctagattttttttttaaaagatggagcttagtcacatcgcttccaggagtcttaatatcccgacccccagtggttgctcttttcttagacaattgtagtatttatctatcgctcttgttatccattaaatcctgcccatttctactcctaaaaggtcaaggaccatgtcctgtgtgcagggaccacatatgtgtcatcattgctatttccccatacctagggcacaatgtgcctggcacagagtggatgcaccaaaaatagctgttgagctaagaggatatgagagtacaaatcatacactgggtatctgctgcttagcattgctgctttatgtgtggtttctcattgtgttacaagccttgactcaactcatggactggaagcttcatgaggggagggaggaagtcaaatatatttttgtattccaggtacctaacacattgccatgcccataccttgcacatatttagtatagagtaaatggggaacccttgcctatccatctctgaaggatttttgtgagctcaaataagagatgtatgtgacaagtgtatgtaaaaagtaatgtattacataaatacatgtaatattaataacaacaattataatctgtagtcattgcttttgtacatttaataggctcagtctttagtttaaatgtatggatctattgcctgttatcatctatttttcaaagtggtacctaaccctagggcttaactcattaatgaagagggattacagggtacatctatcaggtggccagcttttggttatgtggattaatggtatagcaatccacagaaaatcatccatttaaaggagtgaaatatttttatggtgattatgcgaagctcttgtggttgcaagtgacaaaaaaatagttctagcaaaaaggaatttttttttgttcatatatctaaaaagtccaaggatatctgacttcaggtatggttggaacaaggaagtgaaacaatgttgtcgtacttttctattctttatctttgcttgtctcttcttctttttgttgatcttatctcattctcttccatttcaaattagcttccctaattgcccatgggtaagtagctccagattttcttctttctagcaaagcaaacagtcttctcccattgccctagcagagaagtcctaaggaggacttctagtcatctcaaggtcccctgtccagtcttaaaggaatcagaatgcactgggtagcagactgcactgtaatggataacccagccatatgtaatggaaaataagttttcctgaacaaggagtaggatgagaccagaagaaaaggtataggagaaaaaaataacagctatctgtgtgaacctcaggacaacctcagctcagaggtctgcaccctggagacctctcttgcgggtgtacttagttgaagatgaattcggaggtcttggttttcctgagttttctttcctttgaggttagtcccttaggtctggaaggtcactatttgatgtaataagtgatgggtagactgtttcactgcagatctaaagaagttataaactgcagttgtaacataaagtctgtgatagccttcagtgggtcagctgaccaaaattatgcacagttttgtttctatctgtattttctgagaagaggatccgtagcttccctcagattaaaaaacttctggtgagcccaaagattaggcagcttcccatgtttctcaatggggatacataccactgaaatttggacaagaaaatttgttattgtgcaatatgtgtagtgtctctggcccataccccttaaacgtctgtaacatccataagttattatgacaacccctcctcccatattccaagcactgataattgagagcccagatgagattagaagtctagactgcatgtttccttcatgtttgatctttcttctttctctcccagagaacatgaaggaaacacgttttctttgtttgcttttgacagctaatttccagcagtccatctattaaggaatctaggatcccacttttatgagcacaaaactcccactttccttaggggtgttctcaggtattctgacatagtttaatagtttcaggggagggcctaaaagtcgtatgttggggactaatttttattctgaaaatttggtaattgctactgcaacatagtgtgccttctgcactttttccaaatcaccttgagaactccagccctaacatcgatccatcctactggatgtcttttctgatgtgaaattaaaatgtttcagtgggaggcaagatatgcaaaggggtaactcctgggaggtgcccagttgtcactgtagcctctttagaattttctcctaggacagtcatttagtttattaattctgaaaggccaaacaccaaaatgagatgttaatctgaaaggaataacttcaagacctaataaagaatgaccactgagcagagtttttatagattgcaaatcactttctcttacatttgaccttgcaacatcttctaaaactggtttgccaatctcttcttttatggatgaagaaatggaggcttctaggaaccaagtgacatgctcaggattgcacagctcttcttagaaggactggggatttcaactctgagtcttatacctttaaatgccactgtaactctatactgcctccctgatgcctcaaaacacttttgaaaagaaggaacacgtcctactggagctaatcagagggaaggactagaagtacaaatgagccacaacggagagttttaaaattctcttccctaagtgagttccgggaagctcgggaaggggtggacacttgtacagttcacttgtacatcttcactcctgaaatgctaggacaaatctcatttgaactcccagtcaactgagaaattaaaagcagagagcaacgacgctattttgtaactttgtgccttttaaaattaaccgaatctttcaattgctgctgtagattagaagtggctacttggataaaggggaaagagccattcaactgatgaatactattgtaaaagtccagacttagttctagaaaaggaacgcacaagaacaatttctccaataacgttttcattacagagcgaaggaaagttcttcctcgttgttccaatccgaggacaagctgatatgtcgcagcagcccagggaagcatgcgagctgataggaagtccttttattttaagacaggctcgaatgctaaaactttcttgtgccaaaacccttgactattttatttttaaaataagcacttggcgtgccctcgcagatgtctgagctgagaggtcggggcgatggtagaagagcagtcagtgtccgttcttattcatattaagtagccaagtctgtacccttgaagcaagtggggagagaggagggagaggagctgctgacattgacaatgaatccaaacaggagttgcactagcggtgtccaccacgttgcctctcccccgcctggccttctgggagctgtagttttcgtgggagcggctccccaggcgagctgggaatgccccgcccgggccgaactacagatcccaggcggcgctcggcgggcccctcccgcccgggtgcgagtgtaaactccccgcgctggggcgggcgccgcgagccggcgagcgggcagagctcggcactgccggggcgcacggctcgggggacccaggcccagctaccttccctccgcccccgggctctgttctcactttccagcagtggaaggacgggaagcgggagccatgcagtccgaatcggggatcgtgccggatttcgaagtcggggaggagtttcatgaagagcccaaaacctattacgaactcaaaagtcaaccgctgaagagcaggtgagtggtgacagctgggcagaggcgcaccgggcggctggggggcactgcgtctgccactctggggcgaggagagcgggtcgcgggagctctgggacaaggacccagtgcccttgccccggagcagagggcgaactgcccctcgcagttgggggccgcgcctgcccggcccaagtgcgcctttaggaagctcggatggagcgcacttcgcgggggcgcggcgggtcgccggggacgaagcgtccaggcgcggggaccctcggccgaggatgccagctgctgagactgattgggggctggggagcgacctggcgcgatgtgggggaggaggagcgccgggccgggacgctgtcccggtgggatgggggagaaagagttctagtgaaccccctttctgaagatcccagcgggttgagggctcggagagggagagctttgggtggactgagatgcgacattggagggaagcaattagttcgcttggagtcacctcttgggagtccggtctctgtggggaaactagcctctgggctcctgcaggtgaggtttctctgggctccgcctctcacctccagaccgctgctagcgggcgcgggaggggccagggcagcggtgggcgtgtccccttgttcaagttaaactctctggaaatagagtcccattcaaatccaggccttacctgcagaggggaaatgagccttggtcttgggggttactgggagtgtaccccgcttggcagagacacgtgtttaattcgctggggacttcagaaactttttagacgaggagtgaagacatccactgctctgatgccccatcccctctagtgcccacttcccttgagccaccctttttgctgcctccattcccacttgtctgtcgaaatggattgggtgtcttccgttctctctgtccggcagccactctggacgcctcgtacttctcgtttacaatgtttcctaaaagggacatggtcaatggaggctggaatagctgagaagggtttatttccacccctctaagctgtgagctaggataaggctatcattggaagcatccagcagggcttctgcactcggctgtaacttcctgccttgcccttcgctgtggatggggcctgggtgaatgggcctggctggcagagtgggagagggtcttgaaatgagggtgagtggagaagggcaactgaacggggagccaagtggtgtaatcttggcctctggcgagcactgggctggttctttttctagtggaaagtgcagccaggtttatttccttcagggctgtggcaggactctttatcccagttggggaagaaaatctgggaacagcggtcctactgactgccattgctgaagactctttgtagatgcttcacggcagattggaaggaaaccgcctaagcagttggacgtataaaaccagcctttagttggtggtttttcctcataatggctgttttgtgtgtgagcatagattgtgtgtgttgggggctgggggttttgagtaatattgtgtgaagggtattgttggttatgctcatcagggctttatctgcattcggctgaagggaccagtgttttactgggcagtctctgcttttgcttctataagcaaatgcttacacggccagaatgagggaatgagtgtgtgtgtggaatcctgaaagaaataaattaaccggactgtttggaacatttctgatggtagctgatacataacattaaatcagtttgagagagcgaggaaaataccatctggaaaaacccaaatgagtgccgtgaaactcatgttgcacgatttgggcctgttctttttcagagtcagcaaaaaagacttgtaagggtgaacgtcctcagtagctagctagcaggcacgtgtaagggaaaatgtgggtatgtgggaagaaatggcttcacacgttaatgctagaaacaggtgtgggcctgaaccagcagggaaaggaaggctaaattaaaaaagttgttgtaaaacttgtatatggagcacacacatgctctttgaaataaaccagttaaataaaatctgtgaataaatatatggagttggcaacatttctctatactgttttccacagttgtctaaggtattgtcgtcgacatctgttgtgtgacttaaaagggctgcacattgttcagggccttctctctcattgctttttgtcttatgtttttgctggggcacctcacttcttacaagtctttgtcggaaaaagttgaaattgatatgtgaagactgctgtagccgttctgcctatcaactgtcttctctggattgtccagagttgttagagttgaaaatatgtccagaatctgcccgcttcttaccacctcctctgctaccactttggtccaagccaccatcagcccttgcctggattattgcagtagtcttttaaactgcaatacccacatttagtgaattttcagtatagtagccacaatgttcctgttaaaactggttctcagttggaggtgattttgcccctggggtcatttgacagtgtctggagacatttgtgattgttacagtggaagggatcattacccatatctagtaggtggaggccagagatgctgctaaacatcttacagtgcacaggacagcccccacaacaaaggattatctggtcccaaattgttagtagtgctgaggtcaagcaactctgtgttaaacctcaagtcagatcctgtcattctctgcccagaacctgcccatggctcctaatttctcccagtaaaattcaaggttcttaagatgtcagctctgaccttatctcttgttgcctgcctcctacctccctctgctacagccaggctggtctcctcactgtttttggaataccccaggcccttccaccactgggcatttttatattgcacttgccttgatcatcctttgcccagacagacccagtgctcactcccccaccaaccagtatgtgcctgcctccaggagtcttaagaacattaagtgtgacgttgactgtgggaaagtattagcatggtgcctggcacgtagtaagtgctcaggaaatgttagcagatgttgttcttgttattttctttacagttcattctttaaacatcattcccatcacactgatagtgtggcccttttttgaccacagtatttgcgattgctgttcctccaaattctctgtcttctttgtccagctatatatttttttcccatagggcttatattataatctactgtataattttccaatatgttatgtttattacgtgtttctccatgctagactgcaaactccaagggaacagggttttctgtttgttccttgctcactattgtgtccccagagcctagaacaaagtttctcaacctcagtgctattgatattttgggccagataattccttgttgtggagggtcctatgcattgcaggatgtccagcagcatccctggcctctatctattagaggccagtactcctgcctctatcaattatggcaaccaaaaacatctctgaacattgtcagacatcccgtggtaggcaaagtaccctcatttcagaaccactggcttagaacaatgcgtgacacaataaatatttgtttgagtatgtgttgctttcttccttaataccataacccactcaaggtatggtatttggttttttgtttttgcaatgaatattgtgtttcctttaaaatagatacctactaggctttctccaaagaggaattcatatattgttcattggggctaacctcagatattcaagtctttcatgaggaaggacatgtttcatttctaacccagacatccttgcctttaggaatctgaagttgctggatttagattatgtgaatctcattttggtcatattggtggttaaggctgtgtataggaagacacatgctgtgggaaaaggttccaatgaattgtttgcacaccgtttcctccgacaaggttttagaaaccttgtgttctcctgggaatgagttctgaatggtgggtggcagaggaaaagcgctgaatatctagagtgagcccagaattcacataggcatagtcatggcagggaaacaaatgtgaaactgttgaatgagctcctaggagcagaggaagtctctacaggtcttttgtacccaaaaacattttaaaccgtaggagcatctttcaggctcatagtccttttgtttggtttactcagtccacatggctttgtagttgttaatgtccttttcctggacagacttcacagttggcttagtttaattccaatttcttcttaaatctttagtactatttagacagctgttattacattttctgcaaattagaaatgggaatgaaagtgagtattagctttatcatggcaggacaggatacagcagtgatccccaaatgctgattcacaaaggtgtgtgaacttttaaaggtttgggtgaaatgagaaagacaaagactgttgcgtcacacgcatacctacatatatttgggtgtaaggccgctgccatttcttggagttatgctgagatgtttttctcctgtcttcatattaaaaaatgccctttctttgatgacataataatccattcttggcaaaacaaaactgtcaatcattttttgatttctgaaagttttcttgattttttttttggtctgtctaatctgcagggaaccactagcatagagatgaagagccttgttctgccatcgatgtctgtccctaactaactgggtgaccttgggcaggctgggtgacgtctaatttcagtttcctcatctggcaaataggggcctgcctccagtagtctcaagaatataagtgttacattgactgtgggaaaagtattagcatggcacctgacacacagtaagtgctcagtgctgacacatagtaaatgctcagtaaatgttagcagatgttcttgttgctattttctttattacctagcagcgaacctggcattttggaaggtgttttgcatttgcttgactgtggttgtcttctctaaggcaagtgttgttacgcaacacagttctttgaatgttagtaaattcctttttgcttttcttctaatgaagtgttcagataaatattttacactttgtatctttcatttaatcataacaattcttttatgctagttaaaaaaactaacaattttgacattagtgtatccataaaaattcgtgttcaacacatatttattgagtcctagtatgtgcacattaatactaataatgatgggtcacatttattgagtatgtactatgtgtgagccccattctaagtgtttttacgtgtgtaaaacctatttaatctttgtgaaatctgcatgaggtgatcataataaataaaaacaataatgatattaattataattttaaaaacagttaagacttatctagtgcttcctatgtgctaggcactattatgaatattaactctatattaatgctgttaattcaaccttgggtgtatgtaatagtttattattctcattctacagagagggaaactcaggtatgccaagttggtggggcctggagttaaactgatgcttctgtagctacatgctcttgtcctctagtctgtactatgcctggttgattgtgcaaaattcaaagatacatcatactgtgccctccctgtgtggtgagggaaagagaactcatgggtccagctaattatacaaggcagagtgtggtccctgtggcagggtgggcatcagcagttgggggcatttaacagaggaaggggaactggggaggcagttttgtggacaaataggggtgtttgagtttggccttaaaggtgaaacaatagtcaaatgtgtttctctacactaagtaaaatgttagacatcttggagggcatggtcctaaagtagacatttagggtttccgtttgccttttaaacttctaacctttctttaagctctttcttgtggtctccaggcacctgatgatacctcatggtggcagagaggctgcatgcatgtggacaggtttagagggagccctgcttaagtgctgtctgtggtcgctgctttgccacttaaccagtacatctgtgttcaagaaacttaacttcttggagtctcaatttctctaagctgtaaaatgagatcaatagaacccacccccttagggttggtagaacttttaaaactaagcaaaaatgtataaatgtgtttaacatagcacctagcactgttagtaaatgaaattaattcctccttttctagtagaattttactatggtagcagtttttacccttctcttaagaataactaaaacatatatagaatcatgcatccaaaacaaagtagacaagattgaggtgcctcaacctgcagatgttcaaatcgtactatgcagattcgttttgtggtatgattagagggaacacttgattaaagtgggattctcagtcttggtttcgtttgttattggagatttccttttcccgattactactatttacagattttacttaagttgatatatgtttaattccctttgagttctgcagtgcagtttgcacaggctgatgtttatatctgctccagttgtgcaagaagtggaaaatatcctttttttagaacagatcacatgtgcttactgtcaggaataggacctcagtgtaaaaaaatgtatcttgggacaaatcaaagttactaaatttccctctccaactgctttgtttcaggattggcagtattaggataaataataggaaaaaaaaatccttggctactttctttttgtcatctttcaaggacaataagtgagagtttcattttttttgtgtgtgtgtatgtttgtgtgtgtgaggtataaaatgtactttgctgagggtttgtctaatcggaataaattataaaaatatgtttgactacactccaagtatgcattatttggagaaaataatcatgaagacaggtcaaagatattaaatgcagccaccacaagcttttgatattataaaggcaaatttgcagtttataagaaggtttttgtgagtctagtgaacattgtgtactccgaggataggaattataccaagggataagtctgcatctttatagagacaaacgaggtcgagaagacccacagggaggtctgggatctctgttgaaatttctgcacctcccgttctattgcaaatgatcttgggaggaggaccaggtttggcttctcaatggtaagcttatttctctagcccatttctacaatgtggctttcttatttcttcgcttcgtctttccctcctgtggctttggatgcatgctgtgaagagtagagaagtagacctttggagtgttcacctgagacccctgtcctgggattcagagtgatgaagcttttatctttaatggctgacctttctggggacttctcaaggactgggtgctgagtgtcagtctctgtgctggccatagggagtccagtggagaagcagatgggttcctgctagcatggtgcatacatcttggaggtggcgcacagttaacaatgaaccaaatacatgagcaagatgagttttactaactgctatggaaattaaatggagcattattggtagaatgggcctatgaaagaagggggctttttattcggttgtatgatcaggaatgacctgttggaagaagtgattttcaggcaagactgaatatctgacataaaggcacaaatccagacactaccactcactggctctgtgactttggtcaagttatccaacctttctgaactctaattctctcttctgtaaaacgggacagttgccatcttgcaaggcttctgtgaagataaaaggtaatgtatgtaaagcagctaatattaggcttgaggcttagtaggtgttcagggttacccataggactgaagttaacatatgaatagtggaaaaagaagcacagacattaatctttgttataagtgtttataactcagtcttaaatgttttcctaatgttgagtgagtcagagattcatgcttgtctttataaacctaaccctggactaaaagaggagatgggtcttgttagttttgttatcctttctttcctctaggatcatcctacttgatgtcatcccttgttctcctgactgttgttgtcctgagataattaatgtctgaccatagtttttggggctggatttttaattacttttttggtgttaaggagaggcctaagtaattgaggattaaaaaggaaagcctgagattgatttcacaaaacatacacgcctaccacgaacaaataaccagtgtagaactcctgactcctagtcctgtgtttctgtcctgagatcatgcttcctgtccactctgttgtgaaaatgtcagtgttggtgcagaaacaaaaaagaagaagctctcctcccacataccacctccagtgttcaccaactttgacatccacaggaagtggcatgcatttaatttgacatctttaaaaaaatcttcaaagcatttggattttagtagctgtgttctttgattcaagtacccacagagtgataattttctttctttctttttcttttgaggtggagactcactcttttgcccaggctggagtgcagtggcatgatcttggctcactgcaacctccgtgcccaggttcaagcagtagtcctgcctcagcctcccaagtagctggaattacagatgtgttccaccatgcttgactaattttttgtatttttagtagaggtggggtttcgccatgttggctaggctggtctcgaacccttgacctcatgtgatccacctgccttggcctcccaaagtgcaaggattacaggcatgagccaccatgcccggccagagtgataactttcacaacgaaaaatactgggttgtgtgacagcaaatattttaagtctaagtgcatgccctatagagggcactggtagaatcctgtcatataagaaattgtgcctcattgagcaatttcaggaaggcatctgtggtcttcaccctccccacccttgcctcttctccaaagtggggtaacttgctgaatcattcacacacattcatcagttttcccatgtgattaagggcatcattggaaaagtggttgtccccactgttgggagaaagcatagcttgtatttgtagaataggtttccttctgggaaggttgacttgcctcagtggaaagaagacttgaggcagagaggtttcacttagcctggtggctgtggttatatatgaaattacgaaatgacagacaggaatgctatatttactttggtacctttaccataaaatattcctaaatactaactgattctaggaagcatgtttttcaaaaacatacattttattttttacagttggagatttgaaatttggtgaaaggaaatgctcatggaaatcctaaagatgatttccttgtttaactcaggacctagctcaatcctggtgaaggctactagagaacctcattgagatgtagccacactgtacctcttgcctgcagtgtgtcctaaattcgtagagatggtgctctaaaactgagttcatgaaccaacacacagatatgtcattggtcaaattgtaacattcccttccatcaaaaggactaggtatatatttgtcattgttttgttttgtttttagcatttgaattttttcagcgaaaggtggaaaggtattatttcagtgttagttttgctctgctgtattggtgagcctgcatagttgcaccatctaaatttaggatgctggcacctcagccaataagaactctttgtaactaatttataatgcttttggcagagagtgcctagaataaacattaaaatagtgttggccagttaaggtcatttactttcaagggaagagggtgaccccaaatatgcattcttgaaaattctatttatttagttttaaaggaagagtttacaatagcttatgtgaagcaatacctaaaaatataagcaactggcatgattcctggtcacattccgaataaaggtttgtccatttgctgcaaagaagcatgcttggaggataacttgtaagaggtcggccactggcttatggtatattaaacaaccagtgtgtagactttttggaactgcatcttgtatcatctcagcgtggtaatttttccactggtctttgggtaggtacacactaataatattttttatctaggcaaatgcgagatgagtaaatgctaaatgataggattttggaaggtaattctaacaatactgattatatttggaagctttaaattgttgattcagcagtgaatgagagagtttgatggtgcttgcttggtcataatatcaaaatcactaaagtgcatgatgtaacggcagggagctgaatggcaaggacaattaattggggtttgtttttgggaatcaatgataccacatgtcaatctgctgtccttagggagtctctccctagtgttacccctctttctcacttttgggttcatatacctgatacctttctaaaaaagtcaatttcatggctccaggagtggagaatctgatacaggcctggctacatgtccttatcacagggattggtttcacgggggtgcacattgttcaaagtgaatcccaggattttcttgggtgctaccacaacagtaatatagatctgataacaaactttctagaggaaactatagagctttccttttttttttttttttttccttttttaaaaaccagtgagtaattattatcaatgattatctctggcctgacaatacaagtgacactcctttttttttttttttttaactaaatgtattctgatctggtgaatttttcattctaaaataacaatacaagagtatttaatatggagacatgagatttgtggtaaaatcattagggcagtggttcttaaactcgagtgtgcatcagcattccctgtagggcttgttgaaacagatttcagggacacactcccacagtttctgtttggtaggtctggagtagggtctgaaaatttgcatttctgacatgtttctaagtgatgctgaaactattggttgaatcacactttgaaaaaatcatggcactaaggtggtggtgatggtgttgggagtgggggtgatttgctcaatgaacttgtgatagaaagcattgcatagagatgggatataaataatatataagcttgggtgacagaatacccatatttgccgtgtttaatcagaaaatgaatttattggttaaataacagaaaagtctaaagatggggctaaccaggccttccatggataggattcttggttgtataatgtgatctctgagtgacttagagttaacctagctttactaccataaggagccctggcccaaatctcaaaaaggggttgtattttaatctacactctaaaagtgtgaaacttgaagcatactgcagtcacttgactgaaagatttggttgagaaacagggtgatggtggttttgggcatgtccacatgaccaaactgtttttcacaaaacttctgctgaataaaatttgaaatactactgtcagcctgttttcctgtcttaatgaattccagacagtttgtagagtgtgggagcttccaaaacagagaggtggaatggatgtgaccagccagcatctgttttgtcacaaatgaggatgtcctgacataatggaatcgttccccttgttctgaatctcaccaagctgttcacttctctgatcatgaagtacagactgtgagagggaagggcaaggccaatgtcatgtaacacaagccaaaagaaaatttctggattccttatttaccaggaaattcagcctacccctgtgtttcatccacttagacccaagcattttgatttttttttttttttttttggcatgttgacattctttagagaaaaagcgctgatctgttcttgttgtaaactggttaagacttctaaccagtctaataagtctaaatttcagagtaagacagatttgaacttaaattccaatttggccacttactggctatatatgtgtctttgggcaagttattcttgtggcctctgtttcaacagaggctgatatggtttggatctgtgtctctaccatatctcatgtcaaattgtaatccccagtgttccaggtggggcctggtgggaggtgattgggtcatggaggcagtttctcatgaatggtttagcactatccccttggtcctgttctcataatagtgagtgagtcctcatgagatctggtcatttaaaagtgtgtagcacctcccctgtcattctctcgctgctgctcccaccacgtgagatgcctcactccccttttgccttctgccatgattgcaggtttcctgaggcctcccctgaagctgagcagatgccagcatcatgctttctgtggaaccgtgaagcaccgtgatttaatcagcccatggaaccatgagtgaattaaacctcttttctttataagttacccagcctccggtatttctttatagcaatgtggactaatacagaaaattggtgccaagaaatggggcattgctataaagatacctgaaaatgtggaagcaactttggaattgggtaacaggcagaggttggaagaatttgggggactcagaagaagataggaagatgatggaaagtttggaatttcctagagactgattaaatggttgtgaacaaaatgctggtaatgatatggacagcgaagtccaggctgaggaggtctgagatggaaatgaggaactcactgggaactggaataaaggtcacttttgttatgtgttagcaaagaggttggctgcattgtgtccctgccatagggatctgtggaacttttaacttgagagtgatgatttagggtaactggcagaagaaatttctaagcagcaaagtattcaagatgtagcctggctgctcctaacaacctatgtttatatgtgtgagcaaagaaattacctaaagttgaacttatatttaaaggggaagcagagtataaaagtttggaaaatttgcagcctggccatgtagtagaaaagaaaagcacaatccccttggtcctgttctcataatagtgagtgagtcctcatgagatctggtcatttaaaagtgtgtaggacctcccttgtcattctctcttgctgctgctcccaccacgtgagatgcctcactccccttttgccttctgccatgactgcaggtttcctgaggcctcccctgaagcctccccattttctgggaagtaattcaagcaggctacagaaatttgcttaagtaaaaaggggccaagtgctaacatccaacacaacggggagaaggcctcaaaagcatttcagagaactttgcagcagaccctcccatcatgggcccagaagcctagggggactgagtcgtttcctgggccaggcacagggctctgctgccctgcatagccttgggacactgctctccacatcctagttgctccagatccagctatggctcatagaggcccaggttacactcaggccactgcttcagagggtgcaagctgtaagccttggtggcttccatgtggtgttaagcctgtaagtgcacagagtgcaagagctggggcttgggagcctccaactagatttcagaggatgtatggaaaaacttggatgtccaggcagaagcctgctgcaggggcagagccctcataaagaaactctactagggcagtgcaaaggggaaatgtggggttggagcccctacacagagtccccactggggcattacctagtggagctgtgagaagagcactgccatcctccagaccccagaatggtagatctactggcaacttgcactctcagcctggaaaagccacaggcagtcaatgccagcccttgagagcagctgcaggggctgaaccctgcaaagccacaggggtggaactgcccaaggccttgggattgcacttcttgcactagtgagccctggatgtgagacatagagtcaaaggagattattttggagctttaagacttaatgactgccctgctgggttttggacttgcatggagcctatggcccctttcttttggccaatttcttcctttttgaacaggaaaatttacccaattcctatacccccattgtatcttggaagtaactaacttgttttttaatttataggctcataggcagaagggactagccttatctcagatgagactttggacttttgagttaatgctggaataagttaagaatttggggactgttgggaagccatgattgtattttgcaatgtgagaaggaagaaggatatgtgatttgggggaccaggggtagaatgatatggtttgaatctgtgtccccaccaaatctcaggtcaaattgtaatccccaatgttgcaggtgaggcctgatgggaggtgatttggatcatggaagtggtttctcatgaatggtttagcaacacccacttagtgctgttcttgtgatagtgagtgattcttatgagtgtggcaccacccctgttagtctctctctctcctttttttttttttgagacagagtctcactctgtcacccaggctggagtgcagtggcatgatctaggcttactgcaacctccacctcctgggttcaagtgattctcctgcctcagactaccgagtagctgggattacaggtgcataccaacacgccatgttggccaggctggtcttgaaatctgtcccccttggccggccaaagtattgggattacaggtgtgagccactgtgcctggccccctgtcactctctcttgctcctgcttccaccatgtgagatggctcactcccactttgccttctgccatgattgtaactttcctgaggccaacccagaagctgaaaagatgtcagcatcatgcttcctgtacagcctgcagaacagtgaaccaattacatctctctcttttttttttttgaaataaattacccagtctcaggtatttttttttgtagcagtgtgagaatggactaatacagaggctaaaagaggacagtgcataataatatgatctaagtgatagggtaattgtacagattaaaagaaatacatgggtagagtgctcagcccaaagcctggcttttagttccctcgttctgattacctctgtattcacagcatcaacaaggtttttgacttgaatttctagttttagacaccttaataaagaaaaaacgactcaaaggcaatcagtgtgggggttggggggagaggatccatagaacagtggggaggaggaggctaagggagggaggagggtaaatagtctttaagttaggtaatcagcattaggatttttgggagttgatacaggtcaaatagtggtgaaaggtgggatgcctaacaggaagatatttaaggatggcacatgctatttacaagcatggtgttacttttgttgccagaacaatttttgtctttatcaacatgtttcctttcatcataattatagactatagctaagtggagaaataaataatgagatacactaattggggttacacaataccaaggctgtgtagcactgctgtctcaacacagaaatctcgaattcctaactgtcatgtttcggccttggccatagtgacttcctaccttatcttttcccacttgacttggcagcctgtttatatagttatctttatccaatataagccataaggccctatattcttgagcctcaaaatctttgtatcttttacccttctgggtttttttttttttttttttttttttttgggtaatagcagtatatagccactttagagactaggatataagttttcaatgtttttttctttccccgacacgaatatgatagtttgcttttcttgattgtcacacaatttctctcccgaaaactgtggcttaactggtcactagcaagcataaaggggaaaaaaaaagcagaaaggggggttagtccaaatagtatccatctttctcaggggagagatttcgattatattacacatgtatgtggataccttcatcagttacagtttagtcattgactaacttggacaactgggtgcctacctcattgaatagttgtgaatattcaataaggtgatgagatgctacctgtagtaagggtgcagtagataccagctgctgctgctcaccttactgctgctcctcctcctgtactatgattattgctctctgcctactgctgttttgtgctactactggtgtcattgctactagaacttagaagtttgcataagaatggaagaaatggttaatcacagaaacatttctctgtgcaggtggtattgactctctcattgccttatcactgttgagtaaataagcaacagtttggttctctatcgctgaaaaaactctaaccacatagtcaattctcaaatccttggggtatatgtggcaagtttttttttttaagttctaggatacatgtgcagaatgtgcaggtttgttacataagtatacatgtgccatggtggtttgctgcacctatcaacccatcatctaggtttcaagccctacatgcattaggtgtttgtcctaatgctctccctccccttgccccacaacccccgacaggccctggtgtgtgatgttcccctccctgtgtccatgtgttctcattgttcaactcccacttatgagtgagaacatgcagtgtttggttttctgttcctgtgatagtttgctgggaatgatggtttccagctttatccatgtccctgcaaaggacatgaactcattttttttttatggctgcattgtattccatggtgtatatgtgctacattttctttatccaatctatcattgatgggcatttgggttggttccaagtcttcgctattgtaaatagtgctgcaataaacatacatgtacacgtgtctttatggtagaatgatttataatcctttgggtatatacccagtaatgggattgctgggtcaaatggtatttctggttctagatccttgaggaattgccacactgtcatccacaatggttgaactaacttgtacgcctaccaacagtgtaaagcgtccctgtttctccacagcctcaccagcatctcttgtttcctgactttttaatgattgctactctgactggtgtgagatggtatctcattgtggttttgatttgaatttctctaatgaccagtgatgatgatcttttttaaatatgtttgttggccgcataaatgtcttcttttgagaagtgtctgttgatatcctttgcccactttttggtggggttgttttttttcctgtaaatttgtataagttccttgtagaatctggatattagacctttgttagatggatagattgcaaaaattttctcccattctgtagattgtgtggcaagtttttaaacctatcatagcactgggttgcagcccaggagtcttccagaccacttcccccaactatcagctgttgtgtgcataggaatgagattaccaagtttgagtaccaattaaaggaatgcatattctatcagaatccatatatatatattcatacaaacatatgtaggattctcaaggcagtgtttttcaaaatattttcagactttctccagtattcttactaaccaaaacttgactcttggttaaacagttcccattcagagttttataagaaaagaggaaaaatgaaattctcctctttctgtgattgaaacaaaaagacaaacacactgaagaaactgacatagaagtaggtgctttagagtgagtggttatgtgttcagagaagctgtaagcacaggagagaagacagttggggaggtttggtcagaagtggaatggtgggatgagcttccgaactctgcattttagtgagagtacaggataaatctgctgtgtaggctggtgttgagagttaggacaccctgaacttggggaagagccagctatcagagatgaaaaaaaacagtttgggacattttcagaatagatatatttcttgagtatctaaatgggtggacggtaagagatccgacttttactcttgttttccaggagttatggtttgagaattatgtgtaggatcttcgggcaaattttcattgccttgtagtataaaaggattcttaataaatatttgttgagctgaggataatggggagcaggaagggtcaaacttgaaccagtgttgcctgtggaaaatgggtagctgttgagtgatggtgtggatcccagatcagaccctcaaaggccaggggaggtctttctgggagaggaaaagaacctggagttaccctagggcatgtgtgtgtgtgtgtgtgtgtgtgtgtgtgtgtgtgtgtgtgtgtctatatatataatactctcttccaccactcataaagtatatatataaatatatatatatatatttatagcgtgtgcacacacacacacacacacacacactttcccagcactcagaaatatatttcattttatttacttttttttaagacagggtctcactccatctcccagattagagtgcggggatgcaatcatagcttcctatagcctcaaactcctgggctcaagcaattcccctgcctcagcctctcaggtagctgggactacaggtgtacaccaccatgcctggctaattaaattttttttttctaaggttgggatcttgctttgttgcccatgctggtcttgaattcttggcctcaagcaatcctcctgcctcagagtcccaaagcactgtgattacagatgtgagcctctgtgcccagcctggaaatatattttaactggtgttcactgaagatggcctttagctatcacttttttaaaaggctttatttttaaaataatgtatcttttaataaatcaaaagcttcttatgtatcaatagcccaatccggtaatacttattttattattggttagttcccatgggaacagggaatttgttagttcactggacatctcaaggttccaggatacagagtgtgtccaataatgtttgttgaataaagaatgacctagatggctgaagtgtttctggtgtgctagaaggggtcagtaaattttggaaactttgctaaaccctttcaggaaaatgtgtaagaaattatcttaccttttcttttgttagctatgagcccttgccatgtgtttctgagccttaatatctttacctataaaatggagctaatggcatgtccttcttgggataactgtgaggattatagaagataatatgtaaaatgactggcatatgtacattctcaatacaaagttagtaggggtgatgattgttactgctattggtgctaaagatacagactgctaaaaatacagtcaattctcattatttttgttttataaagctgctacaaataccgaattagcaaatactgaatgattactactagggaaatacaggataagttccttagagcctctggtcgcaacatttaatcaatctatcaatacataactttgttttatgtgtgtttctgtgtaaagacacattatttaatatatattgttgattcattaacgttgaacttgtggccagcagcactataacctgactgacttaggaacactagacagcactttcgcactaaactttggtgccatactgaatagaggagtcaccaacaaaaacacacaaaagtgcaaaaaatgtggcactacatagactgtgaaaaggacacttttttacaatatgatgtgagagctgaaatgagaaggcagaccaataccttatttaacctcaattggtaacgtgcatgttgggggactcaaacttcttgctgttctgtgcacgtgattgactgtaaaaactctgagaatgttgattttgggtttacaaatcagttttagtgagtaggtgaatttgaaagtggagaatccatgaataatgagggttgactatattaaaaactgttttcttgcatctgtatttctctagcagttcttcctctggactaaaaagcttacccactggggaaaacattttaaaacactatctgctcagatgttgtggattacagagggagccacattaataaagcttttccaggtacctgatcgctctcttttttttttgagacaaagtctcgctctgtcgtccaggctggagtgcagtggcacgatctcggctcactgcaagctccacctcctgggttcgtgccattctcctgcctcagcctcccaagtagctgggactacaggcacccgccaccacacctggctaatttttttgtatttttagtagagacggggtttcaccgtgttagccagggtggtctcgatctcctgacctcgtgatccacccgccttggcatcacaaagtgctgggattacaggcgtgagccactgcgcccagccctgatctctcatttttatcagtttgtttgccaataaaaatggcccatcacttccagatctttaaagttgactgaggcttcactgttcagatatggtagaattttgacagatttttaatcattctttaataaggtggagtgtgaggttggggacccaggaaaagaccacagagagattatggaccattgctgaaaaatccagcaaaaagcagtaggattgacagagggcaggtgagcccccagattggggcctagcctgggagggttcttggcattgctcaggaaagagttcaagaacgagctggtggtggaagaatgcaggtctagtgaagcaacagtgtacaacagagtacctgctccttgcagagcagggctaacccatagacatgcacccagagtagcagcgtatggactgtagactggcagtatttatacccacttggaattacatgcaaatcaaggtacaggttactcagaaatctctagaaaaagggtggtaacttttgggagttgccatggcatttgtaaagtgtcatggcactgctgggagtgtcttatactgatgagcagtgagggcacctagaggttgcctttggtgccatttgctagttctggtgggtttcttcatttcttcctgtggagaccaggaaataagcgctggtagtctctacttcaggatggcttagaaattctggtgtaggcagtttttgaggtaaccaggctcagcttactcagggcctagaggataaaggtgatgattttgacttttgcaagcattggaaattagcatattatagttatcagaatggtcattattgtaaacattaactgagtacttgttgggattgcttggaattcttttagaaagaaggagaaaaagaattggtttcagtaggttctgtactttcaagttacatagcagatagatcacacaatttagtgacaacagagcacaaagaacaataataataacagtagcatctagcatttttaaagccctctttacagatatgccttgtgttagtgctttagcctatcttttatatatttctatagtattcttacagattatactggagttaaggaaggtacctatgtaattaaaaaaaattctttctgtgttagaaaagtgaagaaacagaaacatcaggaattaataatttacatctaggtgaattataaacatagtaaggcacttactatctaccaggtacagtatttaagtgttttatataatataattctaatatgaggtagataggatcccattttataaatgaagaaacttgtgcttgtctgttttctgtcacttgtctatcttaagttactcaaataaggttgaaccgcgattcaaactgaggactgtctgacttcaaagctcactctcttattcaccatgctggcagtggtttccatgtattttggtgttcggaggtttggagggagaggcaggagtgatcaggagtgacaacttatgttgatttttgaatggaaaggagactaggtttcttatgaagtaaaggcagaagactcagggtgtggttgcacattcaaatccaaaacaaatagttatatctattaaaggtgctcacagcatgcctgtctgcatagtcctttgtttctaaagctgcttctgaaggaggaaaggaggtaggctgtgaatcctccaagaaaggtaggaaaagatgggatggtggatacttaatcattcacaagggtgtggtatataagtaagtggtagattttcctaatttcttattaataatcttcaaatgttgctacttgatgacatcaagttgtcttgtctacatacccatccttgtgttctactactgaacatgaacatgtagctcataacatctggatgtttttcactcatctctttttccctctctcttttttctgctaacctgacttgttgattgctatttttgtgtgtcttcataaatttatagccagtctgttccattctggactgtttatctttggcatgccagaggtctttaaacatcataatgttgtgtaatgagcataacttctgccttgacttgtgggtgttaagagcattagtcagtgcaaagtattgagttaaatattttcaataaaaggatataatgatctagcagagaagaagttataaaaaatcctagttaatggctttaatggtgagccatatatttagtgggttctatcagtgatgagttagagattcacagaatgaatgtaaaagcattcttacttttaattaatgagagaggagaaagaaaaacaataataagaaaaaaaggacttgattctcatccataccaagaaaagtgtaaacatccaagttcccagtgattctaaccctgattcattaccttgcatgtgtctttaactaccacaagaaatgtttaagatttccattgagatattatcgacagggactcctgggctgcatcataagcctgattgaaagcctttagccttgtaatgatctctttttggaggacaatcagggaattctttgcacctttatcagagagtcagggctttcctgagcaaacaaactaggtctttacctatggagctgattttatgaagagttttggtcagcattagtcattgtgaaaccatgggcctcctgccctggtttatctcgacagtcatctccctacagcagaagattgaatcctcatctctccatgagtctgagcatctaaagatgttagaggtacattggtttgattcttgctggggaatgtgtagtgggtactggtcttctgggaatagtgtctagatgaatgtttaataatcagtttaataggttgatgggctgtcttatttcctggggttggaggtttaaaccaggacaccctgtgctaactctgctctttaccttgccagcaatcctcagtcgtcctggtaaacaacctctgagttaaataccttttcttttctggagaggttaccaacaaaggaaaaggctttgatgtcagaacagggggcataaacagtgtttatggctgctgttaaaaatttctcatctgggtattttcaaaagaattccaagtcaaaatatatcacttatgggaagtatcttcttttccaatatgatatcttatgaagttgataattattttcatggtttaagtagtaattgatgacattttgggggttggaagatttgtgggaaggaggacatagattttcatcagatgtccttgcgtcctttccttgcgaggattattgatctctagtcttcatatgtaaggtgttgaatttatttaatgttattaactgaatctatagataaagaggtagttttggagccaagtaacctgttgatgtaaagtctattttaccttttatgattaccatctagcacctccctccttcctggctgaattccctgtcattttaagtaggcagcaattactggtttgctaaagaagccagctcctgctgccaaggatcctgttaattatcactctatctctaatttagccttcctagtgttgagagaaggtgcacgtaagcgtgtggcagaacgtctgcaatcgcatctttgtaataatctcctttctgagacggttcagtggactcaatgttccgccaaagggccaaggcagccctggtgagtgttttcagctctcttctgtagcttgtttggtcagtcgagtttggtgtgattgtcctctccttttgcttctgacctaagtaaaagctaatggttggcattaatcttgggaattcagacctattccgctccatctctgaagtcaaatgggacaccttgaaaatacttcagtggttttcccacgagctattttctctctctgtgaaaaggaaaccaggaaattgactctgtgcctgttttcaagaaggtaatacagatgataaccaaagtacctcagtttacaggttcttatatagcatgttttttaagggatgtcaatctttatatcgtatgaaatctttggttcttgttcataaatggctagattgctttctgtttgttttcggaaatgttcagttcacttgtttcagtgaacattttttcagaagttccactggatcatttgattaggtttggagtgcttatgcttccttttccactttttatgttatttttggcagtgttggtatttgaagctgtagaagtgattcactgcaaagtgcattaattttccacatttccaaatgcattttccagtggtccccaaatttcttttcctcttctcagatgattctgcagttgtccttctgtcattctgctggctcaaacataaatgctgatgtcactgaatttcttaaattacagctggtggggattaacagaaattgtaaaagaataccacttcctcattttgctattttcttgactaattattgtcttttcaagtactgtaggaacatagggatttgaaaatgaattctttgtcttgcagtttaaacagcaattttccttttcctttttctgttatacttcaaaaataatgtagcgcttaggatgcttttctgatgtgccctttaataaccccagacagaggagtctcactcctgattttgcactttggactgtcttctaccctgggtgaagggttttgaatacttcccttaagtaagtttccttatatagaatatttttactcaacagtttttctccgactcaaggccgttactggtattatgtgaaaggttgtgattaatttatttgtttgttcagagcctttgctcctttaaggaatgcttagctctgtcctcatcattttcttgtttaggatctgtgttatttgtgacaattttgattgctccagccctctacacattaatttttctggcttgcctctccttgttttaacagtgggagtctgggcctcaggctttcttatcacttggtttgtggtttgagtgatggttccatgaaccttttcctgggagttctctgggctcctgtgctggacgctggaagccatctggaagtgtgcacacaggatggctgggtgctgctgggtggtattgattgaactgcagtcccgtggaaacagaaatagaaagggttcagcattcccactttcctctggtggcatttttgcttattttgtgtatttagaaaaggtagccatatgcaaactgctgacttactattttccctggaatggaaaccatttggattatttcaatgagttttagcgaagatttgtttgttcacagtattagttttgttttctggtagcctgtttagaataagaccagaatgtgtctttttactttatggaaatgagtgcttacttggtgtttggaattttgcaaaccaacatgaatttgaaaagtcatatgtttattccagagtcaaaatagaaactctttagtgaaaattatagatatttccatcttggatcatttactttctgtgaaaaatttttttttgacaaaattgtttaagatttcagaggaacctcttttcctggttaattttcccacaaattaatttccctcatttttaaaaagaaaaataagattaaactgaagaattgcagaccaagctcatatgtgctggaatatttgctgtaagctggtgactgattctttgctgttatctttcataagagagtggatttagtttaactgttagtagttaaggtttggattaggaatacaaatatgattcccttaccataagaccttttaagcactgatttgcattgctgaggataagttatgattattcagtctcgggaaaatttgtattataagatccatatacacttagccaacattgccttctaacattgcaatgataagttcttttaattgagattttggaatggtatagctatctggaaaatatttcaaatgtcattgtggagcttttggttaaatgtgagttttaaaagtttgataaatagaataaagagcggaaaggaaaaatagttatgaatttgttgaattgtttgggctatgagttatctttttaaaaagaggttttatgtttgtgtagaaaatgccactaaatataagaaaatggaagtttaatagttgaacaaggtaagaattgcagatatcatgagattgtaatttaactggagtatgcattaaatgaattgtatatttcactagcttggtgaccatgaatggttttgtttgtcattttatctttcttttcttttctttcttttttttttgagatggagtctctttcacccagcagcacgatctcagctcactgcaacctctgcctcctgggttcaagtgattctcctgcctcagtctcctgagtagctgggattacaggtgtgcaccaccatgcccagctaaatttttttttttttttttttttttttttttagtagagatggggtttcaccatgttggccaggctggtcttgaactcctgacctctagtgatctgcctacttcggcctcccaaagtgttgggattacaggcgtgagccaccgcacctagcctctttatcattttgtcttatcccagtaaataccatcatgctggaccttgtattaaaaaaatgttgaatcaatgaatgagtgaatgcacgttttgggaggcctggttgcagacctatctgtgctgctacctactcatatgaccctgtgggtctgtctcccgctatatacaatgaaggctaaagatgggatcagggataagtatgtgggattgtgttgctccctccttctgctgcagtacggtagatattgccaactgtcacttcactctttcctgtgaacccaggaggagccttgggcctttctgaatttagtgcatcaggctcccatgactcaccgtagatacaagagttaaaacttactgtaccttctccttttggatttggtccctgaagcccaattacaaataggcaatattctatgatgtttcttggtcagcagatgttcatttaaacaatagagacaacagcatgcaccattatccctccattcaataatttttctggtagatttagcagatatattaatagatagaacttaatgaatgggtctagacagtattcttccagtggagtaagatatgaagatataattagattagcagagtttttcacttttactctccaaagcacatgtctccatctggggcacagttatggagcacctcctgtatgccagcactatgctactgataaatggccagcctgtaattcatgggctctgccttcttgtaactcaaagtgacataagtatgatgctaggtctgtaattattcctttaaagacaaaagatggaggggcatgtaatcctggcactttgggagactgaggtgggtgggtcacttgaggtcaggagttcgagaccagcctgaccaacatgataaaactgcatctctactaaaaatacaaaaaattagctaggtgtggtggtgtgcacctgtaatcccagctacttgggaggctgaggcaggagagttgctggaacccgggaggtggaggttgcagtcagccgagattgcgccactgcactccagcctgggcaacagagcaagactccatctcaaacaaaacaaaacaaaacaacaaaaaaacaaaaataaaaaatgattgtcaaacagatgagaggaaagcattccaggtagaccgaggcatggaggtgcagcatagtgtggcactgagacagtctaagcacggagtgtggctggagcaccagggagtgcggccagcttcatacagaggaatagtgctctggctgccaaatgaagaatgggttggagggtggccagggctggtgtcacagaggccagttaggatggttccagctgaactgtctttgtgaggaacgatgatacacatgcatcgttcagccctgaagataggttgtgattgcaagagggtaaaaaccttgttaaagatttcaaggacagtgaggacaaaagtaaggctatatgtaaactgcttactgctgacaataaagtgactgcttgttcatttctttatcatgtaggtggatgcctgttctgtaccaagcacctggaaaatacaatcatgtgtaaagtagacatggtctctgcccacaatcaagcaaaaagaaaatgattgattactaagtagtctttataaggtgcatgagcaaaattcttagggtccatgctctccacagattcccctcctttcctgaagttaatttatagtctgacaacatgttctctgctttctataggaaattttggaggataaagttagataagaagataaacctcaaggtctgtgccttatatggagcatgcttgcatgtacacacacagacacatgctcacatacacaccttcctcccctaataaaagacacctgtcttcactccatagattgacaagcatctagaataaggcatatgaggattcccataagtaaatctgctccaagaaaagttctagatatcttctcatattttctgaacatgatattttacatggaagaatccgggctgttgagttcctgatccaagaagaaaagtcttccatacataatttggctttggtggctgcttcagattagccattctatctgtgttccaggttattaccggtgtttggaattcatgtgcagaagcaagaatttgccttgaggcagcaagactggtagacactagataagtggcttattttaaagtgatgttttggtacagaaatggcagtaacaacaaattcctccccctaatagaaatcttcctcacattccctatccaacccagaatcatttataataatgtggagtcaaaattcagctgaatgggtttgatacaaattcctaggaagccattgtaagttcaagcactgtgttttaaagatgaagcattcaaatttattaggatggtaattgcagctgatgtaggtggggagggcatgtgtcccattttgcatgatttggagaggcaatagcttgttgagactaaaactctggagtaggactgttctaggtttgaatctcagctgcactgattggtggctgtgtgagtttgggcaaatcactaagattctctcttcacctgtaaaatgaagtagtgggtaagcatgtaagtcctttgttaaatttgccaaggtttgagtctttgttgtactactgtatgacattgagcaacttgttctctttatatcttggatttcttatctgtaaaataataataacagtaataataacaataatgatgatgataataataattatggtccctacctcataaggatgtggcaagaattaaatgagattatgcacacatagggttttcatcttggtagtctggcacctagttagcactcatatcttactcaactatttttcctgccatcattatattgagctttctaaaaattattattttttgactacttattttgttctttctgaaagttagggcttcacaaagtgtagtcgttgctatgtgatttcttttttttttcctttttgatacggggccttgctgtgatgcccaggctggagtacagtggctattcacaggtgcaatcctagtactaaccagcacgggagttttgacctgttccatttctaacctgggctggtttacccttctttatgcaccttggtggtcccctaggaggtcaccatattgatgccgaactcattgcactcaccagatcagcaaagtgcactacagcccggaactcctgggctcaactgatcctcctgcctcagactcctgaatagctgggaccacaggcatgtgccagtgccttttctttctttaaactggagactcaataatgcaatttctgaatttggggcagagttgccagataaaatccagaatgtccagttaaatttggatttctgatacagaataattgtttactataactttgttctagatatttcatgggatagcgagactaaaaaatattctttattcatctgaaattcaattcaactgggcattctgtatttgctaaatctagcaatgctagtttggtagtaaaacatactcctttgccctctcattcattttttcactcagatagatatttgtgtatgcttataaaaatgcagtgaacaacatccttggggcataagtatagaaatagtttcataaatttgaaaaaagatttcttagtatctctggtaaatctacctcctaattccttctccctgtgtaagccatgggaccatcaaattgagattatgttgatacttgagtatatagtatgatgttgcttgaaaattctgaaatgttctagtgttgcttttacctaaagggaatgattaatggtgacacattaatgggtatgcattccagagaatcctgaaagctttgtcatttttgaaggaaattacctcattacttttagagtcacctatccagggtaggttggtccctgtggttgacctggttttccaagtaggaaaataaacacttcaatggttaggttaataacttggagtgattttgttgtacttacaattcaagttaatttttaagtaggattggtctttaagctactagactagttggagactctgagagaattgcattctaagagtgagatcctttcaattcaatcagcatttactgtgtattgactgtgcaaaagcaactgcatatgaagagagaggaatttaaagtgttttgagttcctgctctcaaaaaccttagtgtttaatggagcacgaaagcaagaagcaattatgacaaaaggcaagataaataaggtcaaaattgaagtctagtaaagctaggtcccaggatggttgaatgtaggaagtggttaaatctggaggccaagtagagtaggaatggcttttattaggacaggtttctttgaaggtaatatgtgagagaactattcaaagataagaatgatttcatttgggaaatgaaatgttctaggtgtgggcttagcattaacaagtatccgaaggtggccacattttgaaatgcacgtgttacttagacatgacaaaaatatatacagcaccaccgtaactgacagcaaccgcttctctcatgtgtgactgtttatgatctagaatttccagatcagaaacttgattttatgtaggtggacctggattcattccatgttggtttcctaagtatttattgtgcacctgctgttgctatgtatgagacagccagagagacttgggcaacatttaggaattcttttaggtggtcacttaaaccaactgaaagttactccgtttaaacatgggtttttttttttttcctgaaatgaacacttccagtgagctctgatttaaattgggcaaaatcaacagcaaaagaattccatgagaagcatcttgtcaggcgctctgactttgagtatttgcttaaatgactttacaagccagcttaactcatttcctgttggatgacacttgtttattaaacttggcccaagtcagagttaatagccttaatggttttgaatggtcccaagtgattctccagcagtgtgtcattagtgaacggggaggattctacagataggatgcaacacacacatagctgcttcagccatcatagatttaagagaatacctatagccctcttaaatttagctaaggaaattgagaatactggaaagtaagtgttaccattgcagtaaatgctaaaatatttttcaacagttctagtagttttccttttttgtttttttgaaatacttccatgtgaaattaatgccatttaaaaatggcaccagcattcagaacttgaatcatcccaaattctctagcaaatgaattaaaatgtgacatggggttcatgttgattaacagatgtgtgtagagaattggactgggtagcctgccatcgcgatgcatgcttgatgcatgagagggattgctaagattgggaatggaaaacttttctacttttccatttatgtgtgtgttgggctataaagctctaaattagactggaaattggtgatgcatttggagatcgttggtttttaattttcatcaattaggattgatgtatgtcttttaagtttggacaagttgttctttgtggatgattttgctatttcaggtactggtggggtaagagtagcctggatgcaaacctttattgggttcttaaacatgaaagagcataaactgcttatgttagtttgggtctggttgaatgttattaattttttttccttgatggccaggccaaatattatgtagttttaatatctacccttggttcctactgccttatttttgggcactcttaatatcttcctttatatatctgtcattaagttataattgaagcttcatgttttatatttagaatggtgcatggaggctcagctgtgccagccattcaggcctaatggcaaatgttggttcatgccagaaagtttttggagtctagtctcttttttgggatgtccaatctaagcaaaccatccttttctgtcttaagctgaggggcacagggaagcaatttagaagtgatttccacttctgtgcatgtgacagcatcttgtttctgataaaaattatttacttgctagttcactctttaacccagagagtcatgcagccttaaaagggattgctttgacaagtctttatgtcacttcattccttagtttactgacttccatgcggagtatcagtgagtgtcagttaaaagtgggtacatagtgatagtagatgacacccatgccaccagctgcttcctatgggctgccagatgctagcaaacgtttcacagctcttgaattctctggatttgggccactcttgaactctatccatcaatccatacacccacttattgagctaatatttattgaggttttactatgtttcaggaagttgtctaggtatgaggaatacagcagggcaccaaactgttgaaaatctttgtattcatggaacttacatgggcaagcagatgtagaaataaatatgtgaatgagtaaaatgcataatatgctaaatgctggtaagtgttatagagaacgataaagcatggctgggtttggggtgacttgtaatttaaaactgagtggacaaggactgcctcactgagaaaatgacatttgagaaaagacccaaagaagatgagggagtcatgccagtatttgggggcaaagcacagcagacagaaggaagagtaagtacatagtatctggacaggagtgagtctacttcagtaacagcatcatggccacagcggctggaccaggctgagcaaagtggggagttccaggaatggcaggaggtggggtcagtgaaggaatgggattggggcagaggcagacactgtaagggtttgcaaagactttgccttttactcattaaaaattgggagccgttgcagatttctagctaaaggagtagcatgatctgattaattcaggtagcagcccagtgtggtgggggaaaacaggggtctgtgaatttggagatcatgtaaaccacggttttgtcactaggtaggggcaaataaattcagcatccttagcttcaattttattccttcttataaaacaatgcttgtgggttggatagtttttcatgaccttccaggttttgatactgttaccctggattagttgccttcctgtgagtatttcatgtgtatggctgattacatttctccttgagtatgcatagctggaccacagatttgtaaattatctttctgtgctttatttacttaaaaaattttccataaacatctcaaattgaaaactatgaagcattaatacttctatatattgatgttaaaggttgcttgaaggctaaatggtaagggtaaacacagattataagctttatcactagccttaatactattttttgttatagaaaatagaattgatttgtagagtattgcactgagctatcagttgggatacagtgataaataagacacagcgtcttaaggaattgagtaggaggagagattcctggataagacagtaactcataaagtgttgttaatggaggagacagtcctggttaagacagtaccctacaaaatggtgttaatggcagaaaagagggccagaagccatgactaggtgcaggcccatgggagcacaggcagactaatattcaggtatgtcttcataccaatatcctttaaaaatgtttaatattttcaacaaccagttagacctagtgccacacatgctaggaggtgccagaggcctggcaggctttcttctacagccctgagcaatttggctctgccccaaagttgcatcatgatgtttggcacaccaaggtctggtaagtaactcttattagaagatggtttagggaccgtcttttattattcaagaatgtcctttggacatcttaatcttctcccttccaccagaatatttcttctacttcctgtgatgttatagtgctccttctagactggtaccccaggtagcaggatggctagtcagtttctgtatttcctctgtggagaagtattgctttagtcttaccttgtcttcaggcctccagtatgaactctgttgggagtcacgtggagccctagtcattttatccactgacgcaatgtattccttgtgttctgttaactggcttcttgggcagcctaggagtattctaagtttccaggtcaaagattctggaagcaactttccaagaggtagaagggctgccactttcccagactttccccttcaactgaggctccctgtgtatgttggggtgtggggtgctagaggccttgctgctgaggaaagttgccatggttaccagcaccgtggctctcggaaggaggaggctagcatgttagcacctcagctgtcctgtggtaatgcttagggggcaaatgaccataccaatgagcactgttagagctggaggggaaactgaggttcagaagttgacgctggaaacaggaaccaagagcccttgactttcacattgcattgcttcctttcagttattttacacctcaggccttcacacacattcttcctgccatcttgaacattttcctgccattcttctgttttctttctactcatcctttagtctccacttaaaggttgcttcccaacccacctccttgcccctcatctgaattaggttaccatgcttttcttttatggtttcctaatcttatccttcatgctgtttacataattattctatatgcatccgtatgttcagtgtttgtttccctactccaaagggccaaggagcacagctgttttgttctccattttattctcagaggttaagccaggctgtaacacagataggcagtgtatgactccataagtgaaagggtaaatgactggaaagaagactggttttctctcacctatttatgtgaaatgtctctgcctgtctcagctgagggtaacaactgttattggttttgtgtattattgaggatacagaagatgtgattcttgtctctaacatcaccaagtctgtggccttctggaattttattaagggttgtctctgcaaaaaccaaaacccaatgatacacacaaatcagcattctttaattggtataggcttgacacgaggggctgtgatttgtcaatttattttacaatatttgcatttttatttcttaattctgtttccagaaatgagctttaatgccatttggatcccccattctttttattaaaaatgaatagagaaaataccacttttcattaataggattcataatccttttttggagggatttgttttggcttgtgtaatggaacttttaagagggtaggcatagaaaactgactgggactctttgtagaagaaagagcagagttacctactgtgtgtaaaaaagaaaagcaggaacagtggactttctttatttctaaaactaaactgccctaattgttcatatcaaaagatgggcttttcccaagctcggttggcatttttaatttacagagaaagcgtgcattgttttgcagtgtgcattgcggttacattggctcccagaagattagctcaaaggtatctatgaatagtcacaccctaaattatatgaactgaagagttttaaagaggtggaaaatctgatgcatgctatttcccagacattcatgccttaggaaaataactagggaagtgggagagtgaaacttagaagttgctactttatattcaccaatgtggcacttgtaaactgtgtgaccctgggccactgaattaacttctgtaagcctcagaattgtaaagtggagataaaaataccagctaccttcagaattattgtgaggatttcatgagataatatatgaaaagtgtcacaatgcccagcacattataaatgccttataggtaggggatagtacactacataggataatagttaagggcacagactctggagggcctggcttctgaatcctggacttgcactcaggggtggggccatcttgggctggttacttgacatttgcgtgtttgagtttcctcatatgcacaatggagatagtaataatacctgctacatagggttattatgaagattaactgagttagtatgtgtcaagtgttgataacaacttgtggttcatggtaagtgctatatatacgtttgttgcgatgaagaagtctgggtcttgcagacagttagtctgcaagttcttgaaccagacttcataatgtaccaagtatgttgagcttcaattttctctttttgtaatatgcggatgattctagttataatgtcaatttttatgagaaatcggtgagataatgcatatgtaaagtgctcagcataggatttggaacatggaaaatactcactactcatagcaaagacttttcttgtaattgctactaccattactatgattatttccattatttttagtcctactatgaatatgcctctggcttatatagaacttatattcgaagtgaattccacaaacactctgtggaaataaaaaggattaatatgtagaaaataatgttgagagtaatgttactgttggtgtatttctataaatggagctgtttcagcaaattgaaaaatatccagtaaaagtcttataatcatgcatttgcaattttgcagatcacaaaagatcagagttagtcagggtcagtgttgggtggacagttttatattcatggaaaatgactcataggaaacatcaggaactaaaatttccaaaataaaaaaaaattaaaaagtcatcatataaactgtgtttaagtcaagtctatttcctatcttaactgagattatgttcatggagtaaagttttgacatggtctaaatttcaatgttatatcttgtttgtggcatcactggaaatgaataagtcctgattccagtgatggtaacattttccactttagtcatttgggtcattgttgctacaatatccatatttaaacctgtgtgttgttttgcaatatatctttaagttcaacttccttttttgtttcaagtgactagggaagaaaaaacagtgattataatacagagtacaaatgatgtttgagaaaagcagggctttgagtagcattggtcctgaagtcctctgtgttttaatgaagggtgggagcttgcactgagaagtcaggtgtgcagagaagtgctaatggtcgcatcaaggcctggatgtcagatcctttcaagtcaaaatatggaagtgctgatgaaattcctagattatatgatctagaaggacaagtcaagttatcccatcaaaaatatatgggggaacttccgctaggcatgtgcatatctctgataacagtatgccatggttggaaggcgggaacctggaagggaagataaattcaagttcagtatcactggggccatagaatgaagtactttttaagccatggtaagaagggtgggctttattagaaggccaatagagaggaatggaaaggttttaagtgggagggagggcattctattcgtgttactgaaagatcactctggcggtgccacagagaatgtattgtaggagatggtgacaaagaaaaccaataaggagcagtgtaggcaagagctggggtcactcgggacttgcctgtggagatggagaggaggtggagctgagagatatcagggaaggagaatcgtagggtgggtgattcgttggacttaagtggtaagagagagcaaggagggaaggatgtcttttagatttctcacatgggcaggtggttagaacaatggtgctgttcatggagatgaggctcttggtagacaaaacagattggggaggatgaatattaattcttcctcctatatgtggtagagtagatggatgtttatggggtataatagatgagtatagtcatttgactgttttagaacgagtctggttcttggggtagaacctgtgtttcagtcaggtttgcattttcaagcatgaaattaaattgccaattaacagttgtgtaaacaaatagggatttatttatctccatacaagaagcccagggctctgtaatcactgccgttgtttagtggctccatgatgtcagaaccagcatctcagtgatttgtcttgacttttttctaatatttgtcacctcatggttgcaagatggctgccgctcctctgggcatcacaactgctttacactttaagaagagtgtaaatcaagaagggagaacaagctatgatttcttattaacatatacagtatgaagtgtgcttaaagtttgactatatttttcttagataccttctaacacatatagctctgagtagtctttaaagtatgttaaatacatttttccctgattaaaattctcaacttgcaaaaaccatttttttttctctcagatttattccaaatcttccttattactaaattctcagtggacctctctgggtttcgagcaagtgcggaaaattccatttggtgttcgccggctgatgtgcaagtaaaagcagggaatgtatgatggaaaatgtcataccctttatgatgacttttgatctgtgaagaatataattattctgtgtttaaaactacagaagggaaatgtttattcactctttttgaaggtaacattattcggggtatcatgaagtgcaaatatttgtcctttgctgcagtttaattcaagatagtctcaccacctaatgtttgcagaattctgttggtgactgttttagctaacagtcattctgaggcatagcagaaggtgcagagatttttggaaagagacatctcaaggtgtaccccgatgctgtgtgattttctttaacttctctgaactggtttgttctgtgaaattgggtgaaattgggataagagcaggagacagtctttacatccttactacaaacatacacaaaaatgcctctgaaacaagggtggctatgacacactgaaggtgcaagttaaatatgatggggtgtggaatagggaaagattaatttctgctgggagatattgtgaactccatgttggagaatgcagaagatttacaggataatggaggatggccccaggcttatcacacacatgtagtgtgcaaagtacattagaagttttcaggatttactgtttctgataagggtcaaaatgaggagacccttgaaattctggctgagcgagcttgaactttgttctgtatgtgatggggagcaactgaagacttaaaaattcacggaaacttaatgtcgatagaagtgaaattgggggtcaaaaaatatatataattaaaattaaaattaaaattttcattttgatataattatagattaacacacagttgtgagaagtactgagatatccatgtatcttttatccagtgtcacccagtagtaacatttagtataattcacaaccggtaaatcaactgaagtcttttaaagggaaatccatgatatgctgaagtctgtgttaagtgggttgtcctagtagctgtggactagaatggattggaaaaagaacatggaagctaggacacctttgggaggctcttgcaataatctgagagtaggggcataacaataggattgggaagaagggatatttggcaatatggggctgataagagaagctgatgctctgtgtagttgctcaacaaagaggtattgagggtcagctgtgtgccatgcagtctggtaagtactataggggttaaaagatgatctaatagagacagggcaatgcaactgaaggaaaatgggccacgtggaaacgatgttaggctggacgagacagtgagttctgtctagagggataactactattctaccactggttgttaccatttgtgactataggtccggtgtggctggtgttttgatttcttagatgccagaaatctaaatttctttgtgaaatctctcaatttttaaatgttacctaatataaaattacaaagaagatgcatgccaatgagcagtcatctgtgagctagattcaccctgtgggttctttgttttcttgatggaatgtttagagcttatttcagttatctattactgggtaaattgagtggcttaaagagataactgttttatctcacatagttctgataattgactggggagcagttttcctggtctagcttggggtctctcatggaattgccattagatgatggctggatttggagacatcttgaagcctgccttgggctctaagatggctataactttctctttctccgttggtttcaggacctcttgtggcctctccatgtggcctttctagcagggtaaccagactaattagatgttagctcagaactccttatagattgtttcaacagggaataaatagaagctactagtctccttaaggctaggtccagagttgctagcacatcactcttgccactttctgttagttaatgcaagttgctccagaccagattcactgtgggaagggactgcacaaagcatgaatgatgggaggccttgtccattggtgaccatctttggagacaacctaccactgaaatcaagatgtctagatattggtgacactgtttatcaaaggtaaatgagggacatagcaaattctcctgtttagcattcatgttactttgaagtttttagaaaaccacataatagtgagttttgtttttttttttagtagtaactgtgattctggagaaacctggttgttaatacagtggcttcctttggaagcataattcatttgtagctatttggtgtccagttcattaaaaaataatactattaagtgataagacagatcttttctgctttgggtgagcatgttcttttcaaatacgtgaccaggttgttaatgttgggtccataatcatgtatcttttcagaaaagagcccctcagataaagtctgttacataagacttccaaatgtttattagcctgaatacatgcaactaaaatgtactttatcatggcgctttttgttctccttagactcagaactggctgcaaaatttgcaggtcccagtgcaaaatgaacatgtggagccccttgttatgattgtaaagacgacaccagcgagcattaaaccaagcccagggccctgtgcacctgcatagatctcatgcctatgaagtcatccctgcttagatttttgaaaacgtgtacaaaatgtgggagtatactgtatttttccgataaagggccattaactctgatcaaattctcattagattttgacacccccaaaggttggtcctactgcttatgcaaataagaaaagggtgaaagctctatgtttaacaagatctctgttcccaagcagtccctgtacctcctagccacagcagcaggtgttggcaggcgttagtctgagctccctgctgttcaggctttctgaatttgagtgattccaacacagttaggaacagcatatctcttgtcgaaggcttggcatgcttttttctaaatgtactttctacccctttactgagctctgttcctgaaggatccagaatagattgcctgtctcgttgatgagttcctaagttcatttggaacagacactaacacagttcattgcactaaagatttagggttcaacatctccagaaggtagttgatagactccagacaggtttgcaacattgtacaactgcagagagcatgctcagatcatggcctaggaatggcagcccctggcattgtgcagtgcacagcctgagtggctgtacacagaggccctgccctataagaatctcagtctgctataataatttagagaggttgttgtacagctgactttttaaataaggcatgagccattttgaattacttgtttggccccctgacctgtggcttcataagctcttaatttttgtttatcatctctatcaatcagtggatgccaaggccaaattagccctatacccatacacctgacccttataatagaataatagtagctaacatttattgaatgcttattatgtgctagcgactctgcatgcattatctaatttcatcttcacaacaagtctattagttgctgttattcttccatttaattgatgagaacactgagattaagtgtggttgtgtgagttactcaaagtcacaaagctaattaagtgataagctgtgactcgaacccagtcctgtctgatttctaaacccaagcagcattacagagggtgtgtttttagggcaatgtttgcacatggcagtattctctatttgaagcttgttttattgtaggccatttcttgcttctggagcattccctgattaaatattctctacctatacttatttctcaggatttttagttctttcaaagtaaccatcagacctttcataaattttgaatatcctttattactatctacttcagtaaatctaggaatatttaatctcttaattggagttacaaatggcaaatgctgaggggattatgttctaggtgagtgtttttgttttgcacatgcctcagagaacataaaaattaacacatttccttaacagagatgagaatagagtcctaaacatcaccagataatttcctactagtgataagaaaaattattctcatctaatttttactgctttcagtataatgtactgtaggatgagaggaacagaccagttcccttgataaacaccttttgaccttattccatcctttccaggaggtggaaattctgattttcccttggagtgatattccagttcatttaatgcatgtgaacagacaggttcttttccaggtgtgagaacaatactggtttggaagtagagacctaggtatcctctgacagattgtggggaagttgagatacctgaaattaccttttgcttggatgctccttgtctctcttgcccatctgtacagtattagatttctaacaatgtgatagactcttctaatattcctagttattcttgactgatagtttttgttgaacaaatagaaaagaaaggtaaggggctttatctgaatacagaatacttagtcaagtgtttgtatgtgtgtgtgtgcacgtattcaaaggagatatttatatatgatatgtaggatatatatatatatataatttatatatttaataaaggagattatttctcttttattaaatgccaagttgggttatgttgctttctgcaccacagataatgactaaggacctacttactctaatcgaatgatctgcccaaagactaatggtatactttattatacttatttgcaaggttctgatagaggatgttttaaattatccagaatatgtttttttttgttcgtgtatgtgtatttctaaaagtggtgtttcacaaagtgtagtttaagagttacctgtgtcagggtcacctggggatgtgttaaaaataggaattcctgggtctttggactccagctgtctctactgatttgaggttttcaggaatctgcatgtcgctcagcttctttgtgatttttgtcccactatagtttgagaaccatggtctgaaatgtgtcagcatagggataaagattcaacttaattttgtctttttttgttcccttcctctttcctgtctctctttcttctcccctttcaaatatattagagacaactattttaaggggtattttaatggcttgtgttttttatttgcgatgaaaggcttttgttaatgttagcaatatcacaattccatcttttcctttgtggtctgtataaaaggagccattggggaagagttgctttttgttttgttgttgttgttgttgttgttgttgtttaaatacccactattttccatagcaaatctccaggaaggaacaacatactgtttgttcttttttcaggataactctggctttctttgctagtgggtgttgtaatcaatgcttttcagaagcaacttaatactcctccttactataaatcccagaatttaatgcaaacatttctaacgtttatagaggctactttttggggtaagagaagggaggaatgaaaatcctttgagaagacattttgaggattctctgtgatctcagaataggtagtaatgactccctgagttttagtgtcaaagattttgagatctcttagtatagaaaacagttacaaagctagaagctttaatggatttttaaaaacacaaagtttttaactgaagatattcctgaaaggtaaattccctccctccttccccctcccccatattagagaaattacttttttgaggaagctgaactagccagctagtctccactctaatccatggtagataactagttggattattagagattggaacttttccaggtgacttggatagagactccctgaagatatattaagccaggcaatgaatttagaggcagattcttctttataaaggacttcttaaaataggaaaatgatgatctaagtgtcataaagttaagaaactattgtggtgatttcttctgaaggtcagatccaaggtttgtgtttcattgaagatccccagggaaatctcaagggtcctgtgtcccattctggagagactggcgtggactgtgggcccctgcagccagctgcttgccttttgtttattttccttgttatctttgtcaaagtgctgcagttggattttttttttttttttaaatagcacaagatgattgtctttctgctgtgtcttccacgaaagctttgtattagtggagaacttttggctgcagagctgggctgatctgtgtggcactgagcataattcaggttctcctgcgggcacttgaacattcttcatgagggctgaggcaggcaagctgagtggagcagtgagtcacggcgtgctgcggcagtggtgtcctgaaataacagcaagcagcagcagcagcagcagcagtaatttaatagcagtagtgagcatttactgatgcttcccatgtgccaggcactctgctcagtaccttctgtgcactatctcatttaaatcagaacaatcccatgagctcggtaccatctttcatgtcagttttacagatactcatctgcaggtcacatgaccagtaagcaatccaagtggggcttgaatgctgattgcttgggtgcccaaattcatgcatttaaccatagtaccatactctttgacagaaatgcacgttgttactgccttttttgctttgctttttccttaaatcacatcagaactggtttttgctttttccttaaatcacatcagaactggtttttgcttagtaatttaggctccatgacctgaagattgtcttttcttatttttatgagttgaggttttgagtgagagggaaatacaacctgagaaagttcatccttgggaaattgagcatggccttttgcctgagaccatgtccatctactgaatggtcaagggagcaaaaaaggaatcgtgggaggtgaaaggtagaaagattgggctagagaaaaagagatggacaggtagacacatccagggtgatctgtaccgtggatgaaggaggaagagggatatgaaacatagttcaagaactagagttcaaaggtcacctgggtaataatgccatatagggcttaatgggggaaaaggaaggttcagtgatcaaataaattggaaattgtacattctaacatctgtttggagaacaaaaaaagcagtgcagcacctaacacttcttgagtgcttcctgcgtatgctttaagtagcacattccactcttagattctaaggtggagtgagctttgccaaaggaggtttgactcctagagggaaatcagggtagtttccaaagtaaatgagaatggatgcagatttaaatagttgggactcatgccacaatttacctgatgtttttctcattctgcaactgcctggtgcctggtgacctttgtcagtggcttcctcttgttgcctctagggcatgaatccctgcttctgtctgctttacgggattgttgacagtaaatgagtatgaagtcctttgcgctctgtagaggtaagacgcttttgaagttcaaggtcttcataatgttcatatcaaatatctagagttccttcaatttagttaacatcgtaaaatgaatgtatatccttttaggacagattaaatacccttagcttactcaggagaggaaaggaaatgcatctaaaaagtgtttactgctctcaggagacatatcttcaagttcttatgggttgcaccgagatgactggtgacaatcctcgagtaacattgttatggattttatataagactgtggaaaatgagacgtgtttgcttgtatgggcttatccttttgaagcccagttatctggggcatacatccgtggaaataccgtcatttaaaaacaatttctttaaaattagggttggaggagcatattaggtaaaaatccattcagttggaaatgaccgaaagtccaactacagcaacaaaggagatttattcattcatttaggtgaagagtccacatccttttggacttgctttgagtatcatggttggattgaccataggcctggagttatcatcatgtacctggtttctcatccaatccactctgccttcatggtgttatgtcacttttagagtgttgctggttccacttcgtgatgataagatgtctgccaaatactcctggggctgcttattctctcccgcatgtggtgagagagagagagattgatttctgggagctcttccacgatagcaaaggagaagctcaaaccgttcttattggccacacttaagtcatgttccattcatgagccagtgcatgtgatgaaggaatgggttttaggctggttagtatagacaccagaaccatgttccactcctgaattctaagggggactgaacttcaccaaaggaagtgtgaaacctagaggaaaatcagggtagtttccaaagtgagaatggatgcagatttaaatagttgagactcatgacacaattgacctgatagttttcttgtattctcatgttagcagttatgtgtgaaactggctttttaatgaataaacgactagatcaaggtttaacttgtaaaggatcttgttccaagttcctctctgtttcttagtagtacaggctagactagaccaaattgaaggattctctttctttccactttttgaaaagtcttggtgtttggtttttgaatttgtaaagcattaagttgaatctgtatctggccgtggttttctattccaaatgccttttggatgagtcagtgtgaggtttcattagggcagtataaattaccctcactttttttctttttttctcttcttgatctcagtatgactgctccttatttctgacattgagcctcatgttttaatacataaaagattcctgttttcacatggatctcctacgtgtccaacattacattttatcctacaaaaattacaccactgataaaaataaaatagttattattgaaaggcataaataacaagaatggtggtggtagccagaagttactgagtgctgactgtgtgctgggtaagcgctgtgctaagtgctttatttgcattgttctgtttattcatcacagcaaccctgtgaaggagatgctgtcattatctctgttttgaagatgagaaaactgaggttaaataaggttcacaaggctgcatagacaggcagtggtggagccaaaacttgagcccagatctctttcattctgggacctgtcttcttaaccactattttctttttctttttttttttaattattatactttaagttttagggtacatgtgcacaatatgcaggtttgttacatatgtatacatgtgccatgttggtgtgctgcacccattaacttgtcatttagcattaggtatatctcctgatgctatccctcccccctcccccgaccccacaacagtccctggtgtgtgatgttccccttcctgtgtccatgtgttctcattgttcaattcccacctatgagtgagaacatgcggtgtttggttttttgtccttgtgataaccactattttctctctcagagaagccacgatactttgagtatgctatatacctaatgctaagtttaaaatttctggaaagttgcattatgtctgtaaattcttctgcagttagtgcttctgtatactactagtggtagaagattgaaagagaacccttaacatcttggaccttggaaaaacttgacccagaagtctttcaccaaaaatttgcatttacctgaagagccaaagcaattttgagaaagaagaacaaatttgaaggactcacactttctggtttcaaaacacattacaaaactacaataatcacaacagtgtggtattgacataaagacacacaaatagaccaatgtaatagaatagagagctcagaagtgaacccttgcatatacggtcaaatgatctttgacaagggtgccaagatgattcaatgaagtaaggacagtctcttcatcaaatggggttgggaaaactagatagatgcaatggaatgaagttggacccttatcttacacaaagtacaaatattaactcaagatggattcaagacctaaatgtaagacccaaaactataaaactcctagaagaagatgtatggaaaaaacatagtgatattgaacttagcaatgatttattgtatgtaacaccaaaagcacaggcaacaaaataaaaaattgacataggacagtcttctaggtgctagaaaaaaaaagaaaacagatgaatgctactccattaaacttaaaatcttttgtgcatcaaatgacacaatcatcagactgcagagacaaactgcagaatggtaaaaagtatttgcaaatcatatatctaataattggttaatatccagaatgcataaagaactcccacaactcaatcacaaaaaataaaataacctgattaaataattggcaaaggactttaagagacatttctccagaagtggtatacagatgaccaacaagcacgtgaaaaagtgctcaatgtcactcatcatctaagaaatgcaaatcggaaccacagagaagtatcacctcatactcattaggatggctactattaaagaaaaataatgactcttgttgagaatgtaaagaaagtggaactcttgtgcactgttggtgggattgtaaaatgatacagctgctacggaaaggagcatagaggttcataaaaaattaaaaatagtaatcccagcactttgggaggccaactcaggtggatcacttgaggccaggagttcgagacaaccctgggcagcatggcaaaaccctatctctactaaaaataaaaaatttagctgggcgtggtggcacacacctgtagtcccacatacttgggaggctgaggcgtgcgaattgcttgaacccaggaggcagaggctgcaatgaatggagatcgcaccactgcactgcagcctgggcaacagagtgagactgtgtctcagaaaaacaaacaaacaaacctctcatgtgatccagtaatcccagttttgtgtgcatgtatatatatatatatatccaaaagaattgaaagcagggtcctatagataattgcacatccatgttcatagcagtgctagtcacaatagccaagagtggaagcaacccaaatgtccatcagcaggtgaatggataaacagaatgtgctgcatacatacaatggagtattattcagccttaaaaagggaggaaatcctgtcatatgccatgctacaacatagatgaatctttaggacattatagtaagttaagtaagccagtgacaagaaggtaaatactgtatgaatccacttatagtaagttaagtaagccagtgacaagaaggtaaatactgtatgaatccacttacatgaggtatgtagaggagtcaaactcatagagacagaaagtacaatggtggttgctagggggagggggtagtgggaaaaggggagttggtatttaatgggtatagagcttcagttttgcgagatgaaaaagttctggagatctcttgcacaacaatgtgaatgtaattaacatcaatgaactgtatatttagaaatggttaaaatggtaaattttatgtaacatgtttgtttatttgttttttaccacaattttaaaaatttcacatttatcacctggcactaattttactacttcattgagtatttcaacatcttacttgaagttgcaaaccccaaggccacaggctgaatgtggcccatggacaatcagtttttgacaaatgtgaaatagtggtcaatattttttaaaaattaggaactttcacatcaaaacccctatatctcgcttctcttggaaaactggagaatctggaaattccaagtccctagtctgtccaatcaacaaatggctgtagctgaggagcagcaccccactttcagtcctaggcatgaaattcagattcatttctctcactctcgaatttcttatacaagacccaagtcctcgtgcagatatactaacttcctggccacagtatttgtaggtttaagatattaaacttcttaattccaaatgcatccaataataatagaccgtagatggtggatgctctgcgagctcccacactaacttctttttagagacactaatttctaggtttctgcttctgtttgaggtcctagagttatcatctctgtatttctatatgaacaaatatagtcccaatgcccttttttcttttgccattttgcgtacagcaaatgtcctgcaagtcatgttctaaatatagatgtgttaaatttcaaatgtgaaagtttttgaagggtctaaagccagtttgctaatcagggaaatgctgtgattggcgccagcacttgcagtccctgagggggattgtgaaatccggcctccgcaactgtgattcaagtctgggatgaaagaaaactccatgatcgctgaagagctctccaagttgttttcttcttaacagcgtggtggtggtggtggtggtttgagtgtcataacagagaaaagacaaatacatgttcctgagttcattttactagtactggattaatagtatggtaacaaatcattattttgcaagcaaaaacaaccatgttttgcaattctttatgtgcaagttgtaagaaaatgcctgtcaatagaaaggaatctagagacccaagaggctcaagacctcttcatggcaagttaagaagaatggctacttatgcaaaatataaaaaccttgggtatttgaaagttcaaactggcacagttttttctcttttaaatcttattattctgttgtttttcaagatagggctggtggcatctaatggcaagtagaggcaaaatactggaatgcagcagttgtgcgtttttcaaagctatgcactgcatgacatccctgtgtgtgcatttaagtgtgtatgcaagaggcattattagaactgcctatatgtttcatgctgggtctatttcattggtgcagtagaacttggaaaatgcagtttcatgctttgaataatagtgaacaacagtagaggaggccttagtttccaagactggtggagcagaggtattcggggaactttctgggaatgagacttggataattaagttgctgtgccctgagagttgctccttgaagtagagacggatgtgctgaatcctcatctgtacttgccagaagtgaagctgtcatctagcacagttgctgcctctgtttttgaaaagagatatgactagttgattccatcactatctgatgcagaattttcaaagatgagtagtggatcagagaaacgaaacaaaacaaagccaactgaactaaactgtgttgctagctgaaagggtctgatagtgagcaaagggccagatgtttggagttgctttcttcaattttatttcactgcttttatccattaaattggtcaacagcagcactcactggtaaaaataggaacaacagattcaagttttcctatgtgctgttacagtgatgccctttttttctttcctctctcatctccttgctttttccttccctcccttcttaagctcaagctttcattatatgattttttttttaaattccaaaagaataacgatagtgtatagataaaatgtggttaatttccctactcaccatccctaatcctactcttctaaagaaatcaatattaagagtttggtttatatcaacaatccttccccaacccatgcaaataagatatgtatctagagaaatttgtttttctaatttttacaaaagtggactcgttctgggtacagaatcttgtaacttgacttccctggcattattttattggcatctctccaaatcagtacatttagctcaaaatcgctacttttaatggctaatttttttaatagtatagttttatcacaatttattcataaaattccttattgattgattcctctgccccactaaaaatttcctctcctccactaaaaagatagcattgcatattttaattacacatacatatttttaaagctttaccctgtataatatttgaagaggaaaattaaagggtttctaaatgtttcatttgctttattactttaaattttttcttgttttatgggctaaagtctttagctttttttttttttttttttttttttttttttttaaacagggtctccctctgccacccatgctgaagtacagtggtgcaatcaccgttcctgggcaacctcgatttcctgggccgaagtgatcttcccacttcagcctcctgagtagctggaactataggcgcttgccaccacacctggctaatttttttgtattttttgtagagatggggtttcgccatgttgcccaggctggtcttgaactactaggctcaagcagtctgcctgcttcggcctcccaaagtgttgggattacaggcgtaagccactgcacccagccagattttctaatttgctgatttacctctttgaatttttgcattatagctatctatgctgtatagtgaaggatttctcaagctcggcattttagtcattttaggtcatatagctctttggtgtgagtagctgtgctgtgtgttgtggaacacgtagcgtccctggcttctacccattagatgctcatagcatgcaccctctcccaatgctcatagcatgcaccctctcccaatgctcaagttatgatgaccaaaaatgtctctagtcactgccagatgttccttgggtggaaaaattgctcctgttgagaaccactcctataatgtatataaggtatatatttaaaaacccagttatgtggaagaacactacttttctttatgtattcaccaacacttggcaacatgaatgtaatgtcacatgcattagaagtgaatctcagtattgggccccagatagtgagcttcacttagttcctgtgtacaagccagcactggaatgatcttcagtttatgccattttggtatccataatggcacatagacaacagtgtcctcatttataagttgtgctatctcaatcagacagtttgaatattttctggctgtggtggggcaacacctactcaaatgaggcaggaatgccatttgcgtctgacatcattttcttcgactgggatttgagcagttcacgaggcacccattgtcccacccatgtcaccccagctatatgaagtgtataggaggcagtggcatccaggtagccaacgacctctttcctctcctagtatcttttctacagagtctcccccaacttctggccttgagcaaaatagccccattgggaagatcactgagggaaactgctgtttccacatattctataatctttttctgtgaaaaggtgagctatatatataattatttaagtttcttcacatttgcaggtggctattgtggttggtctgcttaacgaaatagggtgtggtgttatgtatgtgaacaaagctgggcatcaggcccttcatcagaaatgtgaccccttattaaagcattgttttttgtttttacagaaagtcagatggctttgtgttgtttgacgtggttccttttccaaatagatgactgtaaagatgacctgatgatcctatggactgggctataaactttgtgcatctcccttcttgtgccttaatggcaaggtaagatgctggagaaccaattctcatgtccttggttggcattttaatcgtggtagcttggtcatcagggtaatggcaacacgttaaaattcacatgcattaaaaaaatagcagtgtcatccaggctgctttgcatttgttatttgtttatttatttatacatagatacacatccatgtagctactgcccaggtcaagaattaggacatttccagcacagtagaagattcccttttccccatcttagccagtaagcacttcccgaaagaatccattagtctgacctcaatcactctgacttagtgttgtctattcttgaactccacggaaatggaatcaaatagtatttgttctttggtgactagcttttttagtctaacagtatagctgaaatacattcgtactgggacatgtaacagtagtttgtactttttgatgctgtgtgagtagtaggctctgtatgaataatttattcaatctttctactcattatggtgggcatttgggttctttcctaggtgaggatatgaggaacaaagctgccctgaatatccctgtacatgtcttcagtggatgatgtattttcttttgggtaaatacctgggagtggaatggttagctcatcttttgatagatttattcttagttatttaaatgttttgatgctgttgtaaatagattttcttttaaaatcttaattttctcccaagcgatgtattatgttttcatttgcaaactagtatattttaatagatgccatgaaacatgcattaaaattaatatttgcctctttttaagagagcctgatatacgacacttctaatttttaaaaaacatatagaaaattacgtgataactcttgatataaatattgcatttggtttttaaaaaacaatgaactgtcttacattatttaaaaataaatctaggctgggcatagcggcttattcctataatcttagcactttgggaggccgaggtgggaggatctcctgagcccaggagtttgagaccagcctggacaacatgacaagacctcatctctacaaaaattttaaaaattggctgagcatggtggtgtgtacctgtggtcccagctacttgggaggctgaggtgggaggattgcttgagcctgggaggttgaggctgcagtgagccctctttgcaccattgcactcctgcctgggtgacagagtgaaaccgtgtttcagaaaataaaaggtaaaaaataaatctaattacaacatgcaaatattttcaaaatatttctcatacaaagctaatatattaaatcaatctaatttcaaaggcacgtatttaaaaaatataagtatataatacacatttttagattatctgtgatttatttttgttcatatgtataccacaacattttatataggggtcttttacatcataaatcaaatccactgttatgaagcaaaattttaatcttttgttgctatttttgtttttgttttttgagacggagttgcgctcagtcgcccaggctggagagcagtggcacaatcttgactcactgcagccgccgtctcctgggttcaaatgattctcctgtctcagactcccgagtagtagggattacaggcatgtgccaccacaccagctaatttttgtatttttagtaaagacagggtttcttcatgttggccaggctggtcttgaattcctgacctcaggtgatctgcctgcctcggcctcctaaagtgctgggattacaggcatgagccactgcgcctggcctctgttgctatttttgaagattgtgtttagtttgtattcattttagaaatatggcaaagcattctttcttatttagaaaagggaatctaatctgaaaggatttttttttcttttagtgcctatgaggaatttcctaaatacttttgcaggtagtaaaacatttaaagctgcttgaatgcacagcagtttgtgaagcttacaaacaccgtctttctttttttttttttttttttttttgagacggagtctcgctctgtcgcccaggccggactgcggactgcagtggcgcaatctcggctcactgcaagctccgcttcccgggttcacgccattctgctgcctcagcctcccaagtagctgggactacaggcgcccgccaccgcgcccggctaattttttgtatttttggtagagacggggtttcaccttgttagccaggatggtctcgatctcctgacctcatgatccacccgcctcggcctcccaaagtgcaaacaccgtctttctaagatagtcatgaaacataacctgggacagagtgatttgttaggccatatctattgccttgacaacaaactaaacatttcaaaatacttgagcaaatgccaccaacaagtgatgtgtaggggttaagtggttaaagcagaagcaccaagaccatgtttgtgtgataaaggttgcagaaactgtacccattttataggagacttttattgcaggttttctgactctaacataagctaaatacattagcaaggagaacatctactattctaagtttataaattatttttaatgggagtatgcagggatttgtatcataatttagtccagagggtatacctctaattcgctcccttcaagccaatttaatgccacatgtgaatggaaaattgtattacacctatcccaggtgctgaaggtcagagtgatacaggaaatctaaaataccaatctttgtgctcaaggagtttgtttgagttttttaacctgtgttctcagattgtacatattcagagaggtattttattttttgtctcgatggaaatttctacaaatcatataaatgaagacttattatagcatctactgttatactaaagatcatttattaaatattttctgggaatgaatggactacagaaaagaaatggattcttttggccagacaggaaagattttctattttggtggactaaaaaaataaataaataatacaatattatttttgccttagattttgaaggggtataggtgtgatggtggagtaattaagaatttagagagcccatttcactcttttctgttttcttgaattctcatagtttaatattgtcctctttggttgaaagcaacatctactttcagtcttgattttaaaatgctgacactttcactgtacattttgtgaagaataatacgattccccaaggtgacttgattgtcaaagtcatttcttccacccatgttggtggaaatacccaacatttttcatctataaccaaggttatctttatctttttgcagtcagtgccatggtaacaggtagtgatacaaatctgggacccctgagtgctgtgggtcagagattacaataaaaatataaatgttggttgcagaagcaacgtacattttagatgtttatggagggctttaaactgatcacagataaagtggtgactcatagttttcatttttaattaatcagcattcaaattgaagaggaaaatccatccagaactttttgttggcttcagtggatctgaatcccagtactgtgactctgagctgggatatgtgtacccaccttaggcctgtaactgatctggttctgcctcagtctccccatgtgtaaagtggggataatgctacctacatcatgcagttgggaggattaaaagcccagttgatagaaatgtgcctagcacagttcctggctctatagtagctgatgttcttattatttttatagtgaggaaaccatgttgtattagtggaagccaggcagatcgactttattgaattccttctatatgtttttgtcagctgcacagtcttggccaagtaatttaagtcacttagtccccttggagtcttggtttggtcacatgcaaaatggggttcatactatttatcattcagagttgttgtgaggaaaacacaatatatttaaagcgcatagcatggttcctggcacctaataagcattcagcaagtgatagctgctactattattatgattgtggttgttattgtcattttcatgattagactgtgtgtccacatctcagtatttttgctgctatttttatagcccagctactatcatctctctgtagattattgcaacagccctctaacccttccccctctgtttctataaagacccaaatggtctggcctttgccaacctccctggtctcccacattgcctccccatagtgctttagcaacagtggacttcatttattcctgaaaatgcattatactccttccctgcacagggcctttgcatatgctgctttttcttcttggaatagtctgacctctttctacctctccttccaccctttcactctcctactcatccccttgttaatacactcataggtcctgatacatcaccttcattttgccttgtacttaattacttaatttgcttgtccttttacatttatttgtgtgatcatttgatgaattctgtgtctcatcctagactctgatgccctaggttctgatacagcagagagagcgtcagacttggattaccatggtatgtttctttagttccccaacacactcatttgttgagggagtgagtgaataaatgaatgaatgattatgatgataatctgatgataatataaaatatctgggcaacaattgaggagatagaggaggttttaggatgtgaggttcatccttgggagaatgcatagtgagaaggcagatttgctaatgatttgggacaccagtgaggaaaaatggtgtgtctgtgcaggaggacgaatggttaaatgaagaaatgcagggagggaggaagaagctgagcaggaaatagttgtggagtgttggaaagaggaaataactgggaagtgacctgacagaaaattgggcatgtatttcctttgctacagtttttatttctctgatttaagcattgtcacattggctctttttgttgttgttgtttttaagtctgatttacaatattctttttacctgtaggatgccacgtctatctgtttacatggacaaagttatacacccaaaacgggcaaagacacagtagcagtttagcctttgttttgtcttcctttcctaggacaaatgccccctccctttaaaacagtttctttcacactgtcttatttctttggtcaaaaatctactgttttttgtttgtttgtttgtttttgtagttctctactctgatgtaatctccttagtatgctcttagggtaaactgtttctcattgtttaaagtttccagcattggtttctcatttttgttgttcgtgtcactgaagagagcaggggggttttcacaaagaaacctatactgggaccactatcaggtgctgtgtggttataaggggtgaggaactaaatagacatctataaatttagtgtttttcagtctctatgtttttcttttagcataattttaaattgagatgtaattcacataaatgaaatttatcattttaacatgtacacttcagtagttttaaatatattcactatgttgtgtagctgtcaccattatctaattccaaaacatttccatcaccccaataagaagcttcgtacctattagcagttagtcccaactcccctgctcctatcccatggcaaccattaatctactttgtcttcatggatttgcctactggacatttcatataaatgggattatacattatgtggcctttcatgtctagcttctttcacttagcatattttcaagattcagccttgaaaggaatgacctttttatggtcattcctttttatggacaagtaatattccagtgtagggatataccacattttgtttattcatttttcagctgatggacatttgaattgcttccacttttgcctgctatgaactttcttgtacaagtttttgtgtgaacatatgttttcagttctcttgagtatttacctaagagcggaatggctgggtcacatgattaaacataccatagatcatcacatggtatgtttaatcttttaaggagctgccatgctgttcttacagcaggcaaaccactttgcattcccaccagcaatgtgtcagggtgccagtttttccacatctttgccaacacttgttattttcagttaaaaaaaaattatagccatcctagtgttgtgaagtggtcattgtgtctcttttattcttttgtggtgactcttcgtggccttaattagttcctccccccttttcatttaaaaaaaaattggatattgttcttgtcatttttattagctctaaattttgaatgggccctctgtagcacaggggaaatataaaatagaatttgaaatactactttataactgggaaacagcatgcttagagaaagtgactgaaccagaaaaaggcagttatggcctacaaattaggatttattctaccaaaggagacctcaagtaaatattcttatgtataaattatagaaacctctcattataggaataaaagtcagaaaatgaaattggggtaataacaattcctctttatggtttgttgttttccttgtgtaacttttttttttttttttaccttgaaatgctattccttatatgctgttaccgtgaaggttgttcatttgtacactaatcttggaagatctttgaaatcctgtagaaaaagctcggctgacgttagccaagctcattttgtattccattgtttcgagtggctaaaatatcaggactaaaggcctggaattaagaagcttaaataattatagattccctctcctcccattcattagatgtaatttagtactgaaaaaaataaaattactcaacttggattgaagttcagcggtcttaaatccttctaaaattctgaatatgaatttttcattgtaaactgtgacaatgtcaaatcaataacagtatagttttcttatatccagggtcaccatcatcacctagaaatgcgtaatgaatactttatttgtggtctctgatttctaggaacttaacagtggaatatagaccgcattgatgccaagagatatcaagggttgtgaagcattgctgcatataccaggcagcaggaagtcattaattataaggttggaagaggcaactgtgatatattttacatgagtactttaagggaccattttagattccatgcagtaggaaggcataccaaactgtgattattctaagaaaagaaaattaagaaaaatgtttgaaggagacaagtatttgttgagggcctactgggtgacaaactgcattggaaaatgggctatagagtatggtggagagctcagggccttggagtcagatgacttcaatttgaattttggctatgacaactgctatttgggtgcttatgggagtaagagaactgcaatctatatgattgtagtgaggattggagggaatcaagtgatttgtctctattctgtgcctggcatgtaataggccctcaataaacatgggtcttattattgttagtattgtcattattattatttttgtaatttaattattacaaccattacttgaggaaagtggtattgtacacattttcatatgagaaaacaaggcttaagtaaccaagagatttgcctagagcagtggctctcacctgaggatgattttagctcccagaagacattgggcaatgtctggagagctgtttttggtggtcccaactggcagcgcagggtgttactggcatctcctgggtataggccaggggtgctgccgaacattctggaatgcataggacagcctctgcaacaatgatccagccccaaatgtcaatcgtgccaaggctgagaaagtctggcctagagtcatggacctgccagatcaaggagcagaattcgaattcttttctgattcgtgcgtttagatgttctccctgaagctattccattccttcatgaaaatccagggagtgaaataaagttagtttttggcaagtccctttaacttttcagataatattctgatggcttgagactcaaatatggtgtcatggggtgggtgacaggccaagtacagggaaactgaggtgatgtgtgagggaaccgccatccattcatttttcaccattcatttgtgtattgaatcattattgatcattgacttcccaaacacttagtgagcacctactgtgtgctagtccacagtccatattcttttttttttttttttttttttttttagaggatgtttggctcttattgcccaggctggagtgcaatggtgtgatctcggcttactgcaatctccgcctcctaggttccagtgattctcctgcctcagcctccctagtagctgggattacaggcatgtgccaccatgcctagctaattttgtatttttagtagagacggagtttctcccctcagcctccctagtagctgggattacaggcatgtgccaccatgcctagctaattttgtatttttagtagggacggggtttctccatgttggtcaggctggtctcgaactcccgacctcaggcgatctgcccgcctcagcctcccaaagtgctgggattacaggggtgagccaccgctcccagcccacagtccatattcttatgcagcttctgttttgccagccaaaccttactgagaaatgaaagataacatttctgacatgaaacataagaaatgaaaaatatgcttcagtatacaaaagtccagtttatgaagctgtgtgtttggaggcctcacactgatatttgttcatttattcattgactattcaaaatacatttgtacactgccgtcttcttgggtatataccccctaagaaactctgttgtctgtcttttcataaaccctatgtttaatggcagttttatcatttcattgcaagtaaaaatcctttcagaaacaggggctgtatttttctgtgtctctgaggacttttggaggttaatgcttggagaaggaactcttccttggacatttcctgagccctgtggtttacttttaataattattttggtatgaaatagtttgctgggttttgtggttagtgtcataaagtacctaatttccctaaagaaaaataaagccttgacatattaaaaaaaggttgaattgaataaaagtaaatctaattttttaaaataagtgtctgttattgtagaaatttctttaatgacagaaaacaggcacatgtgtgtgcacacacatatacatctcaaaacgatacatctaaggccttgcttctcaacagtttgtaatttcctcctaggaaaaaacaagaattgctgctgctgttattattcttatgaactccattgatctaataactcatgtttttttttttttttaaattaaccacaaattttcctgtagtgaggaagaggtaaacagtttccttgatgttgggaagtcccttttttagaagtgtatagtcaccgcaaattagctaggctgttaatttttttttcttcttttctgttcttgtctaaatagaagaatccatgaagcaaatgtatcctgtgctgggcttatggaagaacttgcggttgaacaccacaaaacacagtttccttggtcactcctttgtagtctgaaatgtttgaacagtttaattgtatatgaaatgtctaaatagtttaattctttgactcatgggacagccaactctgtgatctttctgaagtactaaaaatacatgaacagttgttacgacagacaatgtaagattttgtttcttgatcaagttttgttagatttctcttctcttcttccctctcctttgttcccctcccatctcttctctcccatttccctccccttcctctcccctaccccctttcccctttactccctctcttctctcctctcccttctccaccttttcctcaacagttaatctctttgaaccctttgcaccctttcggggttgaggctccctcttttattctggcgtttccctctttttccacattctttaacacttaaccttttctctctataattcttccatgcccaacatttactacatttttgtgaataaatctcttaaaatatacacttgatattaggatgtttatttttttacttgaattttggaaagtttatgtacgaaagtgcagttaagaattggtagtttcaagatgtggtttgcttttgtgatatgagagcaagtgtttttatttgactctaacatgtatcatttcaatttctttttgttctgctttcgagggtctctgcagggtctcagagtcctggaggggcagagaccatcttcagtgagggagctctgagtgaaggaagatctgggagttggctgtcttgtggaaggtcagcgtgatgacgtctctagacttaatcatgctgaatcctgtcccttgaatttgaaaggctatacaataattttgtcctgcttatcagagccataaaaccacattaaggtatagatagagggcacagctctttcacacatgtgtattgctaatggttctgaatctagtttttaaataaagcttgtcattttctgggtgtattgtggagacatgttataggaatcatttgctgactcttcatgttcattctatttaaacaaacaagaaccaagtctacaatatgacataattttgccttgtaactttttttctgatcttgcaatttccctttgtcttcttagctaaccaatttaagttaggaagataattgatctattgccacgtgtttcttaacctcctctccatttgtaatcctttcttctcggttggaaggaaactagaatttaaaaataactaatattttgatgaccatttataattttatctaaaattttaatggtaactttgatgttttaaaggtattccacacctcagaatccccctctaataatttttaaggatttcttccttgggtggagcaaaaaagaatgaggccttccctgaccatctcatgttatggtaaatgacagctacctgctggtttcttgggtttttttgcagtgattaagaacatttgttatcatgtattttaatcatctgtgtatttgcttatttgttgttatcttttccgctgtatattacaagggcaggaagaatgttagttttgttcacaatcctctaatatttaatatgtgcatggtatgcaacagacactcgataaatatttggtgagtgaaaaaatgcatctttctttttttaaatgacgaggtcgttctctgtcacctaggctggagtgcagtggcatgatcatagcttactgtaacctccaacccctggcctcaagcaatcctcctgcctcagcctaccaaatagctaggactacaggcatatgccaccatgtctggctaattttttaaatttttttgtggagacaagatctttctatgttttccagactggtctcaaactcctagccttaggtgatcctcctgccttgttcttccaaagtactgggattataggtatgagccaccatgcatggccaaaaatgcatttttagaagaatggatatagagctgttatgacttagtccatttaatatagactaattatgtgaaaatctactttgcaaagcggatttggggtccacggtatctgttagcagagccaatttttttttttttttgagacagaatctcactctgtcgcccaggctggagtgcaatggcatgatctcggctcactgcaacttctgcctcccgggttcaagtgattctcctgcctcagcctcctgagtagctgggattacaggtacccaccactatgcctggctaatttttgtatttttttggtagagacagggttttaccatgttggccaggctggtcttgaactcctgacctcaagtgatcacctgccttggcctcccaaagtgctgggattacaggtgtgagccactgcacccggcccattttactaatttttaactgaagagttggttttcaaatgaggaattcatttgataatgagaaaggttttttttaactttgggggtcaagagccaatgtataatttgaagataaaggtcctttccccagaaaaatgtagttagaccattacaaatttttgcatataatcataagatttatggatctttagaggtgggtccttgaactccagtactaagaactcaggctaagaactcatatgtaacagttccacttaatttttaggttgggtttgcagcaatttatgaggataataattcgtgctgaagatgaaagacaaaagtgtcagatgcccggcgaggacagtgctatccactaaggggtttaattcttgcctccattctctctgaggcttttaaaataaataacaggattctgataaagattgagctgtttcacttgagactctgtgggcctatggacttgtaatgaaaaccacagttattgttagtttatttccatgtgtaattaaagacaggaaaaaaatacaagccagtaaaatgagtaatgcaaggaaattctgatgcacagcttccttttgaagatggttttacacattcattcctgtctagttccctgttgaagattcttatcttggctgcgtagattgttcagaattttcaccccataggaaaacaactaaactggtttgcctcttcttggctgggggagccctccaagcaggtattctggctgagctaggccatattctctcttaagttacatgatttcacctatcatgttggttggtggtcttattgcctgacttctcttttatttacaattcctgtggtacattatagctttctggagccaggttaagaatgagatagtctgcccccaaccccaggaatgcttggatgttattttctggtcttggcaacctaaggatctcttaacttctttaatctgattaatggggaattcagaactatagttacaaaatagtttgcctaagctattactgctttgatggaattaatgatcaaatattggctaatgcccaaagcagattcgtgaactgtgcttaattttacatttcccttctcaaaggcaattgtggaacaaagaccttttatgttggttgaacccaattaatgaatggaaatgtaatttcatttcttctacaactatggttgaatttgatgagtcttgcttgtctacaacaacatgcatacgaatatcactttgtttttactaagtgaagttattaaggcaaaacactttttgttgaacttctatggtggataagccactttgatacctttatttgggtcaaaatgttctttaaacagcctttgaggcattgacctcatcaaagcagttaattttccaatgacccattttggagtaacatggacacaatggcagcttctctagacttgatctaaagtgtagcatagttggtaactaagcttcgtgattgcaaatgccagagactgttaagagctggttgtatatttgatgactctgtttgtttagcagtttgttagaagctacttggttgatcttggctttttgcctgatgtacatatgtatatatataaatataatatgtaaataatatatagacttaacaggtcagcctgttttataaataaaaatgggagcattgctcagaaaatggcaaaagaatgagacatagtatgtatttatatatacagatataaaatataaaaatatagatagtataatatataatataaaaatatataaatatatatataaaattagagtgttctgttacaagatttgtactcattaataagtcaatcaattttaatgactacttgatataattgtaaaagtatttacaggggattcaatgatgaactgaaaccagaataaccgtacaagttttagttcagttatatgcctttgagagtcaaggggggcacttttaagtactctagggcagcaggtataaactggaactatctcaggaaagttgagatgaatggtcactgtaattaaagcatacatattctctgtcatggggcttgcaggcaacgggggagacatagacaaatccaataatcagatagtgaataccaatttatagctgtaaaaaaatgataaagtgcatatagtaagaggagttgatctggtcatgggttagggaaggcctccctagggaggtaaagtgtttgctgagctctggaagaagagtaggagtggagtaggggagaagggagtacggtgtgaccaaggaattgccagaagaccagggagactcactcatggacatcagagcagagcctggtgagggaagaggctaggaagctgggtagggttcacaccatgcaggaccttgacctccctgggaagggtttagatctttaccctaactgccatgggaagccattacagattttagtggaggaggtgagggggagggatttttagatgggtgaatcacatgatcagatgtgctttgggaaaagatcatttgggctgtaatgtggagaagagattgaacagggatgggtagggtgaagtggggctggggacaaaagtaagtttggggagagtggttcagtggctttgcattaatccaagtgggagactatgatgactttagagtagtaacagtggggtggagcatatggataaatttaagagatattttggagcaaactcaacaggactcttccaaacttaagagtttggaaacagactcttatggtgaaggaagggtatttaaaattattttgtgcctcctataataatattacagttttgttgtgtctggtcagcctgttttataaataaaaatggaagcattgctcagaaaataggataaggaatggggtgaatgtgggggagagtacagagttttaagttgttaggcaagagttgaactgtagcatgatctcaaccagtattgctgtgtcactgatttcttaccctgatctctgctcaattagccttttggacagcaggtccaagatatcatttaggatgccagaacaataatcttctaaataataccctggtgccttgaaggagttaaggtatggattcccagatgctttatctataaccagcctgcatcttagactttgggcccaactggtagatcacataattcttttataaggctgttgctcatattaaagtatgatgtaataaaggttatgaattaaaaacaaaaacctacagggtcacatgaatgtgtataaacatcaatgaactaagtacatttttttttttttttttggcagaagacttgctattgcgtataacatagcatcaggctgacaatggtatttaaatgtaaatgttagccaagtaatgagatgttgttgtttgcttcttttgtgggctttggattcttgtgtcattcattctgcctttattgatctacatggcttttagcattatggcattctaaatttctgaagataataccatgaacattcttccaaaaatattctcagttaaacaagaagcggagactctcttatgcgtctctcttcttttgcttctctcttgaatcttgacaaattatgaaatttcaactctagtttatacttagagattctgttttcattagcagtctcttttgcttgagttgaggtgaggaaggatgttgttagaaattctcattttcacctactggctctttctttttcagttttcttgtatgtgccctaagctgagtattcattttaagcacgctcatctacccttggtcctctgtcctgagcctcatactgactggccagaaaaactggatgttatttttcaaaagcttagtacagattttgatatcttgttgcagcatttgatactaagaatgactgaggccggtgttcagggatgctgcaggtggttttgattactgattgccaattcatgtctttacaaagcgttgtgtcatattttatcttaaatgtggttaattttttttccattcatttcttaaatctttcacactgaattggataggtttttgaagttcaaactgcgtttgctgtaagctgggttcttggattgctgtccagtgtgagcttgggcagtccagggatttatttgatggcggtgtgctcagcttttgaaattaagtaatagaagtaggatttaaaataacttttttaacatactagttttgatcttttatcaaaagatcagttttgattaactccctgaaaagacatgtaatttcaacattatctgtgtgataggtggaacacatatattgctttaagtctactagtcttagcttaaaaatccttatcagtgacaaggaaataataatgcctaccttcagaggccactgtgagggataaatgaggccattcatgcagttgttcatttgacagatatttacgaagcatctgcagtgtacatgggactggtgcttaacactggaaatgacagagaacaaaatcaaatctttggccttcatggagcttatattttacctaatatttgtaaaatgcatgatagatgatcaataaatcatagctctaattgtcactacctaaaatttggataaaactttgagatctaaaatatattgttaaatgatttcaggtcttcccttattttaacttcaaattaaattagagatgttgaagaagttctgtagatatattctgcacattaattttaaggttctaaagcagtggttctgaactctgacaacacattagaatgaccctggaggcttttcaaatactgaaataccagcgttgggaagcttctctcagagattctgatggtggtctaaggtgggcactggtatttgttttaaaagctcctaaggtaattctattgggcagctagggttgagactctctgaaatactttacgagtatttacatgttatggctatttatgtatcaaggtacatagcttgatatgagagaagggctatggcatttgctatggattggacaagtttgatgataggtttccgagcaaaatatatggcttctgagaacccaggtgcatggactgtaggcatgactgccacagtgcatctctgtcccctggatcaatcactgtaccacaaagccctcagtattctcatccataaagtctggttaaatgcagtgaggatgcctgccaatactagcagtttgctgctctacagggtattgatttaataccccagtatatgaattatctgtttcccagaatggtttccagcctgctgcctcgttcccttcctttgccacagctaatcaagccagtggtgaacattcagtcaaagcctgccagatcttcagctggcaaacacacagctaactcattctggagagactttgagtaatgatgcaaatgtcattatcatctgggaagcatagaatgacaaggaaggtatgggagagcttgattaccaccttggtctttgtgtgatttgaggaagactgtgtacacagagagaatcctagagtaggtgtgtgaggcaaggtgcatgcacattccacagggctgcaactcgatggcccatgagacagagagacggacaggagagctttgtccctggcctggttccagttccagtcctcagggccccacctgtatttaattctgtccttgggcaactgaaatttcttgctgtttccttatcattcctccttccttgtacttccttcagtgggtttctgtccttatgcaaccccagatgctttgagtagaacattagattagtagaaacttttcagtaaccagtggggcagtactaaaaatagaaatggggtaaggagaataagcaaaagagtgtgatgttgtggaaagaatgaagacagtaagttatagtcttagctctgtcccaaaatagctcaatgaccttccccaaggtgcttgactctcccaggtttgtctaaaatggaaatggtgcagtctcatagggctggggtaatgaaaaaaaaatagattatagttgtagaaatgccttgaaaaggtaaaatggcacaccagtaaggagatcatctcgtatcccctcagacatttagacaatgtgagatttgagttgtttgctttcagagacagagctaggagagaagagaaactgagtcataataaaatatgcctgaggggcaaagtttttaagtgttcattgaattctaaatggaatacttctttacttctgtcaacttttaattttcacagctttattattctcccaatggctattatttctttctcagaatttctgattatttgctgcctcagttgtctcagtttttcaaatatatatttttagatagagttcaattttttcatgaggttctgctcacaatgcgggtgacatagttctttgtgttatgaattcgtgataaagttactgattttctttctttgcattcagcaaagaacaagaattagggcatgcatgtaaacgatttggttggttggccttcttgtcctcacttggcatatcctaaaatcattttattgtctcctacatagtggattgggcaatgggaaaggtttacaattggaaaggaaagttggtgtaggtctttccagcagtaaaatctattaaagatccttttacttttgcctctcacataaaacgaatgtgtaagtggctctgagaaaggtaatgatattaatgcccaaatgtacacttaaatgtactattataagtgtacttactatgagccacttacaatgtactattccaattatacaattggaatagaaagggtgtcaagcattcaggactgaggaaaattggcctggcagtgaacaggcttacttttggacactgacattaaacctgactcagaagattttctcattccttaatgttactcttcaagataacttttcattgacacagttaggtagctaagggaagataaagtaaaatcaaagaaagattggatctgtcagtaggttgaatgtgcacaaaagctttccgctcttttgcttccattatgcatttacaccaagtggaataagtctccctctgggaagcgctgttgcaattctcagtacctttgggcattaatatcattccctttctcagagtcacttacaaattcagcttatgtgataggcaaaagtttaaggatttttggtagagtttactgctggaaagacctaggccaactttccttgcattccaaactgtttcatattgctttagtggaaaaggaagatcactgctacttgtagatctgacattggaacacaagtctcttgaatcattagcttttctggagttacgcagcttttgtatatttgagatttctttaaaaggtgtaaagttcattttcagtgaagtatgaatggagtatacaataccgttctttttaacaactgacaaattgattagcatttattgaattaaatctagttgaaagtcagtaatttttaaagagtgccttttaaaaaattggtgttatgaacaaaaagtgagaatacttaaggatcttagataaaattgtgaaatggacttaactaggcaatgaaagattgcgaatccattactttctggagaccccttaaaatctatgggaacttaatggagggccactaggtgtttagatgtccctggaagatattagatgcctatcaacaatatggttcatcattgtttcatatgcccttcagtccatgaggtaaatggtggtatggctggctcatgggaactagggaaaacattatatgctattggtcaggtcactgtgtcactgggcagcttcttgatttccttttcgacctatttcctgtttataaaaaaaaaaaagtgcaactctctgccactgcggtattctcaggtcaaataggaaacaggttaaataatcaattctccatatacttttggccatcttcccaaatgtaatgagttcacagtgtctgatgacccaaccttgtggtatagtttataaggaacaacttaagtattgactcattcattcattcatttaataagtcttctcccattctatatatttttgttattttgatctcattctgtcacctaggacggcgtgcagtggtgtaatcatggctcactgctgccttaatttcccaggctcaagcgatcctcctgcctcatcctctcaagtagctcgaactacagatgcccaccattatgcctggctaattttttaatgttttgtagaaacggagtctccctgtgttgcccaggctggtctcaaactcctgggctcaagcaatcctcctacctcggcctcccaaattgttgggatgaaccagtgtgcccggccccattctatcttttttaacttgccagctttactgccatttgtgtgtgtgtgtgtctgtgtgtgtagtctgaaattttggtatctttgtataccaaagaggcatgccagttattaatctactgcggcatgtaaaaagaaggtgcaagcttccaggtgtcccctcccagtggagtcacatggagatttgcttgattctcccggcaacaaaggctaagtattaccagccaggaaagctcactggcactttgatgttcagggattttactggagatcatatagtgtctgtgtaactgacctcaactacttaagacttcggctcttcttttctccctgggcaaaaacaggtgtttgccctaaatcgcactgtaaggataaacttttctggtaaactggtacaggatggctcggggcctcaggtttataaaaacagatgctaaccataaatacagtggggcccagggcctcaggcatacaaaaacaaatgtttaccataaatacaatatgacccaagacctcagacatacaaaaacactgaacgaagcagaatattccaagggttcagaggttatctcctaggagttaacaaggtccagtcctgaagataggcctttctttggtatgtgcagagttctagcaacccaggcctaccaagttaaccgtttcctgctcacattgtctagtaataaggttgactctggacaacacaggtctgaactgcttgggtccacctgtacgtgatgtttcttctgcttctgccacttcggagtctgcaagaccaaactccctcttccttctccccctcagcctactcaacatgaagatgatgaggatgaagacctttttgatgatccactttcacttaatgattagtaaatatcttttctttcttgtgattttcttaataacattttcttttctccggcttactttattgtaagaatacagtgcacaataaatgtaatatacaaaatatgtgttaattgactatttatattattggtaagccttctgatcaacagaaggctattccccgttgagtaagttttggagagagtcaaaagttatatgtggatttttgactgtgtgtgtggggtaggggagttggcatccctaacccctacattgttcaagggtcaactgtattttattgaatgctagtcattgtgaatgttatgctgtgtgtctctggattttatcattttgtaaggagtgttgaattttgttctggaaagtggatcatttccttgggatcagcttgattctttcaagggctgtctttaaattttctgagagtggatctaaagtcgtcttattgtaggcttagtttagccctatacccaagtgtggtctttctgggatctctacagaacactcctggtgtttaaagaagtctctccacttctgcaggttggaacttgaatgtttcccagcccttgatgagctctgaaagttgttcagtttataactttattacagatgctctcttcctggtagtcattctttctctagtagttgctgtttgcccaggacagtgacatctcaccctctgcatatacacattactattcagccaaagactcagggacacacctagaaagacttctaggtctcttcctttgttgtactgtggcctgcatattccagccatctcattctccccaaatgtaaaccgtttctttccatgtcattgagactcctctgtgctgctcaggttccttctctctgctgcaccatctggaaagtatttctagacagaaagcataggtgatcacactgctcatctcatttgtttttcttcctttgggaaccacagtcgtgaactgttgtttaataactgaaaactcttgtttcatatatttttgtctgattttctagttgattgtagtgggagaaataatctggtaccagctgcttttcatggctgaagtgtaatttactctaacaatttttatgtaagaccaggggtttgagaatcagacatgtggacttcggatttggttcccagcatttgctaagttttgatctttggcaattagttaacatctctctgacttagctgctttattgtaaaatgggcatggtagtacctaattcataggggtttatgagcattatttgtgatagtgcaagtaaaatgcttagtatagttccttacacatattaaggctcattcattgatgatgatgatgatgttgataatggtggtggtggtcgtggtattcagctgtctgtattttcactataagtgaggatgttacatagaaaaaaatgcttttgttatgttacaaagtgaaagtgctgcaagtcttgtggcagttaattgtcacaaatgtgataggatcaaggagagcttagacactcttccttttcactgcttgcagaacagtcacagaagttacagaaaaattcattgatgacttctgggtgtggtagccagaagagttgatgctttttctgaaaatactcatataagtttagggatacaaagctcctgaagactgtatttaaaatgcctttaaaagtgaacctgattatatctttaatgttttgctttttaagctgtgtggtgcaaacataggtgtgtttattattattttttattctatttgatattttgatatacctgaaatggttcataattttccaaacctgtctcaccccctcaaaagcaggcctttttccagagtcagtctgtgctataagtctaatctgttaacatttgagtggatcaaatcttaaaaccatgagatagcttctcattagtactagtgtacgtatttgagaaattgttgaattaaacatgcaagttgcagtatgatgtgtacaatggtactactcaggtaaaattttaaaatatgtagaacattactgtatactctggatggatgtgtgtgtggtgtgtgtgtgtgtgcatgaaaaacttggtttggaaagaaacatgaagtttaggaaaacaattattttctgagaaaagagatgggagggagagcaggcaagaattcaaaatagtcttaaattgaatccatcatatattatttctgaaaaaaaatgaatcaaatattccagataacattttagaatctgaatggtgcatgtatgggtatgttatattcttctttgtatttttctatatgtttgatacttgtcttaaaaataaatgtaataacaataatgtacaagttggtaatggaattaaaacttttggctctaggggcttggttcatgtttgatcaatatcaagccttttggggttatcttcaggaatgtgattgtaatatcctgcattgtgtcttactctgggacaacctcagaatgtaaagttatacttaggagtccagaacaccttccttttgtaaacacatatgcattagatattgttaggataaaacttcgctgatggttttatcagcgataaacttcatacttaggtatgaagtatgaatatttaatgcagtatgaagtttgaatattgtaatgcagggactttttcctgggccagtctatactcttaagtctaatctgttcccctttgagtggatcaactcttaaaacccttaaatagcttctcatcagtaggacaaagttcatgcaacttaaggggacctaggaagcctgcttccccttttcccctgttgctcctcccaccatccttttttctttctttctgttatccaactatactagactttttatccttcttctgtttcctcttaggtgtcctgttcattctcttgaggaggcattgatttcccctttcctctttaactccgtccctatccctcagtttttctagtggaccgctctacatcagtcaaatcttagcttcagtatcccagtgtaaccacgtaagttccactactgtatgctttctacaattttccaatattaatgctcatatcctcactgttattactcacatgcccacctttccagtcttcaatttaagccctattaggaagaaaccatgtttatctccatttctctagcacctatgtagcatttataatataagcactaaataaatatttgttgaatgaaaacatgaattaagtacagtttgggcttctgatgaatatatactcactagatacttaaaatttttaatggaaaatactggatttaaagaaaacttttatgaatattttaatgaacattttcataaaatattgagaggatttatggtcaaagatatatttttaaattggagaagtaaagtgtttactcacaaggaaagcaatgctagagtcccatgggcattaacaggttaattttcttctttaaataaattaattaaaatttttattactaatacacgtgtatggaaacaatcaaagaggactgaagtgtttaaaatgaaaagcagtaatcatatgcttcagtgttcctcagttctatctgattaataagttaaaactttaataagattcaccttcaagaagaaaaatgtgcatgaacaaaaacaactatagttgttgagttgaaggtagaatgggaataaagcctcacactaaaggggctttttaagtcatgatttgtttttaaaaatgccatctgaagggcacagtgattcctccagtgttagcttgtgttttctataaccttcttcctcaaaggcccatcctaaaaaagattcagctttgcttttttgcccctctttccaaagacaggatctcaaaaaatggtaactaatttaagccctgctaaatgtccagatgcagcacctgggaaaaatgaagttcagaagttcagaatttggaagcgcttaagctagaagaatcttcttgctgtggttgcatgtctggttctggaagctagtaacttctttcaggcaggcattgttccattagaacagatggcccgaagtgtggctgtgccagagagcagagaccaagtgtgaacttgtccaggaagttgaaacacttctcagaatatcttcttctcctggtaatagccgtgccattgcaactagaactttctgggttggaagagtgaactcaacaaaacaaaacaaaacaaaacaaacaaacaaacaaaaactacaaaaaaaccatgagactgggtgccatggctcatgcctgtaacctgtaatcccagcactttgggaggctgaggcaggtggatcacttgaggtcaggagttccagaccagcctggccaacatggtgaaacctcgtctctactaaaaaaaagtacaaaaaaagctgggagtgatggtgcatgcctgtattcccagctacctgggaggctaaggcaggggaatcgcttgaacccgggaggtggaggttgcagttagccaaagttgcaccattgcactccagcctgggtgacaagtgagactctgtctcaaaaaacaaacaaacaaacaaaaacataaaagctagagttagagcattgatgtccaatgtggtagctattgaacccttgaaatgtggctagcccaaattgagacgtactgtatgtgtgaaatgcacaccagacctcatagatttcatatgaaaaaggaaagtaaaatatcttgttaacaatttttaatatagattcgttttgaattatgttttgggtaaataaggtagtaaaattgacttcacgtgcttcattttgtttttctttttaatgtggctactagaaaattgaaatatacatgtgtggctcattttgtatttctattagacggtgctgcttttgagagaaactttaccagggatgttcatggaactctgtccaagttacactttgatgtgactctttactctggagtagatcagatatggaatccaaaccttggaatttctaagttagcttcttagtaacttacagtttaaatgtagcaatgaaaacaagagtaggatttttttttttcagttgtaaaagaaatttctagaaactaagagctttacagagcttaaaatttattctcattgttttatttttaaactctaagtttctgccaggacaaaaatgttcagttctttttggattctgatggcctggtaaaacttctttgtaaacctaggggatgtgatagaattggcacaggagaaaattaatttggttgggatccatgaatggaatggaggtgatgtgcaggccttgcagtctgttgtaatcaatcattatagaagttttgctgcgatgctggcctgcccaacactctgcactttgggcaacatcgtgaaaagatatcttcctgtagatccctgctctggtgcaatacaagtgtcaacatagaaatagaatgtgtgttattataggccacatatatacacattcaataaaatgtctcagcatttactcgtgtgtgtgtgtgtgtgtatgtgtctgtgtgtgtgttctggaaaaaagttaaatgagattttccacaactttttaaaaaaatttcagcctcgttgtaggatattttccaaacccacattttccagcaatttgagccccaaacttatagcaatgaggcactttcttgacaaaggtgagtcaaaaacaggaaccctttgattctgtttgtcacatgatgctggatgttataaaataataatagcaaggagttcatttctttccctttgatcgtcagacttttagctgcttcacttccattgctaaagccaggaattcagaagtgtaggtcagatgctgtgcgtagaaaatgcatttgggagcatacacattaaatgggttataaatagtatctgccctgacaatgctggaattttctcagcttttagagacattgaagtctttgttttgtgggttgctgccctccacccccaaccccctaagcttgagtcataaagcctgaaaaactaatgaggttgctgaaacttaaaatctaattggtaggatgtatggaaaacaatgagagatggcagaaaccgtacacttcgattcaagttggcttctctgttgcagcattgcaacttgctcactttgcattttattgttccaggtccttgaattaattttttccttcaataggatcaaattagacctagatttaaaaaaaactcataagtagataaccatcaaggctaatattaggatcctaaagtcttcatttagaaaaggaaaaaaaaaaactaaaaaaaaaaaaaaaagcaaaagttcaaacgggattttctttttaattttaaaattttattttattatgctttttgagactgagtctcacttactctgttgcccagactggagtgcagcgacgtgatctcggctcactgcaacctctgtctcaggggttcttgtgcctcagcctcccgagtagctgggattacaggcacatgccactatgcctggctaatttctgtatttttagtagagatggggtttcgccatgttggccaggctggtctagaacgcctgggctcaagtgttccacccgccttggcctctcaaagtggtgggattacaggcatgagccaccatgcccagcccaaactggattttcttgatagtctctctctctcagaaatattttgctcttatcttctgagtttatagatgatattttacaacaaaggtctacaaactataaaccacacctggcctgtcagcatcttcatggatgcccctacaattaagaatgattttcacattgaatgtttttccccccagccgtttaatgttgaaaaaacaaacagagaaagaacatgtggtagacatcatacctggcccaccaaccctgcaatatttgctatctggccctttacctacaaagcttgctggcccctggtttagaatgtgcttgctgtgtcacccttgctattagatatgtaatcagataaaaagtttctttcttggattttgttaattcacccattgaatatttctggagtatttattccattcctggcactgtcataggcactggggaaatgaagtgtaaaaagtcacaccaaaacacagactaaagggcatatttcaaaagtgacagagcttgcattcctgtcgagagaaaaagaccaaacctaaccaacccgaacagaaacaagaaatgaaaaacttaattaccaggaaaataaaccagctgagtatgagatagataataacagcaatttctgtgcttccccccttgaactgcactatggaatggtgactaagttatttcccacattttgaattcacccacccacatacaaacaccaaatacttgcttgctttccccaagtcatttcctcatttttaattttatttttttcctaaagtctttttgccccagctgaaattcattactcaaccccgtcttattgagtactttagtttggtgtttccaaggtttatttatttggtgtttgtttttttttttttcttgaaagagtctcactctgtcacccagggtgagtacagtggtgcaatctcggctcactgcaagcaattttcctgcttcagccttctgagtagctgggattacaggtgcatgccaccacgcctggctaattttggtatttttagtaaagatggggttttgccatgttggccaggctggtctcgaactcctgacctcaggtgatctgcccgcctctgcctcccaaagtgctgggattatggacatgaaccgctgcactcggcctcatcctttttttaaattagcttttctgtgtctttagacttaaggcttgttgcttgtatgcagcatatagttggattttgatccttactctttgtcttagcagctcaggctgctatcatgaaataccatagactggtagcttacacaacatatttatttttcacggttctgaaggctaggaagttcagatcaaggtgctggcagatttgattcctgataagaaggtctctttctgtctggcagatggctgctttctcactgtatccccagagagccaaagaagctctctggtgtctcttctaataagggcactaatgccatcctgggggccccattctcatgacctcatctaaactcaattacctcccaaaggccccaccaccgaatatcatcatattaagattagggcttcaacatatgaagacaacagtcttttatgctttttcccccttttttggtaaatatgtattatggattatagttattttatttattttagtatcagaatctttcctcagatctgacattctctaaaacttttgtgatctgcaccaaagtaagttacagacaaatgtttgcttgtttcctttattttggatcttttctgtaagaattctttgtgatactaccagattagtaatcctgctctcctaagcatactgagtggtagcctatgatttcttttgtggttcaaaatatgccctgtagcctgtgttttggttagcagaatggccagagcttagactaaaggccacgactcacacattccaaatacatataggcttgaagttatcctattataaaacagttaccacattcatgtaaatggccaggcaaaggtcaaaatatgagcaacattatttgtagctcagtgagagatttgatgttcaaagtctgtcagcatttgtcagaagactgatattgtcaatggctgtttcagattaagaccaactaaaaagtgatttggtgtgaactcagaatatagggaaaataagacaatttgaatgtaccccaggaaacaagagccctgcacttgactccaaaaggagttctattattctggctgtttccagactttattgtatcttgagaagagaactgttttccctctaaatcagtttcatcatctgtatccagggtagtactcacaagaacatgtcaatatcaatagcatgcatatggggtgttggattcttagaacttattgcaattgcttcctctaggttctatgatgattatcaatttattgcctctcaggtccaaattcaccctttattgtctgctctgtgaaaatggacctgaactctttaaatggtatgatgttaaggtttggcaggagagggtgctggagagaagtcacaggaagaaggggttttccttcttaaatctggcgtgcattctcacgtggcttctgcagcatccatggcttctccaggacctggctcttgcagcaccggagacatctccagggcttgtttcccacagcacttgtggcttctctagcaccatgttcctccagggctctggcttcactagtgcctggcccctgcagtgcatagtggccacagccgcacctggtagccagcagcttcctttggcacctctccttgggctgttttgtagcagggtgcctctggtgggacacctccctgtgaacagcttccctgaaaccctagaggatggattccagtaagctccaccactgaagcaccacagcaacttccctgcctccagatttctggctcttagccctggggataaaggctctcccttgggccctgtatctctgtcttagagttaatggccattccttgtctctgccattcctatattctttaaagttctttcaggttctctttacttcttgctagctaagtcttgttatagttagtaatttcttctattaaagtttctattttcagacagtagtttgaaaagagaaagtttaatagatgaaatgacaaaccatctctcctaattggacccagggttaatatagggtcccatcaatagtattatggggttctgtgcttgtgttgcaaaaaacaagtggttgaaagagaatctaatggatttgttcaaaggagcgtgaaatcagaatgtatgtgctattatatatttccctgcactcttctggttgaataaaccaattttaggaaaatctggaagtttgccattatctgtaatggaggaagagaatagtggttctgatgatactagagtgaaaaaaattcattgtctgacaaattgaccattctgctttgtgtgggaacttcaggttcaggttctcacaacaaggctgctgaggggacctagtggatgagttcagtttctggggattgtctgcaaagtgataatatctacattgataatcctaaattgattaagagtgcatgtcaagcgttgtttccttccaccctcatatcttgtgatagggccatagcagttgttcttttcttccccttttctgtgtgaatcctgcagcagtatgatatgggccagcctatgatgcggaagtaaaagaaaaaccagaataaggtgccttgaggattatctggtctgatccctttatttttgagatggggaaactgaccaagagtgaggttaagtgtgttgctctcaagagtgtccacctagttagaaaacacaaaaatatagcaaaacagatctgattcctagctggttgtttccctccaaactttactttttaatctctaatgatttatttctttatatttatatattaagatttacaaaacttggaaaaatatgatatatactttaaaattaaatgatattttagtccacattaaaagaatagatcagtaaatgtcttgtgcaggtgcatctttttaaaattttacactacatatattgaagtggaatacatagagaggagaatgtacatattataagtgtacaccatgatgatttattgacaaactggactctcgttaaccagccctcaggtaaactaattgaacattacctgcaccctagatgcttccttcctgtgccttttattcactacccctcccaaggttaaccagtatcttaactaccaactgcatagattaattttgcctgtcttgtcctttatagaaatggaacaagccatatggtcatatagtaggtacttacttgggcctggcatcttttgttcatgattatgtttgggaaattgattcttcctcattgctgtaagtagttatatagttcattcattttcatttccatatagtatttcattatctaatcctactaggatttagttatccattctactgttgatggatatttggagccttttctaatttggggcatttacagtgaggctatgaacattcattataattacttttaaaaacttttggacattggaagacagcaaaatgtgaggttgaagacacaagcttggagttagacaactcattaactgttcagtcttggtctagttctttatgttcatgagcctgtctcctcattggcaatgggcttactaataccagttgtgcagggtttgggaaataatggaataaaatgatggatactgtgcacagtgcttgacacataagtactcaaataatggaagctgccattactttttaaattaaagttttatacattatagcaaagtatcagccaagcttattttactatttgtatctggttgcttgtacacagtgtttttcattttctcagggcctgcacatgctttatctttggagtaatgtttgattctttatctttcctttcccttcctctctgccacaattattacctgcctgttgtattctaggtactggggacaggaactgaataaatgagcagacattattcattcctgagttttcttctcagtttttgctgttgtattagcctacatcctcctcttctcatgccatcctctgaatgctaacattgctctttgacagcctctcaccagtgtaacccatcctatctgagggggacaggatcatctttctccagtaccaccactgccagttgagttctttagtgaggacttgagaaaattcagctttaccctcaagtcttcaacagacactgtggtgcaggcttttctcctaaagatgtggatgtgcagtgagacaaagccactgtatcagtcagcagaggctaagttttgctgcattaacaaaggactccaaaattttatgacttacaaaactcacagattgacagtagctctgatctttgtccaattccttctgaaacaaaggcttaatgagcactatccatttgggacatatttgtcttgaataggagaaaaaaggaaacggaggaaccacagagtggctcttagaacttctgctgggaagtggcatatgtcacttgtactcacatttgtttgcctacaacacgtcaagcctgatatcaatggggagggaaatataaacctcccagagagagcaatcggtaggaagggacttggcacagagtcccttggctcagtcatgttttaaacatgttttaaacacttccattgaatcagtggacatgacttttggaatataattcccaatttattttcccttttttttttgaccttcacatcactttactgtcaaatcagcaaactggcaatgcacaagatatacagaagaccaaggctccaaattagtggcccaggcaccctgatgacttcctgtttctcagaaaagtaagcttgggcagcagtgacctccacagcctatgataaatgaggaatcaacagttgcattccataattcaataaatagttcttccttctgccaggtgatgtgatggaagctctgtgcagcttcaaagtaagagttgacttctgcgtctatacaattcttgtcataaatgtgatcaagtatatctttacctttctatacagttggcccaaggtatgattactggcatgggtgccagctaataagtaaatcagtcagtattgacaccatgtttagcctcaagcatgcttttctctggaatgcacatttggatgaactttgaggaaaattattaactcaccccaacttaaggagctttgaccgaccagagatttcaggattatgtgtacatagtttcaaacgttgtattttaagatgaagaataatttaagaagattagtgagcatccttcattaatctggagctattttagtaataataaaaaagggcaacttgttttcatcttagaagagtaataggtcagttttatttataggtgatatctaatcaattttttatttagcttgtataggatgattctcaagtagataatgttaactcacctagaataaaggaaaccacttgttacctaagtatacgacattttaatagcttttaaaaaattcaccatactagtttacacaataaaatgtttctataagtctgtgtatatgtatatataaatatagaaggtaaatatacagattatattatataaatagataaatataaaatcaccatggtattttgatatataaaatgagtctcattataatgattccactaaatgtacaacctgttataaaatgagtgataatctgaccctcatttctgtgttttaatcttgggatgatttgaagtaaggcataatcatgtatgaacatattcctggagtctgacatgagcatcatgaacttgctaattttattccttgatggtttatataagtgtctgacaaatttaataggaagcagagctttattttttttcattatcagctagagaacaaaaacattggcatctgaattgaatactggaatatcgtgtgagtgtgtgtgtgtgtgtgtgtgtgttttactaagattcatgccactcaaagtgtgacccatggactggactgcttcatgaactgtgtggtgctgtcctacaatatgctaagaatagaaatagagtgttctgaaattttagagcaatcggaaagagtagctttaggtctgttggacctaataatacaaatttgggcttgcatatttgtgtttgttttgtttttcatctcatttgtctaagaattcacttttatatagtctataaaagtatcagcctgtgatggatttggagttaaaaagacaaacaaactaatgccacagacggtttagaagcattgatgaggaacctgcatcatgatgacagaaagtgatataacttctgttattctataggcgtgaattttgacatggagtactgtggcttgtattgcattgagattttaaaattcatgtcccctaacctttaagccatatccccttaactttccactacaaatattctatttaactgtgacttttgatccacttttttctagattgattcagaaaaagtaattctttggatttattcatttgttcagccatcgtttattgaggaactactttgtgcctgacactattccaaacacataaaattcagcagtaaaaaaacagttcttgatttattttagctaatatgaaaagaactcaaatatacaaatatatttgtgtatatacaaaggtgtggatgcacacacacacacacacacacacacaccaactgtcaggtgatagattgtttccacctgtcatttggttccacttggactactaatgcatacattctttctccctatggatgttaacatcactattggtgtggttttgagctgatggaagtaagtcccaggtaacaaatgtaggtgacctcccttagggccagtgatgcctgaggatggcattcccagtttggtgatgacagtgggttgagaggagcctcagacagtggaggaaccttagaattcactgccacgtatcactgtttcctctagggatatcattaaagagagagttccatctgtgtgtttctttggttcagcaggagggaccgtgatgtgatcttctgggcgatgtttcagctctgcgaatctaggatggatcaggaaggtgttaagcctctgaaattagggcagtgttttgtgcagatgctcttttctggggtgaggttcccttgctttcatcaggttctatcagtggttcatgaccctcaaagtcaaagaatcactggtgtacagtggccacaagagccttctgcagtttggcccctgttactcgatctggctttcccctttgtgcttccctgctgcatttgggctggcctcctcactcttgcccagtgtgctgcacaggagctcacctgggtgtgtacttcctggaaagctcggcctgctaccacgcacagagctcattgcctcacctccttcaagactttgctcagatgtcatcctctgggcctaccctgactaccatgtttaaaattgcattcctctcctggcccccaaatcctggccctttggttgcttcttgttctggcttattgttaaccctggcacttgctacctttaacattttctgtgcttagttatttggtttatcaggtttatcattagaatttccctccccatcccgatgcttcatcaaagtggggatgtttgtctctgctcactgctgtatcccccacactttgaacctgtctggtgtataatgggtgctcagtaaatgaaaagggggttcaataaatgaatgaacagatatgatatctgtctctccctttcagtgtgcccaacatggagcttaaatttggctggttgctccatgtatactgcatcccatcggttatggtttcatgaatctcatgtcttacgttgccataaattagcttttaatgtatccctgtattttcttttcagattacaaatattcccattatccattttcatctttttcttattgatttttgctgtctgtttcatcttgctttaccctagaccctcaaagtgtttgtggataagaccttaggcaagttagctgacttctctacccctcagtttcctcatcttgtaaaatagggataacgatacacaaccttgcagggttgctctgaggctgaaatgagatgatgtgtgtcaagcagttagcatagtaccatacttaaatattggttgcaataatgctgttgaagatgtaagtatcttaaggctcagtgtaatgtctggcacatgatgggcacggagtaaatggcagccgttaacaattatgcttcccccccattattatcatcactaatgatatggtctggacaatcgacatggagtagggcactagcagaaaatcctcgacagggttaagggttgacgttcttgtcctctttttctgttcctttttctttcctcttccatggtggggataaactttttctccccttgccatgcaaaggaagaccttccgttctttgctgtgtgctgtgatgttggttgtcactatcatagtaataccatatcttttgcaatttttttgtttgactagatagcagtaggtaactaatctgggtcctcaagacatatttctatatatggatttcacaacaatcttgatttccggcaagagtttcatttttgtggagggcatttcaaggagctgccttgtaaatttctgaatgcttgggttgtttgctttgtttcttttacccctcagtgccaggtaagtaaaattccccagatttgaatcttacagttaatcaatcagcaaatacttattaagtatatacatgggagattatttgaagagcagaatgacacagtgaaaggtgagctttagaaagattaatctgggggttgtgtgcctaattggtggaaggctctggtgagcagagaagggagagtttgttgtgggagtccacaagaaccagtggtggaacggtgcccgagggagtgggagctggggtggtacacagggtgtacgcatgctcagcttccctaggtatagccagccagtctcccggagccggtgccccaatttacacttccatccacaatgctcagaattttggctgctctctggtctttccaacatttggttactactgctacataacaaatcatggtcaaacttagtgagtgaatacaatacatgtcattttgttcactctcatggtttctgtgggtcaggcattctggagtgctgggctgggcagttctgtctcagcatctcttaggaggttgtagacagatgatggctgccagaccatcagaaggaggaggccattggtggtcaatttatacccccacttaacatctttctctatctcaagggaaaggactgggtgaggccaaagaggcctctttctgaggatacgaagtgaaggaggcattttttctcagggttatgcaggttctggccctgccaaagaaagtagatgccaaacatctactatgtgctagaccttgggcaagatcttctacatttatttgaggtgacttactccctttaatgtgatgtttttttcagggttaactttctagataggcctttccttaccatcctatcttcatgctttccctttgtattttcatcttattgcccagtggatcaccttcgtagcttgctgttttcctatgacattgtacgcaattgtttccccgtttacactgtatattgttgtttgcctagtcacactgtgtgtggttgtttgtctagttacagtgtatgtgttttttttgcctcgttacaccatatatagttgttttcctatttatactgaatgtggttatttccctatttacactatatgtgtttttttgcctagttacactgtatatagtttgtctggttacactgtatgtaattgtttccttatgtgcactgtatgtagttgtttgcctatttatactgtatgtgattgtttgcctagttatactctttgcttagttacactgtatgtggttatatacctggttagactgtatgtagttgtttctctgtttgcactgtatgtgattgtttctctgttcacactgtatgtgattgtttctctgttcacactgtatgtgattgtttctctgttcacactgtatgtgattgtttttctatttatgccgtatgtggttgtttccctgtttatactgtatgtggttgtttccctgtttacactgtatgtggttgctttcctgttcacattgtatgtggttatttttctatttacattatatgtgattgtttttctgtttacactgcatgtggttatttccctgtttacactgtatgtggttatttttctatttacattatatatgattgtttttctgtttacattgtatgtggttgtttccctgtttacactgtatgtggttgtttccctgttcacactgtatgtagttgtttttctatttacactgtatgtggttgtttccctgtttacactgtatgtggtggtttccccgtttacactgtatgtggttgtttttctatttacactgtatgtgattgtttttctatgtacactgtatgtggttccttccccgtttacactgtatgtggttgtttttctatttacactgtatgtgattgtttttctatgtacactgtatgtggttccttccctgttcacactgtatgtggttgtttttctgtttacattacactgtatgtggttgtttttctatttacactgtatgtggttgtttccctgtttacactgtatgtggttctctgtttacactgtatgtggttctctgtttacactgtatgtgcttttttctctgtttacactatatgtgatggtttttctatgtacactgtatgtggttgcttccctgtttacactgtatatggttgcttccctatttatactgtatgtaattgtttgcctttttattgcctgtccacctgcattccttcagcctctattactgaaggtctgtgagagcagtagccatgcctctttcatgcactactgtgcacccagtagcattgccagattaaatatggatactcagtgaaacttgaattgtgactcaaaacaaatattaccttcattttactaatttatttttaaaatggacacattataattgtacatatttatgggtataatttgatgttttgacacgtgtgtgttgcataatgatcaaatcagcatagttaacatatctgtcatctcatgcatatgtgttttctttgtggtgaaaagattcaaaaacctcttttctagctgttttgtaaaatacaataccttacttttaactacagtcactgtactgtacaatagaacaccagaagttattcctcctatctaattgtaactttgtatctgttcactaacctgtccctatcctttcttcacccatccccttcctagtttctggtaactactgttctgttttctacttttatgatgtcagcttgttttaccccttagatttcacatttgagtgacatcatatgatatttgtctttctgtgtatggcttatttcccttaacatgatagcctccagtttcatccatgttgctgcaaatgacaggagttcattcttttttatggctgagtaatattccattctgtatatatactacattttctttatccattcatctgttgttggacacttaggttgatcacatatcttggctattgtaaatagtgctgcaataaacatgggagtgcagatatctctttggcatactgatttcatttcctttagatatatatccaatagaagggttgctggattatatggtagttatatttttaattttgtgaggaaccttcctactgttttccaaaatggctgtactaatttacaatctctctaacagtgtgtaagtgttcctttttctccacatcctcactaatacttgttttcttttcttttttttttttttttgatagtagccattctaactggagtgaggtagtatctccctacggctttgatttgcatttacctgatgattagtgatgttgagtacttttttcatatctgttgccatgtgtatattttcttttgaaaagtgtctattaagcttgctcttttacctttttttttttttttttttttttggcaaagtctcactctgtcacctaggctggagtgtgatggtacgatcatggcttactgtagtcttgacctcttgcctcaagccatcatcccatttcaatctcccaagtagctgggactataggagcatgccaccacgcctggctgatttttgtagtttttgtagagaccgggtgttgccacgttgccgagactggtctcaaacacctgggcttaagcaatctacctgcctcagcttcccaaagtgctgggattgcaggcatgcacccagcttctattttttaattgagttatttggttggttggttgctgttaagttccttagctattctggatattaactccttgtcagatgtttagtttgcagatgttttctcccattcagtaggttgtctcttcactctgttaattgtcttttgctttgcaaaagctttttagtttgatgtaatcccatttgtctatttttgcttttgttgcctgtatttttgaggtcttatttaaaaaatccttgccaagcccagtgttgtgaagcattttgcctgtgttttcttctagtagagtcatagctttaggctttacatttaagtctttatttcattttgagttgatttttgtatatggtgagaggtaggggcctagtctcattcttccgcatatgaatatctgattttctcagcaccatgtattaaggagactgtccttttcctattgagtgtttttggcacatttgtaaaaagtcatttggctgtaggtgtgctaatttatttctgggttctctattctgtttcattggtctttgtgtgtgtttttatgccagtaccatgctgttttgattactataattttgtagtatattttgaagtcaggtagtgtgatgcttctttcttctttttgctcagaattgctttagctattctgggtttttttgtgatctcatatgaattttaggattttttttctatttctatgaagaatgtcattggtattttgataggaattataataaagctatagattggtttggataggatggccattttagcaatattaattctttcggttcatggacatggaatatcttttcatttatttgtgtcttcttcaatttctttcttccttgttttatagttttcattgtagagatcttttaccctgatggttatgtttattcctatatagcttattttttggtagctgttgtaaatggaattatcttcttgatttatttttcaggtagatcactattagcatatagaaatactactgattttttaatgttgatttttgtatcctgcaacattattgagcaaataatatcctagtataagtatatgccaaatgtaagacatgtttatactgaaaaattatttatggttttcctgaaactcaaatttaaccagatgtctggtaggtttaaatgctacatccagcaaccctagtacctggcgttgagtagggtgtgtagcatattgtaggagctcaataaatacttgaatgaacaagagagtgaatacaatgaaagaacacatttctttctcatgacaattttacaaagtggatcttattattttatagatatgatgagcaaataattcaataagcttgtctgtgggtccagagccagttaggacagggtgggataacagtcaaattttgaaactgctcttttcagcttttcagtacattgtgctgccttgctttgttaaatgaaatttcttccttgtagcagtcagattttttggttgtatcaacagaaaactgaaccctccctagtttaagcagaaaaagatatattcatgtgtatattaaaggatttttaggagctctgggtccctggaggccagagaaacaaaccagaggctgactggccaggactgattcccccagcgtgttgtagaactgatccaatggaaatattgatgttgccctcactgggcacagatactgcagcctgcaccattgacgtccccaatgtggaccactagaccacacagccaagcccctgacccttagggcttccagatgtagctgcatctttccttgccagtgtacatacagcttcacactatttgtcccagatatatctgattgagaacctgaaggcatatgtctccatgctagctacaagagagtctgggaaagtgaacctttggcttctaaagtcaaagctatctctgtctccctctacattcattagaaggggaatttttcaagcacaggaagtatcttaaaaggtgctgggcagcctaaaagataatacgtgtccacttgacactgcctttgagcttcagtagcgcaataccttttgattttttaaggcaggtattactttctaccttgtttgaaaacaggagttgtgtttgctttaattttttaatgtgcccacagagtactgagcctgtactctcaagaggcactcaatatatgaccgaataaaagctgaattatctgtctagtgggattttataggtgacttaaattctgttcgtgtgtatttaaaaaatttccaatcataaacatttgtaataaaaatagttaaagtttccaaaacttgatctaactgggagaaaaacaataggtctgaagtgtcttatcttcaaatctgaaatccaaaattctctgaatgtcgaaggattttttttgtctgatacctcattggcagaattacctgacctgaagtgacacaaggctatttatagtcttcattgttccacttaattgaatattcatatgtttcccggcagaaatattaatgtacttgattacaaactgttgccctgatctcactggagtactatactgtatatgatctctattatctctataaaatctggaaaactctgatgttcaagactcatcagtccccaagggttttttgaagtgtgtatgcatgtgtgtatttgtgtatacacacttgcataatatgtacatagaacgttctggaagggtgcattcaaattgccagcagtgattatatcttacagaatggattagatggggagatagtgaggaatgaatttatgcttaatattctttagcatttctaattattattataaaaaacaattgcctttttaaatgaaagaagatagagtagaattgaatagaaatgttcttgtacttaggaaaatagtggtaatattaattttaaaagatggtttgtcaagtaggctatgcgtttcacattagttcaacattacaactgataaagactcagaaaaagttatacacagaatagtcagtctcctgccttttggacactatatgcatgcccaggtggcagggaatttacgtcagcaaaagcactaattttgctaaaaaaaaaaaaaatagaggcacacaaaaatgtgatgagtaaatgaaacaactgttattagtgacggatttggcatgttttacgaagtctgaatgattactcatccactgtacatttgcagaagttctttaataaaaaccagacgcatatgtagtagcaggggttagtaggtggatgggaggattaaaccctgtgagtttctggagcattggtttgtaactgttttttggcttgtcaacaggctatttttctgagtcagcctataggatggcttcccagggtaagtctgattttgcttttctggttttaaaatataaagtggtaatggagagctgactagttgctctctgcattagattctgtaaatcaatattgcctgcatttcttctgtaagaaagacattggtcgcatttcagcatattctagtgttcctgctgctcatttttgtagctttgccttacctccccctaattttaaaagtcaaatgcccaagtgctgaaagaatttgcaaggggaattgcaaaggtcatgtgtaagttctgtggctgaagtgtggagagcagtatgattgagctgcagcccttcatgaacctttcttttcaagaggaggtttccaataaattagggtagcacactttatgtgcttgtttatgaccttaaaaatggtttagattttgctgagtggccattactgctgctttatgacatggaataatggtttcaacctgcacagtttttcatttttttcatttttgtactgaaacaatgtcatgcatcagtcaatgtgaagttcatttttttttttcttttaaagggacttgggagaatgttagacattagaataagtggctgggttctaactccagagaactttggttcttgaaaaaaaaagtgaagattctccaagccgttacaaatgagctttgtagtgatctctgatgaaatgataaaaacactgcttttcccactggaagataaatgccccttttcattaactatagtatgaggaacaaaatcatgtgattttcttttttttttttttaagtttaaccttaattactttttaaaggcagttttcattttgtgattacttttttttttcttccggtgcctagcatagttgaggattttatcttcttgtctattttaggatactctaatgaataacggaattttgacgtgctctttcaaaggaagagtctagttgcatcctcccagccatcggctggttgagctgtcctacccacttcgtttcagctcatggaggccaccgtgaggggctggggcatgtcagtggcccacagctattctgaatggtagttatatctatgtgggggctcagaagggaaccgactttccattcattaatgttcagtacccacgaaagaaaccgatatttaaaaaaaaaaaagtaagggaatttcagttgattttttgaaaaacgaaaacgttcacattaggacctttaaaaatgaaagcatttatgttctcagtgctgtggatctcacatataaataattgcaccccatccccctccccccacacccctcctccccaagtctgaaaccctgttgcaagggctgtgtgaagtgggaggttaatgtggcctctctttctgggacatcagtaattcttgaatattttgggtaagggtagaaaagtatcccatttcagctgatcagtaatttaggagcttttaaatgctgatgtaagcaagggtatattatggaatagaatctgagatgatactataaagagacatctctgttgctaagggtcagtccagaccacactcctagaccttacttctggtcctccttgcaagggtggtcatctgtcctctgctgtgagatcttctttggtagaaatgtgatggggtttgctttcaccccttctcaaaaggctgtgccaggaacacttctatgggcacaataaggtgaaccactgtgaggtttgagaaaattaattgcccggggtgagctggaacacttaatccatcgtgtcacatatacacagaggtctttgaaagggacaggagtcttgatggaaggctcagctaccatccagacattgttagaataagaagacaattgctcctttcaatgagagaaagggaagaataaaatgtgatggagattggcacctcggaaagggaagaataaaatgtggtggagattggcacctcttctgccattctttaacctccataatgacttaccaaagagctttttttaaaaaaagagatcgacaggaaaattaattatcaatgatttcagagcagattattagatatgtgaattatccagcctctttggattttgtcctgttgtcatcatttgtcagtatttctcaacatgtcatcgaaaggtgattcaggatgaagcacaaaactgtttttttctcttttttttttttttttgaaacagaatctcactctgtcacctaggctggagtgcagtgctgcgatctcagctcactgcaacctctctgccttctaggttcaagcaattcccgtgcctcacccttccgagtaactgggattacaggtacatgccaccatgcccagctaagttttgcatttttagtagagatgggggttcaccatgttggccaagctggtcttgaactcctggcctcaagggacccacccaccttggcctcccaaagtgctggaattatgggtgtgagccaccacaccaggcctctaaactgctttttactcctagttgtgtgttgccagttcagaaacttaattaagcttatggaatgacagacatatttcaccttttagtagatgagaatacattcaagactaggcttaagtacatatatcttcgatgtaatttattaaacccttaaatccatattcacacatacaaaataatcagatcttaaaataattattggaagaaagaagagggaaaaatagtaggcaatcttcatgacactttaatgtgtatgtttactgcttaaaatgttcaaacacatctttgttttgtatagttaattttggtggtataatatttgaaaaggtgatagataaaaagtgcaggatgcaattcttgaagctgtaatttgcaggacactaataatacaagtccattttcttttctgagtgtgctatttatacaatttatatttttaacaaatcttagaactggaatgaaaatagtaattcatcttaagggtaagaaaggttgcagctgtgccaaatttggaaactttaatcagtcctcttagtgcttaagcacagactatggaatattctaatttgtatgtcacagagcacagtgctcagcagaaagcatgcactatcttaaattaatgttaattaattaatgttaaatgattgagtcaatttggcagtacttcttttcgtctctgaaaagaaatcatatttaatttagaagtggcaggtcaattttaaagccaagctaaaataagtaggtcaagtgaaattgtgcacagggcagggatagtggtgttatatgtacgaagaaaaaagactgaaaggaaaaatatcaaaatgtttacctgtgaagatgatgaataatttgttttttatatatttttgtttgcctttagtttaccacagtgggcaaatacattcttcggagcagtatactttcatgacatatgttaagctttacataactctttgttaaatctcccgttgatgaattaatagtaaacatgatacctatcaaatatgaagtgagcggtgtcctctgtagttgggcagcatagtagctttgagtggaacttacattctagcaaaattcattttttcaaataagattttatgtaaaatccaagtatagtcagttctgctataacacaacatatgtgtttctaaaaaatcatcaggctactccaaaatcatgcagtagacaacacacgatgtataggaaaaatggggctaggagcacaatgctaaaaaatttcatcagtgacatctgaaaaaagaaaagataggaagctaataaacacagtagacagatttataccctttaatttaagcgatacattaatacaacaacaaacttgttactttgctttgaataacacctggattttgcttgtagaagtggcttcagaagagttgcagctggtgagttattatgcagtggtagaaggaagcttatctgaaactggatcaaaaattatagcatcagaagtgaatgagtgtgatgcataacactcttagtaaacggaggtagccggtagatgtttgaagtgtgtgcttggtgcagctgggtgcagttttcagggtgttcacctactgtttcttgaagacagaatcacgcacaagcaaaccaaaattcttgggggatatgctcaagttgtttactgtgtaacaaatttgcatttccaaaatcaacgtgatggcagaactgactgagatggatgaaaaaaagctgcactagctctaggtatgtcaggagcccagtgtggaacccaacctccccatcaccaccccaggggttccacagagcactgctgtgtggtgtaaactttattttgtttgtttgtttgtttgtgacctggaacagacacagaaagttatttttcttgtggagagtttcggtcctacctacatatccttccctggctggagtctggaggtgtgccaagggctttggcattgacaactttcagttccactgccagatgggctgtccagtaaagcaaatggccttgaactgaaaaccctatagaatacctcgctccaggtccttgccagggactataaccttgagtactcaatgagtactccgtaagtactcaatacttatgaaatgctgctatgaaaaaccaatatctatggattacagtgtgaagaacagatgttcatttgtttctctggatacccaacaacgagggaagaagggtatgttgtttgagaaatcattttccaaagtgtcaatattgaaagaaggcgtgagaaatttacatttatcaaaaggggtcattggttataaaatagttcagggaaatctgtataatctctaccagaaataatctaggccagcagaaatctctattctgagattttgatatccctgaaaatttgtgcatcctccctccacccccggcaattagttttactggattatacttaatattatgcctctgcccccattgaatctcgttacaagatagagccttacaaatctttattgtatggggtgtctgtcttgtgggtgttacaatgtcctttttatgaagactcttgggtgaagtgtctctctggtttcaataccacaaatgactgtacttctacacaactttgggtttttattttatgtatatagttagtcatgtaactgatcatgttttcttcctctttatggccacagacatattttctttgacccataccgtttttgtttgtttgtttgtttgttgtactttaagttctgggatacatgtgcagaacgtacaggtttgttacataggtatacacatgccatggtggtttgctgcacccatcaacccatcatctacattaggtatttctcctaatgctttccctctcctagtcccccgccccacgatagaccccggtgtgtgatattcccctcgctgtgtccatgtgttctcattgttcaactcccacttacgagtgataacatgtggtgtttggttttcctttcctgtgttagtttgctgagaattatggtttccagcttcatccatgtccctgcaaaggaaaacaactcatcctgttttatggctacatagtattccatggtctgtatgtgctacattttctttatccagtctattattgatggacatttgggttggttccaagtctttgttatggtgaacagtgctgcaataaacatacatgtgcatgtgtccttgtagtagaactatagtaaccaaaacagcatggtattggtaccaaaacagatatatagaacgatggaacaaaacagaggcctcagaaataatgccagacatctacaaccatctgatctttgacaaacctgacaaaaacaagcaatggggaaaggattccctatttaataaatggttttgggagaactggctagccatatgtagaaaactgaaactggaccccttccttataccttatacaaaaattaactcaagatggattaaagacttaaacataagacctaaaaccataaaaaccctagaagaaaacctaggcaataccattcaggacataggcatgggcaaagacttcatggctaaaacacaaaaagcaatggctaacaaaagctgaaattgacaaatgggatcaaattaaactaaagagcttctgcacagcaaaagaaactatcataagagtgaacaggcaacttatggaatgggagaaaatttttgcaatctatgtatctgacaaagggctaatatccagaatctacaaggaacttaaacagcttttttttttcaaacaaaaagaaaaactattttccagcattccagtgctgagacaatttcacacaagtgtgtttgaattactagcatttactgaaaaatcagatctggtaacattgaactctcatgtcactatggcaaccatgggattcaataaagtattgccattttccttaaaatagaacaggcactcttcagttttactttttttaattttacctgcctgggccctgtagatgtttaactgtaaaccctctggcttagaaagcaatttgtgacccacctctagaaaacgtgcaggcttttatttgcatttgtgtactaatcttattcctgaactcattttatttttttcttgaattatgtttccttcattctattttcttcatccacttatattaattttccatcattggttcatcttgggatgttgtgtgctttttcataaattgctttaagtccttttagaaagaagcaagaggtattaaatatataaatattaaaattaggagaatgacttctttctcccagatcattttatttttatttttggcctagtaaatttaaagtgatttcagctatttttctgacctatttttgagtctacttgattctagtaccattcagagctctgcaattctttgttttcttttcttttcttttttcttttttctttcttttttttttttttgctatttcctcacagaaactctgagaaaacatgagacattcagtacatacattgttttgtacctaaagttggttgactctctatgattttgcattaagaactgaagagttaagtaattttcacatacaatttgggatttccatatctccttgagaaatatgaagacacaactagacccagttagcctttagatgtgtttgtgtctagttcaccacatcttttccttacctcccccattgcctccatgacactgaggctgaatgctacttgtcctgttttccttgattttcttggtctgcaacccattgttggtccaccacccaagctgatcctgctgtcaaaacatgttctactctttggcaggcactgaattggcttttctttaatgtccctcttagagccgcgagcttcctcggcaggagtgtcatggctctgtgtgtgcatgtgtaggtaaaaagaacactaggttaattcattcaccaaatgtttattgagcacctactttgtggcaaggactgttctggtgctgggaatagagcagtaaataaaagaggcaaagatatgtgccctactggagtttacattctactgggagttggtaagtgctataaagaaaaataacaccaaagggctttctctttaatttgaggatgatatgttagaccttgctgcctagggctttttttttttttaacagagatctaaattaattgagagatctaaattaaatgagatctaaattaaatgagctgtgcagctgtctggggaagagcatagcaaaccaaggggcagcaatgagagtaaaatcctgaaggagagaacatactggatttagtattagacatgacttttatttcaaatactgccttgcctaatggtgtgaactgtgaccttctggaccatgtctgggaactcatctctaaaatgctaagattctatgtagaagaaggaccatgccttactagtttctacccagtgccaagtctagtccttggctcttggtaagcatttggtaaatatttgtgcagttaacagatagacacaacaatggttttaaaagaatataaagcatcttggccagccgcagtggctcatgcctataatcccagcactttgggaggccaaggcaggtagatcacctgaggtcaggagtttgagaccagcctggtctcaacatggtgaaaccttgtctctactaaaaatacaaaaattagccaggcatgttggtgtgtgcctgtaatcccagctgctcaggaggctgagacatgagactcacttgaacccgggaggcagagtttgcagtgagccaagagtgtgccacttcactccagcctgggcaacagagtgagactctttctcaaaaaaaaaaaaaaaaaaaaggaatataatgcatctcaaaagccggatcttagctgattgtttaatacaatcccagagattaatgacaaggaagatgcctagtcctgaaatgtgtccaaggaatttctctttaatgataattccatattttctgcacttagcaagacacatctacacatcaaactggggattattatgacccaggaaagggacctgggattctttgactgtttcctcttgagggcattagtgtcactgattgggagacagtcctctaaattcagctaaatattggtcaccctctataaggacagtgggacagcgggaagcagactaagtgcaaggattgtgtcttagttgttgtatccgtttttttcccttagtgtatcccaacttctaatgtagtacccatgagctcacagtaagagctcagtacatatttggtaaagagtgaataaaatcaagggatgcattttcaagctctttcggaagacagtgttggagtcatgctggaaagacatcatacattctgcctgtttccttcctaagaaggacacactagaactagaggagattgaaaaggctgaaaagtggcgtgaaggccagacctagtggtaatgtcttatttgcataactcatttagttattatctttacttacatatggggaaatgaggtcagagctagtaagtggcagaaccaggtagtttgactccaggggttgtatttttaactccaagagtgtgttacgtacagagaaggataactagcagttacagaaacagaagtatgaaaaaaaatcattcactaaatagctgaatggattctgttagtggcattagtgactgatgatcttttctggtgaaaaatcatttctttcacatggaacaggtttcagatggagagaaaagtctactccgtaactcacacttctctggcttttttgtggactcctccaagactttgccatgtttcatttcttgagactttatatcagattttctaaaagccattggggaagcccttcataacaggaattcttattttgattcagataacacatgggtatttcctaactaccatgttcccaatcccacatgcttcatagcctaagagctctttccacatttaatgatgtgctggccacattatttcccatcagcttcaactccttcttttctatttcatgaaaaaattcttgttcatgaacgattaggttttcttctgcttattttccgtgtagatagaatgaactcagttgttacgatgctcttgcagaagaacaaatttaaagctggaagaaagctttgcgaatttataacagcagtctgttgggttcagagagaattgttggaatcctatgctttcctttcatttgtgtgcttttcaagtgaggggaacattgtgatttttgtagatggtgtcagcatagatggcagagataagcagatatcctggccagcgttctggggaagatgaaaatgcttgtgttttctcatgactttatttttccagagctgactctatggcaatatcactctgacaaatattggctggccatggaatattttaaagagcaagggttttgtgaatgttctgtctattaccatggctgaggaatcaaaacacaatattctccacacatttcctcgagcactcatggatggattccagtatgatactttcatgttagctcttagaccacaggaagaatttaaaataaatgattactgaaaacacaatgaagaagaatcgagtagaatgttttgtaccatttttctctttctgcacggtaatatcatgctcagagtggtgacaaagactaactgagtgcaaaagggctttgcaaaaatttatgttttcagatgcttgttgtgaacatgatggcaatgacaatcatgtcacatctgcttcgctcgtgatctctatccttatgtaaggaaagagcagacactgatgatgttcaaaaacaaacccaccacagacatcccaaagacttctataattttccccccttctctagaatgtacttctcacattattgtgtgattaatgagaataaattatatggtgtgagtatacaaaggaaggaatttgagagatagctttttgcactggaaattatttgggcaaagattcttccttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccattttagccggggtggtctcgatctcctgacctcgtgatccgcccgcctcggcctcccaaagtgctgggattacaggcgtgagccaccgcgcccggccgggcaaagattcttctacagtacctcttgggtctatgaatgaagcaggatggcctggatgtaaattaaggatttcagttacggtgctgttttagaggagttccctttgtgatgccatgttcgtatcaggctctggtgaccaagatggtggtggcggtgatgataatgtttattatagtggctgcagtgtattcactgcttgtacttcaggttctgtgcaaagtacatgccaggcattaatctatgcattattccacaacagcctgtgaagttgagactgttcttatgctcattttgcagatgacgatactgaagcttagaaggcttgagtaatttccccctgggtgaatagctaatgagaaatgggaagagcttggaattgaggctagtactctctgaccccagagcctgggctctgatacctcatccttgctacatcctttctagaagtaggaaactcttgcctggaccatttcaggggcctgttgcctctccctactttcctcctgtttcctctttagctctttttcctagcatgtacctcaccattgaaggtccatcatccctgtttctttgcctgacttatatacctctcaatcttcaggacttctttactctggggtctctccttcgaattctcataatattttgttcttatcttaatcaaaactccatgcagtttgtggtcagctagttaagtattccagggattcctaacctgtggtctgagcagtcaatcgagttttttgtgtctatgcctgtgtgaattttctctgaagtctgtagttttcatatgaatctcagaaaagtatttgaccaaaaagatcaaggtgtttattgtttataggatcccccaccctcccataagtaataagctcccagaggaaaggagcatatcatatttatgtttatttccctagatggatataataggataatatttttggagtgttcagatgaatgaatgtagttactagttagacaatgaggtgatatagcctgtggcttaagaacataggatctagattccaactgtgccttgggttgaattccttctttgcaaaccgtttggcaagtgatacagtctcttaaagtctcattctccttattggtaaaagggatactaaaataatattaaaggtagaaggttgttattgaagattaaaataaggtaatgcatataaaatgcttagcttgggaatacatagcataccttccataattagctgctattattattacttaagaaccttttgaaaggggccaaacaatgaggttctcatgattttcctagtgactattgcagagaaacaaaaacctgcaaaggaaagattgtttgcatgctgcttttgagtcttaaagacttagaaccgatgtgctgtcattaactatggtgccaggtgcaaggcagctacctccttaaaatgtttttcttgggcatttccattccctgtggccttgaccctggatagacagtggctcaggctccccagacaggcacccagaatgccagctaatggaaattttgtgatagtctgcccctgaggatttggacatatgttgttttgtgtctaaatcaacagaaataagtgcagctgtagttaccccctctgcataatcatctaagtagcctgtttctttgcatgctcatggagcccccaagtgctgggcccatcacttgccacccactctgtgcattgcaaatgagtacagtaggtcagataaaaggcagaggctggttgggcatcattgctgacttacacagcaatgatgaatagttacacatagatcaagacataaaagttatttataatagtctggtcaccagggtcacattggcaagaaggaacctttggaaaggtgctttggttggatacttctgaactctggctcattaatgtgtaccaaatatagaaaagttagtttaaaatctctttacagaaaatatattatgagctggattttattgacataggaatactgacttatacttttcctataggtttctttaaagtatgtaccatttctttttattattggtaattgtgaccttggctcagtcatttgcaaattttctttttttggtatatcttaaaaatggatagcaccttttattcataattaccccaaactggaaacagcctgaatgtccttatactagtgaaaggataaacaagctgtggtttatccatacaatagaatactaattagcgatagaaaggaacaagctaccgatacctgtagcaatgtggatgaaggtcaaatgcacttgctaagggacaaaaaacagactcaaaagcctgaatgctatatgattccatttatatgacatcctggaaaaggcaaaacatagaaacagaaaactgataggtggtttctgggattggagatgggggctgttttgactacaaaggagtagcacaagagagtattttgaggtgatggaactgttctgtatcttgattgtgctggtggtgacatggctctgtgcatctcaaaactcgaacggaaggtgaattttagtgtatctaaataaaagtaaaagaataaaaaaggagatgaaaacatttacccaatatgctcacatgctcacaaagaaatgttgctttgaaaaggccgatatatgtaatttaaatttcataaatttaatttaaacctcacaaatatttattggtgagctgctataatgcagtgctttatgggaaatcctaaaggaaatactgatccatgcactcagtaatgtaaccatctctttcggcaaacatatacaaacaattttagggtgattttaagattataattatattatgggacattagaggagaaagaggcatctagatgggatcaaggaagattgttaagaaagtgaagaaggtttgtcaaggaatagtcttaaagaataggtagatttttaaagtatttttagtaaacttttaactgaaatataatattcccacagaaaagtatacacatcttacatgcactgcctgaggaattttcaccagatagctagcacccaatctctaagatagagcatcactagcacccttgtgcctcctcctagtcaacccctcttctaagtataatcactatcctgacttctaacaccatggattaatcatgtctgggttttatttaacttcatacaaatgaaatcatacagcatgtactctcatatctggattctttcgcttaacattatgtatgtgagatttatcccttgtttgtatgtagcagtagttcattctcataggatattccattgtatgattacatcaccatttatccattccactgttgatgggaatttggtttgcctagagttctgcactattatgagcagtgttgcaatgaacattattgctatatgctttttggtgaacacacatataaatttatctggtttgggttaagaaatggaattactaggttatgaggcatgcacatgttcagcttttggtagatactgcaaaccattttccaaaagtctttctgtgaatttacaccttcaggagcagcatctgagtgtgccatttgctctgttcttcaccaacatttggtaatacatctccctttcattttactgaagaatacgtagtgtttttttgatagggatggtgagtgcatgaagagtagtactccaggcaagagaacaccccaagcaagagtgtacagctagagttagagaataagttgtttatattggtttgaatcattacaatagataagtccagaaggataagttggtgcttgattgctagtctaaataaaacattaaaaaaaaattcattcattgtatagtgatgaaccattaattttgtgaccatagttgcctgaaaacagcaaaatcgtgctttaggaagtgttatctagtagtaggtgtataatattttgggggaagttgtcagaacaacctagtagtccaggccagagtttcaccatgtcagaatatctgtgagaacagagatggtggttgatagataagatgtgataagcatctgttcggtagagggttaaggggaaggaagagtaagagatacctctgaccctggtggtaccttagccaattatgccaaaattcactattatccttcttaatgtctttaaagagtagtttatacttgccgtatccatttctttacttccctatatggcttattttttaactttttcattactaacaatattcaatattattattattaaatatatcatacatatagaaagcaatacctgtccgtttagtaaagaccaataaaatgaataaccatgtgcccaccatccatcttaaaaaatagaaccctctggaagcctcatctttgaggcattctcctctttactccctacctagttaaccatcatcctttttgttctaatcactcctttgcttttcattacacttttagaatcgttgactacatcactaaactatgctttgaactttaaataaatggggtcataaggcaagattctatgtgacttcttttttcattccacatctgtcttgattttatccatgtaaaggcatatcactcatgtttactgatgtgtagtgatgcattgtgttaatattattcctcagtttattgatctctttcgtctttttttttttttttttgacaaagtctcactctgtcgcccaggctggagtgcagtggtgtgatctcagctcactgcaaccttcgcctcccatgttcaagtgactctcctgccagtagctgggattacaggtgcacgccaccacgcctggctaatttttgtatttttagtagagacagagtttcaccgtattggtcaggctggtctcgaactcctgacctcgtgatcctcccgcctcagcctcccaaagtgctgggattacaggcgtgagccaccgagcccagctgatcacttccctcttaatcattaatccctggacccactgaccctaatattgtggcatatgtgatagactgaagtaaatcatgtattgtgtcccatagacttaaaactttttgttaataatttaatgtttacaatgaggtggaactacagttgtccttggtatccttgggggattggtttcaggactcctttggataccaaaatccatgggtgctcaagtgtctgatttaaaatggtgtagtattttcatatatcttatgtacatccttacatatactttaaatcacctgcagattagttctaatacctggtacaacataaatgccatgtaagtagttgttatactatattgagtttttatttgtgttattttttattgttgcattgtttttatttgtttgctttttaatattattgatccatggttggcagaatgtgtggatgtggagcttatggatacagaggggctgactgtattttgtcttctgtatgaaagaggtgcttattgtacaatagagttttccaatctgggcaatattgacctttgcagccagatattctttcttgtgaaggccatactgtgcattgtaggatgtttaacagcatccctggcctctactcactagatgccagtagcacttgtttctctgtttgcaaaaaccaaaaatgtctctagacctgtcaaatgtcccatggggacaaaattgtcccttgttgaggattactcctctaaagtattaaaattcagtgaaaaggcagtgagttaccatgactgactggagagaatcacagaagttaccttcctcttagtacttccctgctgccccatcccagccctaggttggtgactgtgaacagtggtatttttcttttgtcttttggtagttgacttttactggtcctggagaccagccccctcatgttgtaagcatgttatcagttttaccccccaccccccagggactacttttctgctctcatggtctacattctgcctacgtgtgactctctttgccctaaacccctcctaatccagaggcagtctttataagtccaagggagatgatcatgctcattgcattgcatttaaaaattgcttccatttcccataagcaaaaaaaaaaaaaaaaaacacttaaagaaaaaaaagtacatatctttttgaaattgtcagtttaaaaatctataataataaatacatgttaataaagaagttaaataccaatgagttacaagatttatatatttgaaatacacattttatagtattattgatactttgatattaatttaagcttaagagttatagaaaatgctaaaatgatagggccttttgacctctgaaatgaaaatttaaaacatttaaagtatatttagttagcacacagctctcccgtaactttgtgtaatgattttttttttcaagtacaacacaaaacctgctcacgaatcccaaagcattataaagctggctccatctagtgtatgaagtactatatagctaatactgggggaaaaattgtactaggaatctcttttggtacttcattatgaaattagataacaaccaaaagaaaaatggactgtaagctaaatttatgttccaggagataacacaggccagagtgaccttcacagcattagaggagaggtctttatatatcgaagcatcaacctgtagcatgcctgacattttgttctgacagccttgattttttttgttttgttttgttttcccctgggctagaggtcttatttacaggcactatcaacaaacgcagcatgtaacttccatggtgatattctcagtcctacttggccagcttcccactttttctgtatggaatcatatctgagagtcatgctcatttcccacagttagtgagagattggggctgggctcacttactgtgatttcagaaccctacatggttttctttatcagactgaaattctttgtagctattagcctctcaccacaatagagtgggccactctatcggggctgtgtttaatctcgtttccactgaaagtttctagcacattctttatatctctcaatcaatgtttcctaaattttagctattctcatgctaacttcattacttttgcttgcaaaaaccacatggaactttaaatattacatgttttaaaggaaatgttatcatacatggaagccacgaatggaaataggtattaaaatcaatataatgaaattgaaagaaaattgttagattcttgctaggtatattgtctggaccggcaggtgtctgaggtctgacctgtattgtgaacaaagggcaagtgttgagagattgaagacatattagcatcaaacagagactttccttagatggaagaaatttgaaagggcccttctcactgtgtgattccatgcttagttaatgtgaagtctgtacatctctatttgagatcatcttgtatcccacactttgggaacttttgctcaagatttaccatgtttctcaaaggaagcctatcattctcccccaaatttccaaagaccttgtttcccctagaaagcctttttgaaaaattatttccttttttgagaactttcttcttctattaagaagtataaattgtgttgatatgttgggttactttttttttcttccttgtaatctcatattttcttagtctcttttctaactagattaaattatttgaggacaaacattgtttctttctagtaaatgccattaattgaattcatgcttggtataatattcagggaagtctgcttcattctctgtttttttgtgtgtgttttttgttctgttttgtttttgttttttttaagtcagatcatcgttagaggtggccaagagaagccattatggtcaattaattaatcatttaacctattggtgaatagttattgagtgccttctctgtgtctggaattgtatgtggtgaaagaatgaagtagtgacctaaacagacatggttcatgcctttatggaattcagaatctagtgtggggtacagacaagtaaagaggcaactccagtgcaaggttctaattttagaattagtttgcttttgtgttcattgggtagattacaaaaacttggaacagagaaccatagagaggaaagtgtgggctctggagtttcaaactccagacctgtggcacattaacctcttgattttgcacaggatactcatatctcaatccctgccccccccagtttctttctttaaataaaaaagatttgtttaataataaacatggggtatgatatgcaaatatgagatacagttatcagtgtgacaatatgataaacaattctccatgtctcttctctcctccttcctcttttttcacataaggcagagacgtgatctcatggtttttttttttcaaattttcatgtttctttcccaacacgctaataaatgaaaatgcagtgatctagatcaagtataggaactaaacatgtttgttaatgggaatatcattgtagatggtgtttaaaggttgcaaatgcattcaattttcacattgtctgtttaaattaataaataatttgagcattcagcattaccccagaacatttttctcttaataatcatgatatatcagttatgcatcttaagcctattgaacagtgcctgggacataggaggtgctcaataaatatttgtttagtggatgaatggattttaataattttgactcttccttcttttattcatgattttgttaacatcttttaaaaatgaaccaatattgtttgatattaggagcaagataagcttaaattatggtttatattattctctatatctgtattaccagccttacctgttatatctggcaggtaattaatatgtagtaaatgttaaggggagaatttagtagtttttttaggcattatttttttaagaacacatgacaatattttaagtaaggatttaatttgtcttttatattatttcatggtaatattcattggaattacagactattaatttaaaatattggttatttgaatattttactatcaacattaatatacactttgattataggtaagactccctagagtgtcaattagatgcagaaagctaatgtgcattgagtttattatgattgattagagtttattatgattaatcaacagacaggaaggatttttgtgcaaatattatttttctcattttaaatcctgtttgctcagcataactgtaacaggatgtcattagtatgagagtaagttttgagatgctttaaaagtttgagaaatttgactgttagcaaaaatttaacataaggtgatttatttagcataaagaggtttgattttttatagttttacttatttaaatacacgacttcctgtgtgactcctgggtatgtttacatagaaaaaatataaacaaaaattatgattgacacactgaatcagagcagaaggtttcctggactagaatttggtttgtagctaagacaaccactgaaaagacagagtttgttgtctactatcagaagttacagataccatcaatatttagtctttagttatgcactatgaatatattattcacagatttatctatacctttcctgaacttacatgtattttgaatctggactacctcttaagatatcaaaattcaaaactaccttaagcattgtctccaaataataacttttatttgccctagaatttaaagttctttgaggctctaagggctgacttttcattacctaacaatgttttgaaatagagtcctcgctccttgtgtcaccttgattgagtgctatttttcttgtaccatgttaagtacttttcatactttatctcattcaatcatagtattaatctatgaaataggtagtattaatattcccatcttatagatgcagatcttgagactcataagtcgaatgccttacccagagtaaaactaggatacgaagggtggtgtgtgtgtctgcattgaatcaccacactatcctgtctccagttggaaaaatggtgccatgtttatatccataggagtgacacatttattaaatagcagacctctcagaagtttgcttcccacaggttgaaaccactgccctggatccttaccacatcttatacaaattggaggttttgcacaccagtgacttccataccaccttccacaatggcatcgttgtctgcaagaaacagtgtctctctaccttctgctcactctttggaatacaaacatttaatttatatgaatagactataaaatctagatggcagaatatccctgtcttctttatctcagtcccttcttctggctcctccttggaccagaatggatttagatggtccatggaactgctgatgtcctgggatctcctaatgagatggaatcaagggaagggtgggttcatctcagcggctgtgagcttagccaaggtggtccatggaggccacttctacagctgaattgcatgttgctttaaaatattataataccttgactcctgcttggaagaagaaagaaactgatgttgtagatgaagatgatggtgatgcactctcctgtttcaatccacaacacccctaaaagataggcagagacattcatattcttattgtccttcaatatttcataacttaaaaaaagttactaacagtaaaatatatgtccacatttttctttttaaatgagtaaagagttaacccataaattgagataaaaacaccatgattttcaggtgctgatgtggagattttatttattgtaaagtcatcttgtgaataactttgtcccccacactgatgacagccttatcttttcctgtttacttaccttgataagatagtaaattgcatttttactaaatttctcatttaaaaatattatcaaagcagcataatctcatcagtgtgttctctccaactttgtgttgtctcacctactctgtttatattctagattgtagttttcttattgcaaatactggttgccatttatagataacaaagaaaagcctctacataacctttaatgcaggaacaagtatttattttgagatgaacactgagagaatatcaaagagtttaaggtaagggattaatccgtggtattgattattatattaaagagtcatgctaatgttttatatatttttgtttgttaattgcttaaaaattcactttaggctgggcgcggtggctcacgcctgtaatcccagcactttgggaggccgaggcgggcggatcacgaggtcgggagatcgagaccacggtgaaaccccccgtgtctactaaaaatacaaaaaaaattagccgggcgcagtggcgggcgcctgtagtcccagctattcgggaggctgaggcaggagaatggcgtgaacccggaaggcggagcttgcagtgagcggagatcgcgccacagcactcccgcctgggcgacagaacgagactccgtctcaaaaaaaaaaaaaaaaaaaaaaaaattcactttagacagaatttgagatgcctctttgtagactatatttttatcctctggacagattctttgaaacagtttttaaaaacatttaatttttccttctggatgtttgtataaatatcttaaccattctttaataatgttgggctgcatcccaatcaggtttatgtggggtcatcttagtctcttctttatttcccttttcaaccttgaagggcttccttggtttccggggacaatgagctgtctttgagaggatgctgtaatatcactgttacaggcagatctgttcttggtaggagaaaaaaatagaaacaggatgaaagagataaacgtgagtgagtgctactgcacagttatttctgcaagtaggtagtcattaaaaattttcttcagtcatgctgtgatggtttcaaattagagccgctggaccagttccttgcaaatttgtaccccaatactttctgcatgaaagtgagttgtgctcagccactaaaagcttgcaaataaagagtacacagttgtatatcccatttatgactattgactttcttcataattaattaaatgctaccctcaaattatacttcatagatccttccttatctgaccttttttcatttttgtcagtcattcatgcattcttctttccttctatccatctatccagcaaatatttaaatacttactatgtgccaggcactgagaaaaaggtaagtacaaggaacctgcccttaagaacacaggacaaatagataaataaaaggattacaagttgaattaagtgctataaaagaaagaagcttgcttcaagagcacaaaacaaaaggagatgtttcttctttaggaaggatggtctgggaagacctctctgaggaagaaatataagacctgcaaaacatcatctgccaggtcaggaggcgccaggccagggaaggagttgcagaggagagagaagagggctctagcattctgtcctccctgtaccctcttcccattggcatgtgagtgtgagtcttgggtttctctggagtgaacgcctggaaagcagagcctcttgcatcttcatccttgtcttccccatggcgctgagaacagtgcctctcacacacatgctgggaaaactaataaatgtttggattgaagggcctttcggtggcatgtgacttttcccagaatgtgagtgtgaggccatctggacaaaagagatgtgtgtgttactcttgagagtactttgtgagtttcattattactttgatgaaactctttaattaccccacaataaggctttcattgaacattccacatggatattttaaagaattaaaatgtatgagtaacttctttattcaataaataaaaggagcttccattcttgagtattttcctgccactcttaacagaccatttacatagataatattatatatagctatatatattataatgttatattatatattagtggtttctagacttgacttcactttagacccctatgagaatcattttttagaaacacagaattctaaaccatacccctgcagaatctcactcactcatttgtttggggaaagatccttgaactttatacttcttaaatctcctgtatttattttaaggaggtggggtaaggagaaggctcctcaagtgcttctgataggaagacaggttggggaaccattggctgggatcataatgaaacattccaagaccaagtagatgcttcttaaattgtgtgtagttcatgggccaacataggacccagcacatagtaagctctcaagtgttaactgttgtggggctattgagtagaagtatgagtttactggaaagaaaaatgactatcaaaagaaagaatataagaaaatatggtgtgctcgggctgggcaataaaacatttaatgcctaaataaaataagaagaattttgagctatgataaaacagtagcattacttttcttcagctaagtcttggacaggataacaagtaaaatcccttatctcttttctaacctgttcaaagcagtgattgaatttttccttccaaaaagattctgaaacccagtttagcttccaaggaaaaagttggctgtcacttggatggttgattactttaaatcccattttagttaaggttcagcttttaaagggtcagtaagaattctgatgactgtagttgatttgctgcaatttagggcaaagagtagtacttattattgcagaagcactggagtactggtgatgtttttattctgcattttgtgcttagtttttctgatattattttttcctccccaaccacactacaaattcttagtctgtgtttaaacttaggatttgggtatctctctctatctctctttccctctgtgtgtgtgtgtgtgtgttcatatgcatatacatatatgtatacaaactcaggaaacacatctgaatagtacagatgtgcccaagacagttgcttacatattacgttgattcattttaaagatattcatcaagccatggactgtttattctgctgagttctagggatacaacattaaaccaaacggacatggttcttgatatccagaagacatgtgttcgttaatttgggtgatgacttgaggagcagtattttagtgctgggaaatgcacgtaacatctcatgaattttgtatatggtggcctgtgttcatatttaagccaagctttggtccatttgctagtggacgtttcattgctgtatccaagaaggttcccttagaactgtactgtaaggtagatctttctaaagtactggtgtaaattgtcaatagaaatatttcttgaggcggtggattgtccaacataaaaagtcaggtgatgttactggctgaacctgccaggggaatatttggcaccacattatgtccccttcgggaagggctggaattgataccattggtttcgtgatcaatatttgagaactcatggagggtacagattttccctgtgtgtgagcatgtaataaatcagagtttcagttctaagatgtacccgagtgccttgtaggtttactcagctttaaatagtgcctaaggtgagagagaaaatctggcttgaacttttatttattttatttcattaaaatttatttttaagagatggggtctccattgcctgggctggtcttgaactcctggtcttaagcaaacctcccacttcagcctcccaagtagctaggattacaggcatctgccaccgtccctggcttgattttttagaaaattatcccttaaagtttctgatatggttattccctatcctttctttatttcttgctcttccactttcttgatttttcatttgtttttttcactctgtctcatttctcttagttctctagattggtcaatattaatacaggacaggtagcactaaccatgattataattgtaagagcttttttaaaaattgagcgtttattatgcatcagagacaatgctgaacacattacttgtcatctctttcagttctaacaataacctatgggtagtcacttatttctcctttctcaggtgaaagaactggggcccagaaagtttagaaaatttgtacaaagtcatagaattagtaagtggtgagatttgaacctggataaataaacgtcagaatctatgttcttgattttcatgccaaactgtgctagaggcaggaaaagagaggtgggataggttagtaagataaatagtgtaacatcttagtcatctgtttaccccaatacctggtacagtacctggcatgtagaaagtgctcaatgactgctgttgatgaactttctcctctaatcgtatttattggtccttagttttacgagcaatctgcccacttttctccactttgcacatctgcccttcccatgagctaccatcacctcctaccaggactattgcagtagctaactctgacagttttctagttggctgtcaacatagcaaccagagagacctttctaaaaactcaaatctgagctcatcgttcccctgcttgccatctctctgtggtttcttgttcatcttgaaacagaatcagtgacctttccctggcctaccagatccttcatggtctggtcctggtcactgtgtaggtctcacgggcaccatgtttttccttcatactatgtccttcagtgatagtgagtctgcctgccaacttcccacctcatagttcttacatatgttgttactgctgcctggaaagcattttttctatactcctcctctccccaactcagatctcagaccagaagtccctgcctaaggaaagcctttcctgacccttaaattttaactttttcacctctctgcagcagttatgacatttttcattacatatttatgtgattatttaatatgtgtttcccattagactgtaaactccacgaatttacacaatgcctgggacacagttggtgttccataaatatttattgaacaaaagaaagaaagaatgaataaaatgagcagagaataaacagaaccagaaatagtttggccgagactcctggctagatatttcctagcattagagggaagttaaaaaaaaagataatttcattatatcacgtaatttgagtttgattatggctgaagaggttgcattattttccaaccatttactttggagataaatgtaggcacagagaggtgaagtaacttgcccagtgtatgcagctagtcagtgtcagatgtctttgttatgacctttgaattgtgtgtagggagaaacatacatacaatattttcacaactctgtagggcatctttggtgtgctgagtcctgtaggagctgcatgaatatttgataatattgatgttgtcatgtctgcattttaaagtgttttttgagaacatgtattgctgttttttcttcttgtataccaatgtgttcagaattagattggatgacagtcttaagaatacacagtttatggcctaacgatttgtgtgtcctgaaagatggtggccataattaggagcagtttgtgttttacttccaccagaaccgggcaaggacaaccctcctaatattcttggggtctgagggtaaggaatgctgttttggatctctagcctgtcagcaaggagggcatattcaattatcaagctccaaaaatgcctgtgcacagatgcaaaacacctagagttgtgtgatgagttgatgcccgagagctcccaaactgagaggggacacaagcagttccacagtcctccctcctagattctgtgactccagtaagtgttgacaattcactggtatgtgaaattacctctccttttaagttctctaataatgtgcagtctctgcaagcctcagccagtaccggagctgggtaaggctaaataagcttcccgaggtgcttgcctggctgctgggctgcctccctggccgtgcctgggtccttgagtagccctcattgtggtgtgaggcagcgtttttgtcctgcaggtacagtaggtactggattaaacaggtctgctgttgcagacagaaaccaggcaccgttctagcacagagctgtgtttggattggagtttccagggccttatcaggagccacccctagtgacacagccagtgccagaactaactttgactttcactcttcgccaagggcttgcagaacaccttaaaggaaaaaagatggaggcgcttagagttcagatgttcatgccatgctcctttgaaagcttgtatctgtaagtgaagttttattctggaaataatcccgggaccacttaagaggagcagttttttttctctttaagggggaggataaaggaagagaagggtttattgggagttaaaaatactgaagctgttacttctcactggctttaatcagcttcagctgtaacctctggtaggtggctatgacaaggataacaactaatttgggggtgggggtgggggtggtagatagaaatgctaacccaatatccttgccctctcctttaaaattgaatactggtcttaagttaataatgacaaaaataccgcgactgcttgaaaaatctgagttagagcagagcttgatttatgattgcaagatagactgcagcccagctttgttatgaataaaacaggattttcttcaggaaaactgtgtgtttaatacagtagtaacatttgtccaaactctcccattgtaaacactgtgaatttttggtttctccccccaccttttttttttttttttcctgactgtggaatggtaacagttgcattaatgaacatcttctttgcattcttgtatattgatttttttctcttggaaggggaaacagacatccaaacatcagaattgtctgcctggcatataaatgtagaacaagtttaaaaaatggcaatttcaaagaaatattaaaatggagaaaaactaaacagagtatagttccccccacatcctttaacatttactttcactgttaggtgataagatttgaaaacagtgctaaaagctgtgtccccaagtgaataggcattcaagcaaatcaacttatgcaaaagctacctctggagcttaatcattatttactgaacgttcctgggtcatgggagaggttctgattaagtcagaaaggcattatgttcagcagcttgtgaaggtgtgtttaaagacagcaagaataatggaaaaatactagatgtagcagatctatttttagaatttgattcttaaaaaatataaatataattaccataagtttaagtgtgggttaaagttcatcattttcagtagatacatctttaaaaggtcttataaaaggtagttttaaaaatgatttctaacttcttgagcttctatttctgctgcagtttgttttaacagatactttagatttttttcattctttatgtcgtcataacagcttaattactcacctctataaaatgttagagcattttctaaacaaagtatatataattatgtgtttaaaatgtcactatgctagaaatgttataaatttttgccttattaatgagatactagctggggagatgatgtctactctttgtgattcattctctacaaaaatatactctaacttactaattttttaatattaataatggatggcatgaacaaatgaaacttgctattctgattctacgtaagaatggtagtaatgtcaaacctgaattcacagccaaattaattcttaattttgaatttcattcttttagttaactaaaatacttgtcgtaagagcatgcttcccttatacactctcagaatgaaattcttcacaaacacgtttgacaaaacttgttcactgagttattgcccattaacttttctgtgcgtattcttttaggagagcacacactgtgaattaattgttttgtattttcctctaggaaagaaaaggaacatgatagcagaaggcagcattctagaattttggctccctagaaagtaacttgtcagctttgactcgtttttagatattaagatgttcagcagataccatttcaggaattaaaacacagactagaagaattcattgcctaacttttactcatgtccacatggtttgtgggaactatgctaagtattgtgcttgtattaacacatttaattttcacaactgctctatgaagaagatatgtctttccacccccattttgcagctgagaaaactgaggcttggataggtgaaaaaccatgcccaagtgatacagctaagaaatgacagggctaggaatttgacccagggatcctggctccagggcttaatgctattatctgttgtggtctgtggattttcacttaagatactaaatgaatcaatatttcttcctctgcttttttatctagtgggtttctcctatccctagatttctgaattaccaaactgtaactcatttgagctcttgaggggccgtgtttggtcctgatgccacggttttcgtctaccaggtgtatttccctgagtccagttcaccattgattataagacagctattggctgggcgcggtggctcacgcctgtaatcccagcactttgggaggacaaggcaggtggatcatgaggtcaggagttcaagaccagcctggccaacatgatgaaatcccgtctctactaaaaatacaaaaattagccaggcatggtgtcccgggcctataaacccagctactatggaggctgagaaaggagaattgcttgaacctgggaggtggaggttgcagtaagccaagatcgcaccactgcactccagcctgggagacagaggcaagactccatctcaaaaaaaaaaaaaaaagacagctatttggtggagaaagaaacttactaaaatatattcattgattatatgatctcttctgacttgggaaatcttaacatgtggagggaaagttcctcttagaattaaggaactgtcgtagatccctagagcccagagttctccgtctctggatgattcaagcaaatggtttgaataagggtgcaccaactctaaggttctagtattattagattctatgaggtagaatatttgttgggagacagacaccaactttactcactgaacaaatatttattttgttctactatgtgctggagagacaatatgtgaataaaacatgtaaacatctctgccctcctggagcagattggaccaggtcatgaaggaccaagcacataccagtttcatccctgagtctggccctcattctcatggttcaggatggcttctgaagctccagccagtgcagccagattacaggagacatggtggcagaaggtttagagaaggggatcatttgaaggagattttctgtagctgattctgatactcagccatgtttggaaatgaatactaaaacattcaagatcacctgtttgtttagtaggcgagctgggacatgagcccacatacatctctcattcttaagccaggacactttcctccatgtctgacaaaattcacattctcttccccacctctagtcagcctggccagaggtctgaaaagcccttctgatactgaattcagtgttttggatggaatcaaatgagaaggactactcactcctgccaaatgggctatgaaaccaccccaaaacatctatccataaactgcccatggctttttgtgggtacagcacaactgctttgtcataaacaaaaggaaccgataggctgaatctataggaactgcctccccctcaggaggtactatgagatgggtcgtatgaagctcctcctgctcgtatgactcacttcacaatacctctcaccccatgtccttctccagctgaggatcccacaatctcctaagatgtaaactttaagttatgttgaaatggagtcttacgtagaactccagaaaacagtttcggtggtgttcttggggttgtcttagaagactcttgaggatctttgttctttcctatttttcttcacctagaaccaccatggagatgtatatatttgatctttaatttatattatgctatagtacagttgccgtagtcagttgtatttgaattaataaaaaaaacaggcaaaaaaaaaaaagccagtctgtttcatcacaaaaaggaattcttaagaatgttttgaaagtgccaccaactgcacaaatcagagttggtaaatggatacacacacacacacacacacacgtgtgtgtgtttatatatatacacatacatatatacatgtatatatacacacatacatgtgtgtatatatgtatgtgtgtgtatatatacgtgtgtgtgtatatatatgtgtataaatatatgtgtatatatatatgtgtgtgtatatatatatatatatttttttttttttgagacggaatctcgctctgtcaccaggctggagtgcagtggcgggatatccgctcactgcaaccttcacctcctgggttcaagtgattctcctgcctcagcctcttaagtagctgggactacaggcgtgtaccaccatgcctagctaaattttgtattgttagtagagacggggtttcaccatgttggccaggatggtctccatctcttgatctcgtgatccacccacctggatatatatatttttaaatggcagtctgggtgtctaacatttcagagtgattggcacttctgttatctacttaaatctaattggcgaaacttagcatgtagccagtccagctctggagacctgggagatgttgtgggtgggagtgtgcctagccaaaacaaagagaaaataggaaaatagatgggtgctaggttttatgaattgtaggtcttaggctgaaactttgactttttccccagtattactgatattttttaaatgttacaaaaccagctgtagtatcccagggtacatcaaactggcttaagaaaaaatggagtttgattggccctcgtgaagtccttgtccagggttagtccagggctatcatgacttcaggaatgatttgatacaggtgctcaatgtcatataaacactggctccctctttctttgttattccttctcattagtcctctgttctttctttactgtttcctccagtttggctttcttctcggatagatccaggaagttccagatttacatcctaccagcttttcaaaccttagtttaaagagactcattttaacctaatagtttcagttgaaggaatagggataacccttacttgattgtcttggggcacaagcacattcctgagttagtctttgtgaccagaaggatggatttcctgattggccagggtcgtacttccatgtctggaggtagtgacaacaccataacctcatgaactgaaagtgaaggaggctggttattcaaggttaaatcaggtactttaccaaacaagtgggacaggatgctgggcagctataaatgccatgtggccaccataaatcattactgctatgtgtaaggttgcctgttaaaccatgacaggtgtacccattcactgctccttagattacagtttgtacttttgtctttatttcaacacaatgttggaaactttgcatcttggttgacgtgtgctagacatgcagtaattgttaagtgatggtggtctaaggcttttgaattttctctgatctgttataatgtctagaaaaacagccagagcatgccctgtgattggaacaattatttgagtacaaacagaagggctttctacctttaaaaagtttattccagttcctttcacactcatgtctgaattctgtcattagtttgtcattgtgttagatttttaaaaattgctttttcttttaaaatactctcagtggagcatcttgccatgccgtattaattactttaagggatgaatttctcaaagccctttaaaacatggcagttagatgtgaatgggattccacagttggacagagtaagcaagaattctagagtacagtctagtgaaaggaagcttgatatgaaaaacagaaaacttgagtgtggggcacttcaactttatctgcttcataacctttcaatggtttggctctcagaggcgatttccttgaaaggaattgagtgttaagattgtgccaacccataatggcatctgtggaaaatggagatcagtcgtggtcataaaatgaggaaatggcaaagttcatatccttagtttaaaatatcttttagtaagaacttgatattcctcttagttggagtatacataagtgagacacactttggtaaaaaaaaaataaccaacttaaaaaaaatctgctgatgaaaattgcctggaagagcattgttcgtatgttacagaggtctctaaacatttttgatccttcttcctagttaatttctttcaagaaaaccttctcaacacattttcatttgatttataagttatgtacatgtgcaactatactattatataacatgtacaaaaataaaaaatgaaagtgataatataaaatatatatgaagaaatgttttaattttttcttcctgcacccaggttgtcatttttggtatggatttttggagaatactgatatattgggaaacttattaaggttctccttgatttttatctaatcagtcattgagattagtctttcctggtacctgttgaaggtccagcttaaaaaaaatgtggagaatcctgaatggatatgaaacatcttccatttttagcagcgaattgaggtctcagcattagaaagaaaagacttcagattttaagttgtgtgtgattggtggttcttaatttttagaatgcttttctccctatgtactgtgaaatgtacaaagctctggagataggagcattgtccagttgcgacaccatgatatcctgcatgtctagcagcacctagcttttggaaagcatttgcgtggggcatgaggctatgttttgtaagcctttgtattttagctatgccagagacctggagtatttattatctgagctgctcatgttacccccaaaaaggtggaatcttggcagatctccattctttttcttgatgactaaaacccaagttaggtgttgacagaagtccagaagatctcagtgtgaagccgaactatgatatctggtactttcacatttacatgggttacactcccagctattttaagtacgagggatgatatagtttcttattagtatttttttccaccatgcatggtgaaaaactcatcctgaatcactttggaaggaatggaaagtttgagataacagaagtgccattcactctgaaatgttagacacccagactaccatttaaaaaaaatatagccatttaccaactcttatttgtgcagttggtggcacttccaatagattgttaagaatttctttttgctggtggaacggactggttgggggcagttcttgtagattcaacctatcagttcctttcatttatgataaagcagttgtgctgtacccataaagggccgttggaagtttctggatagatgtttttgtttggtctcatagcctatttggcaggagtaaagtagtctttctccttgtgtcccatccaacatgttgcattcagtatcagaaggactcttcagacctctgggaaggctgattggaggtgagaaatggaatgcgaattttctcagacatggaagaaagtattctggtctaagaattagaggtatgggttcatgttccagctctcctactatgcagacaagtgatcctgggtattttactattagtttccaaacatcggaatcagtcaagtgtcagaattggctgcagaatttttgtggacatattgattcctgggccttacctaaacaaatcagaatttccaggaatgaggctggacatttttatttgagatgaagttctcagcgaattttgtttttctcagctagccttttgcattttgaaacccctgtagcttaacccatacatgacataggtttctcctttgcccaggaggttaacactattgaaccttcctgtgtcttcactgtgtatatgaatatccaccactgtgcctcctggacataaataaattgtacatcagtgcaaacaaatactaggctttgagctctgtcaaccaaatgactatgatgaagattattttttactgaataaaaatgctacaattcctactttatagctcatgagagatttgcagaataaattatcttctctctccatccctgaaaaagttttttgagttctctcatttaaatggacattggctaaactttacaagacatatcttctgtggtccaaacttgcacataggcatataaaaagtagattccttgtatccaaaagaagaagcatgctcatggtttaatattattatttttaccactaatttttgaactgtattccagtttattggaccatgtttcagtcattgtgctaagtttttctatctattaaaaattttaatcctcaccacagtgctgagaggcagatgtattgcgaagcacagagatagactaactgggccacagtcacaagttaccgcacagcccagctgaactctgcctgaggagtggactaaaggaaacgcaaggaaaagtagaacattgctttagcgtctctaggtttctactgatgaccagagtactgtcttagaggactgtgatattgagaccaaagaccagtccctatgagatagtaaaagaacactggcatcatgtcaaaggtgaggggtgggcagacagatgtttggatgctggagcattgaatttaatggaatttctgatattgttaggtggctgacaaagatagaataaagtattgggatttagcaaaacgtcagatagttcagagcccatgtccaaaatacctataccatcacagagaagagggaggctttgaaggttaagaatgtaaattctgccatagaggtaggaactcaggtcacatttggtggccatctggtgtctgtatacctccagccactgtgctgaacactttaatttagtgaacattaactgacccaatccctgcagcacattaaaatgctgggttttggaaaagcccagagaggtcaagtggctcattaaagctcatgcagctcggcagtgactgagctagcccttgagtccaatcggtggccctcctcctcgagccattgctgacaaattcccagttctcaggggagttgtgtgcctggcttcagtgatgccgatacatgccagtaaaggcatttgtctctctgcccatcggctttcaaagggagctttctgatggtgagatgcccaccttcccatgtgggacttgatcagagttccgtagtctaggtaactgacttaattttaaggcgtctcagaagaattatgtgactgtggctttaaactctatgagattagaaaccaggtattcccagcacctggcaataactatttgttgaataaatgacctttacataatctgattaaaaggaatcagactcatggaattaggattatctagcgaagattcagcttcatggcctgggatgagttcagttagcttttaaaattaaatacatttggacatctctccttgtgtatcattagtagcttcagcatcacgtcctcgttttaaaaaataagcattgttgccacttgtaatgttctcacataaacctcaatttggagcttaagacattatgctcatttgtcctgctaacattgtgacatgcagatatccttgtttttgtctagaaggtgataattgcagattcagttacttctaagagaaagggatgtttagaagattgagagcaaagctgagaatctgggagtcatctttcacaatgtggaaatatcccgcagggagtgtgtgccatgaggcgactctaatgcttcctttgcacttttgggtttttttgcaggaagatttattaaaacactgtcaattaactgagctgtgctatatttatataactataaaaatatatttgctctattttttagtggggtttcttttcacttatactggtctacttcatacatacgtatttttttttcagacaggatatttcagaaaatgctttgaatgatattgttgtcgactttcacgtatgaagacttagtgcagttgataactagaaattttaatttaagatgtcttaagaatgctttactgttaattgaaaggatttcttcccccagtatcacagccaatgactcgtcttgagcagctaattagtgcgattattccacagctgcatttgctacagcacaaaggtttgcttctgtttttatcaaaaggatcagtctctctgggaatgttttaacctgacaggctttgaatagtaaggccgcttatttatttatttattttaaaataactgttccccccgcgcttccccccgccacccgccatgcccctcatcacagctctccttcttttcttggcttaggaaggtacatttgagctttgaacacatactctaaaatgggaaaatacatttttaaatgctcttttagtagagctgtatcaagtgaatagattattttaagtgagttagaataatggccaagtgcccttaatatgtggatgagtgcatgatattaaataatatgcaaggtattaatgctgttcgatttgtatgtgtctgtagaaaatgtaggaaaacatgaaggaaagagggtttgtgttttctggaatgctgagcacttccaagtttgccaatgtactggatatattcaccactttcccatcgtattgtcaaagtgttgtctatgttggattctgtcccctttcttctagccaaatggtgattttgatcactcaagtccttttttcatggtcttaaattagtgtctagaggcatatattctgccattgaaaaaatactatgacttctttatagttgaggggagtaaaatgatagaaagataaatttacctgtagttctattctcaccctggcaactatcgtgatctttggacattccctactaatcattttgcatacttggatacatgcatataccacacttatttcaaattagaatgtaaatatacttttgaatcctacttttaaattccctcttgttacatacatttcccactttgttctgtagttgcacaatttaaaaaaataggtagtattttattgaattcatatatgataatgtatttaaccattctcatagtatgggacaaattttttattattcatatattttgcaatttgtaaagagctttgtaatatcagtttttgcacatttaagttatttacttaggaaaattgtccatcacaacatttctgaatcaaattgtatgaacaatttttagctttttggtagtgttgttaagctgttttaatatataccagcaatggtgtagagtaacattattcttatgctttttgttgtcatagacagtttgtttattaaaaaaaaaaaaaaaccttggatcttaccttaaatactattttgtatctggcttttctaagttctttgtattgtgtagttttattcacatcagtaactatatttttacactagttttaatggttgcatcatgttacattttgattctctgacaatatactgagccaatttcctgttgtgaaaataagcgaactgttaaattgttattgtgtagtttttctgggatagcgtgagggtaaaaccaatacttcttcatcccctagcatgttttgttaccttcagagcctgaaggttcctgtctttaaggagctcatgaggatggtcaatgatatttaaggcttcattttgccttttattagaaggtaaaagataataccagagtttatattcaaggaaggaagttcaaagtacaaatacttacctcgaagcatgactttctcaagagtgaatattttctcaaatgttccttttcttctgttccaggtgctaaggttttgaaccgttgacctaaacacagacgttaaaaaatatatatagagagagaaataaacaatgaaacattttctacctataataatagtgacagcaaacatttgttgagccagtactacatggtactcattgtactagggcatttatgtgccttgttttatttaatcccccaaaatccctaggaagtagggctttaaaatatacatgatgctatagaaattttaaaagaacagctcccacctttataaatggtaagtgggtaaaaaactattgttatccttcttttccggatactaagacagagagagatttaataacttgatgtcatagagctggcaagataagttatcagaaaccatatttaggaaaattaggaagttttttctttttaatttgtgagtagggtttcagaattttaaactattttgggtagagtgagtaccaaaaccattagaagtagtcctcatggggaatgcacagagaacacattgtaacatagtagagggcatgccaaggtgaatcagaagaaaagacagcacaaagaaaaccagacagagaagtattggcttgtcagaccagctcgtcttctgcccccttacccaaagagcgaggtcgagttcagtgttaacattctggcccaaatgcttccttcattaattatttttacttattttatcttagaaaaatttcctcttggcaaagctcaccttttctttaatcaatatttgttagtaaacattttaggcatcttcaaagaacttagataacatgtaggagtagttatttggttagattcagttatacaaaaaagcaaatcaagcaatttatttttaaatgtggaaatttgggtgccattaagatgctttgcttcttggcagtgcatatggtggcgctatatttggtggtgatgagtagtgtgcagcataaaatgtaaaaaaaaaaaaattaaaaaaattaagccgcctgataaaaatgccttgatgcaatcaagctgacttattttaattcaactactaatgacttaaatcctgtcacctcttgattttcaattatgtggagtaccattctgtgacttgattatatttgcgcagactcattttatagtttggtgcaatttaggatacccccaaagtgcaaacgaagggtctcattaggaaactaaatgttgtatgcattttggttttcccacagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtacgtgagtgttgctcttgttggttggaccaaactctcttccattttccatttgctaggtgttttgtttatctgaatatgtattttgttagactgacccttcagaattatatttgaaaactccaactcccttaattcttacgtggctttatattttaaaagaaggatgcaaacgcattgtaactgtaatagtaacaatcagtaaatggtgggagtcaatgttccatgagaaattgcaagtaggaatacatgtttgttgtgatgacatctttctttgggaaagtttcaaaaccagaattatctgaggtgggcctcttctgataatttgtgtatcttaaatatttttctcttaaataccttccatagccactctttacttttctttttatttagtatgtaatattggttgtaaaatctgactgttttagagagctcttcacatataagattgaagaagagctttctgcgctttgataaccagactacataatccttttactgaagtgagttgtctgctttgggtctctttgatttcttgctagagtagaaactgcaggagcttgttagcatcattcgattagggacatatagcttcctaattactaaggaaaattgtaacaagtctaagaatagaattccatctcacacgtgtcttccacatcacatagggagatactccttgtttaagaataaacatttcagttcttaaatatgactgattcaaggaaagttaaaaggaaagtagaggaacttccttatttttagtttttttattttagtacctgctcacctaattctgaaaagtctcaagtgttactgttcattaaacaatgtgaactttacagaccggtgattcattattggtttttgcattcatccatgtgcacagaaaaaatgtctcccattatttaaagtttactattaaagtaaatagagagatgatgtgttataatcaggaatcaatctgtgaaccttaccaggaagtaggaaagagattctttaaaaaacaaatcaagagtcaattattttttatttgcgaagacttaaaatatagtgatgcaataatggaactcggatgaagaaaccaactgaaattgggttagggaaaaaagatacaaatagtttagcataaagttttactctaatgtgattgtttgaaattctggatattgccacagttaatggattttttcctctttctttttttacccgtcagttaactcaaggttttctctctggagtagatgatgcattgaatctttctgttctgcttgggtgaaaattgatatgatcactaagtttttatagatttaagaattatttaagatttatgttgttgtctcatgcctgcaggggtgataatcattgtgtataccttaggttatttaaaattgtatgaattaaatagtaacaagatgtggagaaatatgtctattttattcatcataatagttcacctttataatctgtagggcaaattttagaagagttgccatggatttgggctactagtgggttatatccaactgaaggtaatgttaaagaatttttattaaaatcaatattcctgttaaggcagctacaacagagaggaaattacccaaatgaaaatgtgttgaaacatcatttccagattatcttaaaagtgagcataatttctaaatgcttttgtcactgtaaatatattatttttgaaaatgattaaagttaaaatctacattaagttgtttgaataacataccaatatttttatatgttgctgtgtcctggtgacactggattgagctacaacccctaacttatgtatgccagaaaaatgtccaaagttaaagcacaaataaattgttacagctggacgacatactctaactaaaaataagtattaggtaaatttctctttcactctgaatatagttcctgtctatttaacttctgcttttttatatttcagttatataaactagtaaactatgtcatataaataaaaataaggaattattgccatagctatatggttaggtttgatagctatttagacaaattttggtattcttaaatgaagaaacaaataagaatacacgattttattaagacaatattttaagaaaatcagataacatttttaaagagaatatcatataagtgattgcttcagatacttaaagacttaggacttcataaatatagttggcttattttcaaaattttgtgtataaaagtattatgaaacattatagaaagataagtgagagaaaggtggttttttttttcttttttatagtttttaaatcataagcataattttgtgaagtaagtggttaatagcaaaacagttaatatgcttaatcttggaccatttatttctccatgaatatatattttcaaagaatggtaataccaagtatactaattgagtgcattatgatacagattatattgaataaatattttctcatagtatggcctgagtaaattcgcttaatttttaaaggtttaacttgctaaaacagaacatgcctgcttctcagtggaggtagatgtatacaattagtcacacttgcatgcactagagaatctggttaaatctctccgtctcccaagttgtttgtaagaaccagagggaagaaaggtcatagtttagttttcatacacacacaaagttaagttaccaacattctgctatctggatgaatgactgatttcaaaaagctaaagcagtgttttcaggttaatccctttttttggcagagtaaaatttaaaatatgaagctttataaagcatgtttaaaagttattgacatctggtaaacttaggactagtcagattttgggttagagatcgaaaatctgcaccactcattcctcaacgtatagtcattgtgccgtgagtaagttcatgaatctttgtaagattagcctctggtttctatattgatttaataatatatgaattttccttcatattgattttcatttttggggacatggaatcatgagtcttattgctatatatttacatagtaaagatattctccaagttttttaagaacaaccttacccaattgggtattgtaatttaaggatgctcttttaccataaattaaccaacacctggagtgcataatgcatttttttgtaatggtgaacacaccctgtattttgagttgtgaattaacaacaacaaaaaaaaagtcatcaagaaccattaatggaatcagtttcttccacaagtgggttttgctgacatgcaagtcatgcaaacctgaagtttgaaatttgatgtagcttttttcaaacaaaaacagagtaacgggacagaactgtaggtgagttcagccttatagctaaagcatcacggtacaaaccaccaagttaatcatttatgtagtcaccaagcatctgttttcatagttttgtctctctgactttgatgaattataaaagcactggtcgctctcatcctggactaagttcatcaggatttcttcccctactaccttcccaagatgggctttgacggttgaaagcttgaaaacattagtttacagtttgaaaatgtttctctgttcagaaatctgaagggagttgccaaggattccccactacctctgtctctccctcccttcctttcaccttgaaatttaaaattttaaaggcaaagtcgaagtgtcttctctggaacggattgtcccttgaatttttctgttctgcttaagggaaaggttgcatgaattttaaaaggaaaagattttttttattactttggggcatttcttaactactttgaaggaatttatttttaaattttcccttttctccaaatcatctcaagagttgcgcaaattgctctgtaattagtgatgatgcttgctgtttgtcaaatacagaagcactttttctgggaccttctacattgtaaactaaatttacgtgggcatttatttggtggttatctcgtcaaagttgcctctcatttgtattgagattctagcgaggtgggctggaagccctgctccttgttaccctctttcaaaaactgacattccatatttcactagtgaggggaagggttaatggctgaactactggtctttctctgtaaattatgaaatctgcatggagtagaattttcaaggtgtgatttattttttaggtataacacagaacatgaaaatgtgtgtggagttacaggtggattggtgggctacagattggcaaaagggacttctcccacaacctacccttagattttgtttctggtttatttagccaggaatacagaccctaaatagcatcatggtggctgcaagaagccagaacagatgtagtgtgtctcagatcagcttgcctttgtcccctcagttaggggatctgttgctagaggtgtcactctcataaggtgaagacctgctatgtctaagatttcttcttatagcatagtccattcacacatggaccagcatatacttatgacccttgtagtttgacttacacaaacaacctgtcagccttgatttcagggatcatttataaacattgttgtccttttgtttttgaatcaatgttggtgtctgcaaggctacatcctcattcagggggagaaagggactcagatttcaggtcaacagacagctcttcattctcccagaaacctcatttccctgcagaatctgaatcattcagtgtcacacataaggtaattttctctctctttaaaactcacgttattgactttttaaattgcagataatacttgttaacttttaacagatttaaacaatgcagcagaatagttcaatatgaatctcaccctgcctaccaccgcctcccttccgtcatgttccctggaaggaacgactgttaacagtttaggatgcagccttcctgttattttctgtttaataaccctaccatcagttgccttttataggagcgaggtctgaagaaatatgttagtcactttttatcaggtagacataaaccctttatttttctttgttcatatttgcaaatggaacaaaaaaatgtataatttattttccttctgggttgtctctatctttaagaatcccgcttcaaggtccactcttccctatgtgcagtgaggacttctcaccctgtgtcttgagagcagtttaattggttcaatgtgtaagtatgtaccagcttgcacggcactgagtggcagcccctttgcttcccaggctgctttatgaacacttgggggtgaggatttagtgatctctgggctgacacaagaaagtgctccatagagttgtcttacttggtaaagtcaaacttaacacaggctcagtagtgcaagaattgcaataagtgcaagaatcacagtaagtgcttttggattcatgttggacttggtttttctgtctgcactgcttttagtgactagtagctagtaatgaaatgctggctgcagaaagtcatcttcgcttaaatttttaggttttatctacttaaaagagcagaccgatgagaccaactatctgaaacaaaatattcagcctttacacaactaagcctatgaattaatcccagtttctggaaacattggaacttcagctctaattacatgttcattgggcaatattggcacagaatggaaatgatttctccctttatgaccacaagggcattttcatgtaactgaggggtacagcacaatctgggttttgtacagcacaatctgggtttgatttcatcaggttgtggatagggcctgatgtacctggtggacacttgactagtagctagtaatgaaatgctggcagatacgcaacatggcgctctctctttaagtaggagaatctttgccatcttctccatgagcccctttgcaatcactgaattcatcctgtgggtttcaaagagaagagacacctgtttggctcctcctcgttttctcctgttagaggaggctatactaataggtgcagtctcctttcatttacacagttctcataattccatactgccagaggtgaaggcagtatcataaggaaaatattaaggtctggggcctggaagtgagggctaaaaactggagtgggcctagtgtcatctgactctgaatggtaatttcttttttaatgtcatgagaccagtagaacgtgcatcctcaacaggggcgaagtcactccccacaagtaggacaaaaatggattgttggagggcaaaagagtcttagatgttacaatggtttctaaacctccaaagtcccagtacataaaccgataaacagtatatgtgtcttttaaaattttatggtgatggggatgaaggagaagcaattaggggaaaaatgtcttaaaaggctttttattgggatactaatgaataaaagattgagaaacattcctgcagaggaaccagcatctttcccaattctttgtgttttgtttagggaccatttgtggaggctcctatagatgtgatgcctatattctgtctggtctgtgtctccccaggaaaactgttatgagaacaatcatgatcagcaagtgccagcattgaactttacctgtattgactcatttaatgccaccattgctctgtgaggtagttattattagcatccccatttcacagatgcaggaactgtcacagaggggtcaactaggtcatcagaaagtcacccaagtaggtggtgcagtcaggatttgaactcatatagttgaactccatgggccactagtggtaatacctctcctggagggaatgacctgagaaacattaggagggagagatagcaatgttcagcctctcaaatgacacggtagcttggggcttgtagcaaatgtttactacagagcttcaatccatagcttaaacttttataggaattactgatgtgaacgtgacactacctgaagcaccttggaggaggaaaggcaattgtgcctccttgacaacgtggatattaattatagggtggattggatggtgggatgaacacttcaggtcttttagctcatttattattttagtaaccttaggaaacaagtaggataagccttattttccagatagggaaactgaggcttagattatcactgatccctggttacatagactccacacactaccttatttgcttataagcacacatcctactgtaaggacatgctctaaacatttctaaagaatcaccagtaacagaatatattagagcaaaatgggaggtcaaagagaaactacagaggagtctcacaggcttaacagaaagatacatgagcttaagcatttgaattagtaaggggcttccctattgaatagttaaaatatcctcatgagtctccacaatatgccagatgaaagaactggatgtgtttttattatataaaaaagacttcctggccacattgacccccgtggtaatttatgctttattgatagtcatcattatgggttaaaaagcactacagtgaaagtttctataacaacatccaaaaatcataactcaagtcacttatattctaaagatcttgatggtccatgctattacaattcatatgctttatagttctgagtatttactaatatatttgcattgttttagatgatttttgaaataattcagtagactcacacacttttgatatcaattttcttctgaaattatgtttgcatttttggtttttcctttcccatgcaccttgcaatattagagctcttgccatattttagcacttaacaactggaacttcatttctggtggtttttctatttgcttttaagtaaatgtcagtggtaataaatcttctattactatattgaaaaagtcatgagtctccttcacaaatattacctatttaatcccaacaattaaagaaaggacttagctttgaaagaccacttaatttgaaagactcttcagttagcacgcttttgaacagagattgtgaacatgtgtaagcaaaatctaattttaactttgctctactaaaatcggtgggtgtgatctgtgttaaaaatatgtaaatcagtacagtggcttcactcaaggttataactgcaatcagtactagaatattggctcttgccctgaatgtgtctccttttattgacttctttgaggatcagcttgaacttaaaaaaacatttagctccagataatataccagttattcagatcttatttataaatttagatgttttttgtttagtaatttataactttatgaaaaggaaatgaatccgaattggagcatatgaatcaggtaaagcagggggctgttaaaggagagaatggtcctaaaaaagaaattgttttaattactctttttaaaaatagggaatgtcctagaaaagggtataggtgaatctataccattgtttctaccagctgtctctggagtgagtattgggattggaagcggtggtggtcaaaggctttatcattattattatgatttttactaggagagcatatgcatgcattctttatgtaaagtgatgtcctgatgcattttatttgagtcacccacaactttttgaggagcacagttcttctgtcaggtgtaaactcaccagtttactagacttagacacattatgtaactctagtggtctttcctagaagaaagataacaaggtgtaggaatcctgcaaattcaaagtgagcaaaaggatttcaatcacccggtcgggaagtaatttttaaaagtagttaagaggcccaaaatgaaaagcaaaattcagacttctattaccttactaccatgcataactctgttgtaatctcccctgttgggcctgggttttgtataattaaaatttaggggctggaaattttgttgagccttaattggaagtgacaaaccagagacattcctgccagttaggaaaggcttaagaaattcttattggctaaattacaaatatgtaacattttttctgaacactgcatggtagttcagactgcctaaaggtgacaagattagctctgtttttctagtgaagtagtaaaaattagattaataagtaccaggcaaagaaccttttctttttttctttttttttttttcttttgaaagaaatcttaccttgagtacttctggctgtggagatcggtgccttaattagccacatgttctttttacctcctgggaaataagtacgggataaaattggggatcaagccgtagacgtacattgacttagcacacgccgctaagtaattcatcaaggaatgttggtaattagtcctgcctctttcaactcttggcttattttataaaaccggttgatttaaaataatgcctgctgatttattacccacacgtttcaagactggtacttggctcttaaacaaaagcaatattgtgcagcgatggaaatgcgccctcttgtttttgtgtttttacaaattctgaagggccatctatggcccccctattaactttgttgcctttccttttgccccattcagcattttactgggctttcttttctgtcttggtgaagagaaaaggggaacaaatttaaaacaaaaaacgaaaaaatccaggctcttagagatttgggatgtgaggtgcttgtcaaagtgtattggctcggtgtgatttgatggaatttaatttgaatccttcgtctggtaagacaggctgtagtaatagcctttgggtttttttttttttttttttttttttgcattgttaaatgtttggtgatatttatggcagccaggctaatcttaaaagaatgaatttatgagaagcacagaacctcatgacttcagcctcttacccttagtatccaagcactgtagtgcattatagtttgaatgccagattcccattaatgctaactgatggacctcattatgctttgagatgagaccttaatcagggtccctgttgaaaatctacgattaggctgtctttgattcataactctgtgaacttgggcacatttcctgttctctctgggtctcagtgtcctcatctataaaatggaggtaataatactcgccctggggagtttttgcgagagttaaatgagataattcacgaaagcagtgctgtctgatagaatatgaaccaagtacataaattcaaagtttctagtactctcactaaaaatagtaaaaaaaaaaaaaaaatagtgaaactaattttaatgtattttatttaacccaaaatatctaaaatatcacttcaacatgtaatcagtataaaaattattaacaagatattttcacattttttcctaagtctttgtgctgcctttaaaattgcatgtatattttatacctccagcacatccccaatttggacactaaattttcatcagaaaatttatttgacctgtgtttagattttataaaatgtataattgaaaaagttagattcatatacctaacttgtttcaaacgtattcaaaagatttccaataaataaattgaatatgtctttagatttaaattaaattatatgaaaagttcagtctgaatgagtctgaacaagccacatttccagtgctcagcagccacacgtggtctttgcattggacagcacagaactaaggcattagccaagtagatggaaagtgctcaggaaaggattctgctctactgttggtaataataaatcacataatgatttacaattattaatcacacgaatataaaaattattatcttctctaagttgccatcttcatatgccactattgtacctacaaagtattactgttttcctactgcccgccacaaagaaaacacaaaaaaattagtcattattttcttgctcattatttggagcccatgttagctgacatatcttatgtatggttgatatttcctgtcaaaaacagcctcttataggagaaagcagcaacgagtcacccttggtaacatggcattttgactcatctctgccaatagccttccattcagacttgagcatggtgacagccctcaacttgttagccacacatcttactcatactctcaatccaggttcttttcaaacctacacatatcacacttacatagcacctgtccggtgtgttaaagatgtctaaagtcttgcgaatatatgagcatttaatcaatgttcttggtgtgagacagacattaggggacaaggagattagttaatcatacattgttctttaccatacattacatagattgattaacatgaaggatattgaaaactaggtttttttggtggggttttatgtatgatttttatttgtgctgatgtctctaaggcaattttctttcttagttaacttgcggtatatttttaggaaattatagcacagctcataatgcaatgaaacagttctttagtaattcattagataaccaagttttctgttttgatagtaattttcaaccgcttattaaaccagaaataatacctaagtgataatttatattttgttagtcaccttttcattcctaatgcaaacaatgagtcaattatattggaattagtaaactgtgttagagagatttaatgtgttcttcatataatactaagagcctataaagtcacattcttgtgcaattacaaaaagcaagaaagccaagggagcaaaaatgttaaccatgctatgacctccagaaagaaaaatcatcacgttgtcagatttcatgatttccttagtttggagttagatctattttctgagtctgtattaatctcaatattttcttattatcttccattaacataagttaataaactttcaggccattgcaaagttgatttcagttttccagtagctttccaggtttgttttaaaatcacatacctaaataatttttcaactaatgaattagaagaatcttgatagagctcataatacaatgttatgaatatgggcaattgtgaccatttttattgacacctgggactcccaatgtctcatagagagggaagacaaattgaacattctgacaagacatttaattttgatataaaatctctgttcatcagtttgacatgaagctaagatgtttagaacttaacctcaaatggtggaaagcattgtgtaactcaggggttctcaaagtgtgctctggaacctgtagccactgcgtcccctgcgacctcgttagaaatacagattccctgtgcctatcccaggcctactgaaccagaaactctgtgggtggagctcattaatctgtgttttaaccagccttctgaaagattctaaagtatgctcatgtttgagaatcactgctgtagaaacctggaggttaatttgtaagaaatgtaagaaaaattagaaaatgcagaggcaaataaagtcaaataaatttctttactgtagagcctctgagatcctttaacatgtaaagagttatggcaaatctccaacagtggtacagtgggcaagcactttgagaagaaaggggaggagtaagacaggcaaaggaaatgttgccttgagttgctcagtggaagatgcaaaatacctaatagctatttagggtatcttgtacatgtggtacattctattatgtgcatatatttatgaaaagtttataaaaataggttaattctgtcaagtcttgaggaggtgaattgaggataagaaaacaataagaaactctaaaatgacttgctttagcactgggcctttccaggaactctgagggtcagtgaatccatttgtccacaaatatttgtaaattaaatatgtatgtcacatatgtaccattcatctcttttactaataaatgtagatgctgctatgataaagtacaaattgatatcagagctctatgtttcattttttttcttatttttaggcattttcctgatcaacaaaaaccaaagcacaactcgtaatcaaatagggccttgaaatatttgacttttaaaaatgattgaaagctacttaaaaatattattttttgttttttagactttattttttagagcagctttaggttcacagctaaattgaccggaagataaggagatagccatttatccctgcccatgcatattcacagcttctaaccccagagtggtacatttgctgcagtcagggaacctagattgacatatcattatcacccaaagtccaaactttatgttagtgttcactcttggttttgtgcattccatgaatttgggaaaatgtgtaatgacatgtatccaccatgatagtatcatagacagtatttttactgccataaaaatggtctgtgccctgctttggttgctcctctgaagaaaaaagccacttttcttcaggaactgtgttttagctatcaagagttatttaaattctacttttagaagctactctttttacaaaattggatttagataaatggtagcacaaaatggccctttcagagtctgcagacccctgacatctgtaattcccccagcagtaggcccttcatggtctgtctctgacatcaaaggtctttctactgacgtggctgtagtcttggctttgtcttttacactggggcattgacatcaagagaaagtgtttttcttcctttctcctttctttttttgtattggttttctgcctgaaggcagtatatccagtgcatgtggccatcctgccctttctgttgaaataaaacaaacggtcattttaagaagctccatgggaaagatcaactctttctgatgctggagtccttaacatgcacgtccagcacgatgaccaagtacagccttaggtgagatctggctcatatatagccatgaagtgcacttttcttccaccagatgatactgattgccttctcaccttcttacctccctttcatagttatagtccacctagtaagagaagaaaaggagaaatcaccataagatatcccctgaggacttctgcactggatcgtgaaccttgtttcctagacctacttttcttttctgttagggtttgcatttttcaattaaaattcattcaaagaactcctgcccagaggcatttgattatgcctacacctgctatctagttgcagtgttgaaaggcatgggctctggagttagatcgggcgatatccatatgttttctcaacctgaattcccttgtttgcataacagagataataaaggtccctagctcataagcttgctctgaggagtaagtgacatgatgcttgcaaagcacttagcacggtgccaggcgcaatactttttaatgctgatcactgtcatcagcatttcaaccagagacacacagtccacagtaattgagccacataatgggttcttgagaagtgactagaaggttaatgctttggtaaaagattaggaaagttgattctacctatgatctagaattaatttctctagagatgcatgggatgtgtaaagattcttttaatcaattactgttgaattacattgcagcagcaaggaattttaattcttaaaaactacctggctatgtagattcctctaacagtaatttttgggggataaggagtagtgagatgcttggccacagtttttaactttcccccaaattacacccactacataaaagacttatatgttgtttttaatgattgacagccaaattaggcagctgttaaatccttacttatagaaaattctgtggaaagtggtaaaaattggggttaaagtttcaagaaaaattaatagacatcaggctatcaaaatgtttcttgattctgaaattaaactttcacttataagctgagaagccaacaattttggttctagaatacaggttacataggagtgaccatatatgattttattaactgttcacttttgaaagccttattattttggggaaacttgaaggttcaaaatacatttaatcacagcctttcgcccctaagccacagggcctacattgcagaaccagtcaactgatgaaaacaagtgatctgtgttcagagtgttttcattgctaatcaagttgcataatcatttttatctagtctctaagtgttttgattcatttgctttggaattactcgacttcttccttacatgatatgtccatttaattttattggactgcgctgtgctggctgggcacagtggctcacgcctgtaaccccagtgctttgggaggccgaggtgggtggatcacctgaggtcaggagttcgagaccagcctgaccaacatgctgaaaacccgtctctactaaaagtatgaaaattagccaggcttggtggcgggcacctgtaatccctgctactggggaggctgagaaaggagaatcccttgaacccaggaggcagaggttgcagtgagccaagatcatgccattgcaccccagcctgagcaacaagagtgaaaaaaaaaaaaaaagactactgtgctatcctaactcctccactccaatctctgtaatttatggtacaagtttaatttttttattcatttgtttatattttttaccttttagaaacatgtcaccttgactgttctgtagtcagttctaactacttgctgacctttatttttgctattaaaccatttatcttccattacatagactatcttcagataagaccagaggccattctctccaaccagtcttgcaaagttcactacttcacaattgatactgcaaccatgaaatcaaacatgcctctgcatggacccctagtatgacccaggggaagttgtctttctgggtgtaggtctccccatctgagtcgtctcagacttccctcctagcctggactttcagtgaattatctcctttttcctggagaatcgcccacctacagaccactgaagtttcatttgtgataagatgaaggtgacaaaggactttaaaagccttgaaagaaacattaggtttattttaagtgttagatacataaaacagttgtaatgataaagaacagcagtgtatataatacttacagttccactatagtttaagtcaccagtttctccttgagggtggcaacaggtgagttgagaaaagcctcttttttagatacgctattattttgtctaagtgtgttttgccaattataataataatgttaatcctggttatcacttactgcattcctgagacttttctgaaggtcttttgcgtagagattgagcacagacttattcagaatagatggcgaggttgtcaactaaactgccacgagtttatttacacaaatgtcctaaagtctatattaaatatttagttctcaagtatgctaaatccctaatattaaaatttatctctgacacaatttttggtcacaggatgttctatagctcttattttctttcccttatgaagcagaaaacaaataaaggctatggatgcttttttatgttcagtcagtgggtataggacaggtgaagggggatttacaatgtgactcacttctataaatattttgctcactttccttcagtttatatattaatactaattttaattcattccttaagagagaattgtggagtgtttgtgtgtgtgtgtgtgtgtgtgtgtgtgtgtgtgtgtgtgtgtatgtgtgtgttttgacaatttttctcttaaagcctttccattttcactgatctttcaacttttcctcttttccatccttggagaatacctctatagatgctaacaccccccttcccctatttacctccctccctcgctcactcctttcctccccctctctttctccttcctgccttcccttgaatcctagctctgtcctttgataaacttgggcaagtgacttagtctaaaccttagtttccacatctgttgcactgtgtttctttaacatgaaaacctcccatgttgttggcaaataagacagtcatgtcagtataacatgaaaatccttttggttcatttcccacagcatattaatgcttgaagtagtcaaagacaagttttatcatatttaaagagaaagtcttagccctagataaagcattacttggctttccacagggctctgctctctggagaagttgagaatacagaggcagcagctgcagagacaatactgtctgtgctaacacaggacattcataaagaaggctgtctctgggatcagattttaattttttgaaaaaggatcaacattagaagcatctatacttgttatccgtggtctaccttttgagagaggaagcaggagccccagtgtttaaggctgtctgggatgctagctgcagaatccagtagaaatttaaccagctgatgctgaattagggtttactgattgttgttattcgtgctccggttataaaggtgcataggttttgagggatctgcccccaatcttcttttttcttaatatgccctgctattcataggtgtgatttttgcagaacgtgatgttttccaggactgtagaaatggagttagagcataaacacctgaaccaacctcagagctgtaattaaatgaattcatgtatgtaagtacctagcacagcccctgagctggttggctttgattggagtcttgaaggacaagtaggaaagggcttaatcagtatcagctagtactgttgaacccttcaaacattgcagttcagcctcagaaggtgagggacgtatccctgtagtggtttgtgttgagtggaaacttgaataacaagtagggttatacccaaaagactaggatgagggggcatggcacatggagagaaatgaagcaacaatacatactctggattttggtgtgaagcagtgaaatgcaaggtagcagaaggtaggactaggagggtattgggaactgaagctagatggatgagcaggggccaggagcttgggtctgatgcagtcaggattgggtagccatcaacagcgtgtcttcattttccttttaggaaagaagaaggtggttaaggtggacttctatgggagctggtggagatggtggcgttggttttggaggaatgcagttggaggtggggaggcgatcaaaatgatttggggaatgagtgatgaaagtgttggctccagaagacgtaagaagaaagcactggttaaagaaaattaaggagtaaagtatatggaaccttgccagacagaaggaagaaggcataatactataatgctttacagagaagaaaaactgaacatagtagagcttaagaaattggtctatattgggagttgacaaacaatgtccatgggccaaatcctgctaccatcttttttggtaaagttttattagaatacagtcatgctgatttattttcatagggtctttggttcctttcacactacaatgacagatttaagtagtacaacagagaccttgcgcccacaaagctgaaaataattatcctctggacatttatagagaaagtttgctgactgctgatctgtgtgtatagctagtaagtagacctgggattcaaatcttcgagagttgggatcatatctcttttgctcacttctgtatcctgggcattttgcattgtgtctaacatatagtaagccctcataaattaacatttattgaattaacctacaaatgaatgaatgaattaataaaatcacaaagtcaagtctacctgagtcacagcttgtgctagtcattattattctgtactgattcttacaaagatgttgaatgggagttgatatacaaaacaaatatatttattgagtgccaacaatatataaggcatgttcttcgttttaggatacagtgaaaaacagattttcatgtgcccttgtggaactcactgctaacagggaagacacatgttaattaaataatcacagaaatgcatgcacagtttcagcctcaacaggtaccagacaggagaggggcacagagttttgagagctgccaatgggaagatgtgatgtaaagagtccaagaagtctttcccctgttcacctgtcttgtgatctgaagagtgagtgaactttagtttaaaagggatgtgggatgagtatttcaggcagcaagcactgcatgtgcaaaggacctgtgtcaggagagagcaggcaagaaacaaagagaaggttggtcttgctggaggagcaacagcaaaggggatcatggtaaggactgaggctggagagataggcatggggtcttgtgatcaagatagtgaagtcagtctgcttctagagccaagtctaaactagagctgcaagtttgggactcagtaatagagtaagtattgtagttaaagaagagtattgtacacaccagagagagggctgtgagagaagatgtgatccttgagaagtactctggaacatgccagtaggacagagagggagaacctatgaagcagccagtaggacagagggggagaacttatgaagcaatgtaaaaacacaggaacaaagcttggagaaccaggatggtaaaggttttgaaatggaaggttatggcatgcatgtctaggattgaaaagtgtctattgggttggtcttttgtgtgatcactgtgaccttggaaagaacaggtttgggagagtggaggggaatggctggagctggtaatttgttgaatgaatgggaagaggaaatggaaacaagcatttattcattcatttacccaacaagtagttattgaacatctttgtattagggatctaatggtgagtgaaaacacataagatccttgttctcctggggcttactgttaagtagagaggtgggtacttagtcaaacaatctccctaccaccacccaaaaagatgtatgaacactaaaggctacagtaattgctgtaaaggaaagaaagaaagttttgtaggaatatgtagcagagaacgggggaagtgtttgggccgggaagagttctccaactaagtgatcttggagctgaaggaagcataggtgtgagctttgtgaaagctgtggtgagagaaaatttcagcaggtggagaaaagcagatgctgagaccctgcagtgtcagagagctagaagctccaggaaataagaagtgaggtccagagtggttatgtgtgaagagcagtgatgagaattgtgcactacaaggctaaaaggtgggcaggggccaggggcctagggtttaagctcccaggacttaatccttaagaccatctaaaggattattgtctttattttaagagcaatgggaagccatggaaaggcatgggaagccatggaaaggtataggctaggggagccacacctgggttttaaggagtgtagtctgctctttgcagagacagcgtaaacctgttagacctttctgaaccaacatgggtacatggcacggagaaggattctcatctcagggggttatcattccctcttctgagtgtggagtcatctaagctcttcagaaaacctccagctcagatataacttatgcctgccttggcagaagaacatgaaggtttctcctaaaacccacttggaaaaaattcttttttccaagtctccaagaagacttggagaatgtcttctaaggactgcataagctataacttcaggagacatgaatttctgggttaaaccaattgcaggcaaaaagaaaaaagcataggcaacttctgagataaatgatttcaagggctttaggcttgagttacctctgagtgatgtctctccttggggtctgccagggcacatgatacagcaagtgttttagagacctctctctataaaagccattttgacccctctccacttatgcaccattctgtcctcagatttgatgaatagagaaagctttgctaagaataactgacttgctcagtacctcttaatattcaaagaagtctttgcatattaggaggacttgatttctgccgagtgggaggggtggggaaataatagattttcagggaaggtaatggtgggccctattgggagtggaggcagaaaacagtggccttcctggtcacacttctaatcacagagagtgggtgaccctcccctctgctcccagctaacacacacctcagccaccctgttgcagccggtttatttttgcatcaataataaccgtcctccatggaattaaaaaatcgtgatatttccctgtggttcttgcctacattttcctgtttctgaaccaaccaactctcttccttttgcttggagagcacatccttaattagttttgcataacatgtgtggtacaattacctgaattccttctcctccttcttggccctgtttaaccaaacacctcccacgtctttgttctttgtgctcatcctgattgactcatgaggtgacactggctgacacttggcaaaccagtgaccttctttttgagctagagttgacaaaacctgatagaacagggtaaaaagggggaggcagaagcctgcagccagccctttttttgttaaggagaaagcagcatgggtaaatatattaagaagaagttctgctttgaatactttgggaatatttgacaaaattatctgttgaagaacaaaagtaacatgtttaaggcaaataaaggatgaggagcaatgctcaatcaggaaaaatgaggtagagggatagagtagtgattataccatgtctattttagagatattatgtactttatgaaattcttgcatttgttaactattaaaatcagaagaatttacctggaaaagtaatagccagggaggaaaaataggtttaacacaccttgagcaccagaagctgtcctatgttcattttcccagaaacggtgttttcaattaaaaaacaaaacaaaacaaaaaaaacctatgaggatggaatgaggtatgtgttaagtgaattgagcagtttggaggaaggttgctacagtataaccttttatatttccatgacttggtttttggttgtaatttcaagcagtacactcctagaccagctagataaaaagaatggccctttaaccaaataatcagggataacgaaccagtgtgatttttcaaaaaaaaaaaaaaaaaagataaattttaagtcaactttgctactatcagtgttaaaattagttgtatttagcttcatttagagcccttttcctaaatatagtgtgttgttaataatgcaagtgttttggctttaaaaattaccttttataacaatttttactatttccattttgccaagatttagataattttcatgggtttaagcataatcctttaaacttaacccaagtttttagccctgtcaccctgactctatccttctgttcatctcctatccctcccccaatccccacacttcaattttctttaagattttgttagagtgcacttagagtgactagagtctgagcccatggaagtttcctattgcttatttttctcccagtggcacatggtctaatcacctattagagcgagaatagttggtcctcccctccgagtctctccacagttctgcatagattgcaaccagatgatgacattaattaatatggcgaattctgaaagcaagcatttaaaataaccctccctgtctaattcagagatcacagaaagacttgggcagtactttgagccttgacgacatagcgtgtgctgagcatggcctcccttccctatgtcatcaagagtccatgtagtgtaggcaattaagggacccatttctcccagcatgtgtcacccttgcaattggaaagtgtccactattctgggcctacatggggatagtagagggagctggcttagtcaggcaaagttggggcaatgggtagtagtaatgtgatttgctttataactgtttgctttgcattggcaactgagctgtggccacactccaactggcagtggagatggaaccttaattttagattgtgtccctaatgtttggtgaaaataaaaatggagaggtgaccatgagttgacttgagactttttatatgtgagtcatagtatctattaggaagaattgcattcatattatgtaattatcctttgtttagtttttctttttttttccagtaatgaataatccttatcatctcttttgcatccttatttatttttcccatttacataaattaataaggccatgacagctaaccccatactaaatatatgtatacttgaagcttgctttgaacttcctgaaaacatatctatttggcttactgttgggtccccagcacctaaaatattacaaggacatatgacaaactccataaatacttcttaaataaaattgcagtttaattcatgactcattcttcaccctttgattcttatgtttgagtgacctagctgtccagtgggtttgcatggataatttatatgttcctccacatgaagggataaatagatagctcataggttattctggtatagaatagaaccctttgaaaaccagcctgaggctctttttccttttttaaaaaattagaatgctggtttcatcttcagacaaaaaatactacttttaattactgtgcagtctttagttacacccataacctctgggacactgagatggtaacacattcaattctttgtctttgacttggttattaacttgcgtttgccttggttattgttagcccatgatatttagggaagtacctctgaaacattttaatgtctgcctttttttttaaggtaaaatgcagaaaaaaaaacccaaataggtttggttttgaattttaaattactttgtattatttttgttttataaaaatatacagtaattagaagaatgcaataatgctactttctatcgtgttttattatttcaatgttgtttgtagaggttgtaagctatgatctctgagtcttcaaagagtttgagaattaaaaagaccacaatctatgggttttatttttaattattatgaaaccatagagatgaaaatgcaatgtgtatcataagaacaatttttctctatgatgtggattgagtttgtaattgagaatagtgattttcaaattagctaatctttggactgctctggtgaggttttaaacataagaatagctaggtctagtcctagaatataggaatggccttgtaatctgtatttttataaaatctccctgtttatttcagatggtaagcacagcctagtttagaacattagatcaatgagctcaagtcatgggtatgatttttcagttggcctattggttgtcctctgttctgtgacctgagaccttcttctgagcctgactaactatcttgcagatggatgttcttgctgtggtgtaggtaagagagtgtggacaggggaggcattgagcctagatccagtttaattaccatacaaatatcttaggtcatgaggtagctagggtcatcttctctaagggcagctaatttctttgcttatgccaagcaacagccttgtcactgggggcttttttcttaatttggcctttttaaaaaaaaatatcagcaagaggagtgttgttaaattgccaaccaattcagactcactagtcttttccagtatctactggagctaaaattcacaaacccaactcacttctagaaatcatagcttctgactctgcgtcagcatggtgggtgtttgggcagcaagtgagcagaaggtgctgggatcagattgcctgggttctgactctgctgctcccatgcactggatgtgcgacttggaagcaaaattacttaacctctgagagcctttgtttttcccgttggcaaaaaggcaataacattaatactaatatagggttgtcggaggattatatgagataatgctcatgcatcaaaaatggtaagcactcaacacatgtcagtggctggtattattactataatttttaccacaaattctgaataaacacgtctagaaacaaggtattgccatgattagcttgaaccagtatcacccataatttttttattaattattgcctccctttgcactctctgggatttccattcatttatttcacaaatacttatttagtacttactatccaagcagggtactaggcactggggatacactagtgaacaaaagagacaaaacataaatgatagtttaaaaattgatgcttcactacattttaacagccttaccatttaaccgtactgaagactgagagaactgaaatgtttgatcatatttagattttgtgaatttgcccataccaggtactgactagcatgaaaaatagtgacagaaatgctacataatttcttccgtgtgtcttctactggtctgtccttctgtctctatccattcttggccaaatcctgcccacccaataagacccactgaaacactgctttccatgtgaagtgccccaaggttttccctcctggtccctctacctctctctcctccaatctctactcactccttccgtagaatttggcttgtattccatgtatagtctgtatcaatgtatcctttgtattcccattagttattttcacccttataaaccataagtaatgtgtaggaccacatggcttctacatcttgcaggcccctggctcttaagaccgtcccaggtatatattaagtagtcagtaggatgcagagttcatagacagagaaaaaaaaaatttagtctacaagtgagatttttctctctttgctcctttgtaaaatgggaataaagagtacccagctcacaggctggtaggagtgtgagatgatgcatattgttggagatgttagcgcaacccattcacagtacagtttcaataatagctatttcttattatttttaaaagttttattgaagcataattagcatataataaagtacacttgttccaagtgtataatttgataaatttagacacattatacctctgtgaaatgatccctacaatcaagaaaattaacatatccttgtacctctttgtaaccccttcttccttcccagcttggccctactccccttgtccccaggcaaccactgatttgatttgtgtcactatagatgagtttgtaatttccagagtttaaaaaatatggattcataccttttgtagtttcttgggagagaggcctggcttctttcactcagcataattaatttgcagttcagccattttgtggcacgtatcaatatctcattcctttatattgccaactgtattcttttatataggcagaccacagttttttttatccattcccctcttgatgagcatttgcttttttttttcagtcttagaatattacaaagttcctatgaatatttatgtacaggtcttcgtgtggattcattctttcatttctcctgggtaaatatttgggagtgaaacagctgaatcatatagtagacatatatttaacttttagagaaagtgccaaacttgctttcctaagtagtcttgtcatttatattctcaccagcaatgtatgagagttctatttccttatatcctctcccacacttggtatggtcagactttaaaattttttgttagctttatgtactgatgggtgtgtaatactatctcattgtgtgtttttttttaaatttgcatttccctaatgactggtgatgtagagcatcttctcatgggcttatttgccatctccgtattttcttttggtgaagtgtgtgcaaatcatttgcctgtttcttaactgagctgtttgtctgtgttttgagagttctttatttgttctggatctatcatatgctttgcaaatattttctcccagtttgtggtatgtctttccattctattaatagtgtcttttgaaaagcagaagttttaaattttgataaaaccaagttcattggttttgtaaattaatcatacttttaatgtcatatttaagaactctttgcctaacccaaggtcataaggattttacctatgttttcttttagaatgttatagttttaagttttatgattcattttgagttaatttttatataagttataaaacatgaattgaagggttttttgtaaatatggatgaccaattgttccaacatcatttgttgaaaaaactatcctttttccctttcattgcctttgtatgtttgtcagaaatcagttgattatatgtgtgggtctatttctagaatctctgtcctggtctgtttttcttccttgacaccaataccaaactctcttgattagtgtagcaagtaagtcttggagtcaagtattgtctgacctccaaattgttttttgttgttttttgtagtaaaatattatataatgagtaaatagttgtgtatatgatgtcaatcattggaggtaaaactgaaactttgctttgttgctttggttaataagtgccatgatttgtcattctactagttatctttctctgaaggtgatttatctgaagcatttcagaattttcccaaatagcagagggatgagttatatgcaagtgtacttgtataatctttaacattttctaagtcttattttacatggtctttaatcctgtagttatttatcacttcggaagtgacttcacagtacatgtcacaaggccaattaaaccctggtagattctgaagtggattgtaggatctgtccaggactatgatttggtttttgtttgtttattgtgtaatatgcccagatggagagcatctagaatggagactagcaacctatagactgttggatgtgaatgaaaataggagctgtcaacgcactccctttctgcttctttgaccacacatctacaacaaaaatagcagctttttttaattggctacttaatatatgctggtcactctgctaaatactttatgtaaattgccctatgtggtacttacattgtccatgtgaggtaggcaccataaatccttgttttgcctgaagaaaggtttaacaagttacccaaagctacacaaccagaagtaatagagctagtgtttgatcctctcccctttccctccataatcttgtgttcctaatcgctatgctacagtacctttggtactaaagaatgaaagggattcaaacttgaaatataacgtaagtcgtccattgagctctggaactcctactttctatgtccaaaactttcctgtctatgatttcttctgaatcactggatgaaaaagtcatgtgggttttagagatggggctctgtgtgtcaaactggttgaataaataaatgaacgagttattcattgtataattcagcacaaatctattggatatctatgtaccaggcattgttataggtgccagggatattgcagcagaacaagcaaatgaacaaacaactctttcttcatgaaagttatattctactggaggagagactcatgatggacaactttgagatcatgtagatgaaatcacttcataagcaggaggtagtattctcctcagatcctggtctaatggcctgtattatggtgccaaaatttgtatttgaaatcacccttgatttcaggcaggaggcctgacctgtctatccctggtaattttgagcactgttaagtctgggtagaccatctgctttacctaagcttagatcattggctctctttttcagtagtctgaggctttcctcagaccagtcacctcttcacggacattttaagtgtatgagggctaagctccaaaacacagtaattgctcttgagaataagcagttttctctgtgaacacaagaaaatcatattctgctgggctcaaagagagtttcttaaagttgactcagaagaggcttaaaaacagtaagtgttacaaatggttttttgaaaggaagaggaaattatttatttattattttaagagtttcatttcaagaatgagggaagtaaaccaaaatatccagctttttttgttgttgtttgttttgttttatttttccctaaaactcttttgcaggaaaccttatggggcttttgccttttgatcttgctatagaatctagatggatacatgagacagaaggatacagaaatgttctcaaagtggttgggccacccaattaactctaggggtgtgattcagttttgtaccactttacatagtgagaaaacattccagaaggagctgtgctccccttgggtgtaggaatgtctctcctggtctgcaatgcagttgaaaagtgaagaataatttccattttctgctttgtctattgaaataaaaagacaaagcaaaaacaataaaaaaaaaactcttctacatcatttatcgctcctttatttggcaggagttttcaaactaatattttctttttgtacaccagccccattttttaaaaagtactgagtagaagttttttaaatttggcaattcaaaaaatagttttacttcaacaaacttaatgaaatcattattctttaaatatcatatggaaataatagtaagtttttttttgtttctttaccacattgatatttgtggtttgtttaccacactgccattcaacctttgatgaacatgtgggatgaatgagcactactggtaataatgaaattaggtacaactttcccataagaaaatttggcaaaatgcatcagaagcttcagtggtttttatatccttttatctggtaattcttccacttaggatttttgttcttgttagaagaaaggaataagtgacaatctgagaatatttgtccctacgtgagctaacacagtcttttaagatttgtattaaggttagttcctttgcacctatcagttttgcttttaagttgagattatttatgtttgttttatttatgtgaaataagtccttagaaaatatctttgatgcttatagttataggatatagtgatttcctttaccagctgctaagttctattaggtttttttgtttgtttgttttttaaagacatggtgatacggcttggctgtgtccccaaccaaatctcaacttgaattgtgtctcccagaattcccacatgttgtgggaaggacccggggggttggtaattgaatcatgagggctggtctttcccatgtggttctcatgatagtgaatggataagtctcacgagatctgatgggtttatcaggggtttctgtttttgcttcctcctcattttctcttgccaccaccatataagtgccttttacctcctgccatgattctgaggccttcccagccatgtggaactgtaaatccaattaaacctctttttcctcccagtctcaggtaagtctttatcagcagtgtgaaaatggactaatagagtaaattggtaccagcagagtggggtgttgctgaaacgatacccaaaaatgtggaagcgactttggaattgtgtaacaggcataggttggaacagtttggagggctaggaaggagacagaaaaatgtgggaaagtttggaacctccaagacacttgttgaatggctttgactaaaattctgatagtgatatgaacaataaggcccaggctgaggtggtctcagatggagatgaggaacttgttgggaactggagcaaaggtgactcttgttatgttttagcaaatagactggcagcatttttccctgccctagagatttgtggaactttgaaacttgacagagatgatttagggtatctggcggaagaaatttctaagcagcaaagtattcaaaaggtgactttgggtgctgttaaaaccattccattttaaaaggaaaacagagcataaaagttcagaaaatttgcagcctgatgatgcagtagaaaagaaaaacccattttttcaggagaaattcaagctggcttcagaaatttgcataagtagcaaggagcctaatgttaatccccaagatcatggggaaaatgtctccaggccatgtcagagaccttcatggcagcccttcccatcacaggcctggaggcccaggaggaaaaagtggttccaagtgccattcccagcacaatccctgtgctgtgtgcagtctagggacttggtgccctgtgtcccagcctctccaactgtggctgaaaggggccaacatagagcttgggctatggcttcagaggttggaggccccaaaccttggcagcttccatgtggtgttgagcctgcatgtgcagagaagtcaggaattgaggtttgggaacctttgtccagatttcagaagatgtatggaaatgcctggatgctcaggcaaaagtttgctataggggtggggccctcatggagaacctctgctagggcagtgcagaagagaaatgtggggttggagcccccacatagagtccctagtgggacactgcctagtggagctgtgagaagagggccactatcctccataccccagaatggtagatccactgacagcgtgaagtgtgagcttggaaaaacctcagacactcaatgccagcccatgaaaacagtcaggagggaggctctaccctgcaaagccacaggggcagagctgcccaagaccataggaacccaccttttgcatcagcatgacctggacgtaagacttggagtcaaaggaaatcattttggagctttaaaatttgacttgactgctccgctggatttcacacttgcatgggccctgtaaccgctttgttttggccaatttatcccatttggaacagctgtatttacccagtacctatacccccattgtagctaggaagtaagtagattgcttttgattttccaggctcataggcagaagggacttgccttgtcccttctgtggatttttgggttaatgctgaaatgagttaagactttgagagcctgttgggaaggcatgattggttttgaaatgtgaggacatgagatttggaggggccaggggtggaatgatatggtttggctctgtccctacccaaatctcaacttgaattgtatctcccagaattcccacatgttgtggcagggacccagggggaggtaattgaatcatggggggccagtctttcccgtgctattctcatgatagtgaataaatctcatgagatttgatgggtttatcaggggtttctgcttttgcttcttcctcattttctcttgctgccaccatgtaagaagtgcctttcacctcccaccatcattctgaggcctcaccggccgtgtggaactgtaagtccaattaaacctctttttcttcccaatctcaggtatgtctttatcagcagcatgaaaacggaccagtatagatgggctcttgctatgttgtccaggcaggagtgaagtgacatgatcatagcacactgtgcctcagactcttgggctcaagcaatcctcctgcctctgcctccccagtagccaggacaacaggcatgcaccactgtgtgcaattcctgttaggtttttaaccacacttccaggagatggtgttaattagaaagacaaagttgataaaaagtaataaataggagaaccatattgataacataaataacaagtgtaggattagtacctagaatatataaagaactcctgaacatcaataagaaaacaatggggtgggaaagaaggcaaagaatatgcatagacagttcacaaaaattcaatctgtacctaaggaattgcacattaaagtaatacacagatacaaatagtattttacaatcagcttggaaaaatttagagagcctgataatggtatgtttggagagaaaaggaaatcagaaccttcatacattgctagtgagagcaaagatggtacaaataccttgaagaacagtttggcaatatttaataaagtttccagtgtgtgcaacctaccatttaatgattccacctcagggcttacaccctgcagaagccataaaggagacaaacatggggatgttcactgcagcattatctgtgattgcaacaaactgcagtcaacctaaatgcccatcaataagggagtagattacatggcacatcataaaggagagaaaataaatgaattagatgggtgtgttttttcatggatagatctcagaaactaaatattgagtgataaaagcaagtttgttcaagcacatgtatggtcaacaagtatgtaatttttgaagaaaatcacacaaagttataggtgctatcttgcaaaagcataaacacatggattggatgactacacatcaaattctgggtaatagttgcctctggggagggagagcagggaacttatggggcttattgttgtcttcaatatttaatacaaagcaaacatggtaatatttttggttttttttcattctgggagacagaacaatgactattctatcatttaccacaaattttaaaagttaacaaaaaaggtaaggaatactttcagggaaataaaagtaatgaggcgcatctcaaccaaggtgttcatcagaaacttgccatcactgtatttgcttgcacatgttctagtcatctctgttggtattttccctcatactatcataatcttttaggacaggaactttgcctatgatttctttgaagccaagcctcatgcaatttaccaaagaaagtatgatcatcattctataagccacacacagaaattgttagaaagcttcacaaacctgctagagtcagtgttggggaaagtgtgggtgaatgggcacttggatcctctgttggttagaatataaacagaattgctttttgcaaggaatttgggctgcatctctcaacatggaaaacaggcagtctctttggccaactatcctctacctcaaagaccccacactccagaaagcctatataaaggtccagtatgttcataatgcaagaatattcaattctgcattacttaccatagtgaaaattgagaacaatagaaatgcctttgaatctgggaatgatttaaaatttttagtaataaaatggaacatttggtggctgcttttgaaaagaaagatagatctaggtgtgttgacatggaaagttgtctaggatatattattattatttaaaaagcaagcggcagaaaaatatgtatcatgtaaccagatgtttgttttgaatggatgtatatagatatataattatattttatttaattctatttgaattagcctataaataaagcagagaatgcatgtaaactcttaaattaattaaagagtagagataagagagagtagggagtgggggctttttgtatttgtttatatttgtctttattcttttgggattttttgatgagcttgttttctcatttttaatgtacagtgttagtagtattactgatgtctgaatgacacttccacctaaagatatgaaggaagcacgtcatgtattgcatttcatgttttataccactatttttctttaggagatgaattcttccttgagagatctcatttgcctttttagtaatctaaggtttttctaagactccaaagaaacctgaggtaatggagcagtgacaatggtgcacagttgagtttgcatgaaggtgactcagatttcagcccttgaggtgcctgatcatcacacatagtgattgactgcatctcatttatgatggtgcagtctactcttttcagatataaataatagcacagctcattggacaggaagggagagccaggtagttccctggttgcatgggtgtgtaaactaggccagtgattttacatcatcctaacgaacgtattaatagcatgataaaacgaaggcccttgaattgttttggtggtgatgcctactcaaccttcccatattcaagatgatataaagctgtaacaggctttcagaaatgcagtctagatttgatatagtgctttttattaactgtgacacaatggattatggcacttcaaatgagaaggggaattttcttcctttttgaaatgtgaattaacaaaatgcttattctcagtagaagttgttttcatgggcttttccatttatttctgctgtggttgccttcctctactgcctctttgctagacaggcaaacagtcacacacacatagttcatatacccattaaatcatgctattagaatggaacttttttgtttgtttgttttttgagttggagtctcactttgtcacccaggctggagtacaatggtgtgatcttggctcactgcaacctctgcctcccgggttcaagagattctcctgcctcagccttttgagtagctggaattacaggcacatgccaccacaactggctaatttttgtatttttagtagagacagggtttcaccatgttggccaggctggtcttgaactcttgacctcaggtgatccgcctccctcggcctcccaaagtgctgggattacaggcatgagccaccacacccagcctgaacaactctgtttttgaggaacggttttatatttcagaagaggatatttcaattgggtcatgctgggaaaactccccaggagatgaacctgccacttcatcgtgcagttattgtctgtacttgcacaaattattgcttcttctggcttgggatacttcatctacttgtgagttggcagtagtgacacctacctgtccccccctggagcactgggctgatgtcatcattgtgcggtgttggatgagtaagtactcgagaaagggtgattgccaagggctgggtagttcttcagggggatgggctgtgttagttgcctggttgttaaaataggagattaagaagaggaatcctgagcctgacttcttcctttgcaacccatgacctcattttgtctgacttttttcctttagcagttaaggccattatactctacagatatattccagaggaagtggagggctccacctttaaaaataataagcaattcaggacagttcatataaagtcaggatttgaatagatatttattaaatgtctgccatgagtaatgtattccactaagcacaagggggagatataaaacgtagtttagtaggttcttcataggttctaatgaaatgtaaacaccttacgagaagtgtattcctttatgtcacaaggaacccttgtgttctgtaggtcaatcactgtgcaatactacgtagattcagagatagttattaagcataataaatcaatcacacttttctctaaagctcagtagagatactacctgtctccacatattacatttgattgtaagatacagcctagagaaaaatgttagaatctcattgcagtgatttccaatgggaagaaatctaagagaatccattcatttgagattttctgtattataaaattattttctaaaccagagtctataatagatttcctttaaacacaagaatatatatcataagcataataaaaatgaatcataccacacaattcttgtttgtataaagaaatcctaatacatgaaaattaatgaatgatattgccacttcatatatatatttgtatgtacaaatatttatatatatttaaatatgtacctatttaaaatatatatatttataacctaatgcctgtatttacaggattaataaaaccataaccctatgtcagagtttttaatagctagcaacaataagcaacttttgttaattttgaaagaaaatgaatttattgacagggtattgggttacctgctgagttgctaggcagtaagaagaccaggcttggaaccgggagcagtacctctaacacactgcagaattggtctggagagcaatggaagcctgcttctctgtttctattgcaccaataattcagtcttcccacagccttgcccactccctgtggtccctgttccttttccttatcctttatctctaacacctgagtccagtgcagaacacctgattggtggatcctcagtcacatgttcattccctagctgcaagggaggctggcaaaggaacacctgcattttctcatttctagagtaggaggatgattctgcagccaaagcaattgccaaattgttattacaataattatgctagaaagtttgaaaggcagaaaacatgaaaacatcatcatattccattgttctgatacaaaactattttaaaataaaattatcccagtctttttcctattcatatgtttttacatttgtgcaatcatagattttatacttttacatctgcattttattttcagtgtctttttttatgttgctatatacacatatatcattttaaataatcacataataattcaaataaactgacttattttgccattcttctaatgtcagagattactgataaattttcattattttgaaaaataattttatgaacgtgttcacatctaaagctttggcatctgaatgttgtatttggggcttcagaacccagaaggaaatcttatcaacccttgagtctttaataataaaattagtatacttgatttatacctttccttaattgacttaaacacaaacacagtcctccttttgatgtgaaattttacaagttcggaattgagtgagttaaatttgggattgtttaaaaaattttaaacattttatgtaggcaagctatgtttgttaagcaaatatttactaaaaagtactgctttttaatttaatactaggaaaacaaataaatgacctaataataaatatcctgtatctaaacaaggtaatatgatgcacatcataataaacttatgactgtcatatgactgttaacactgacctcaatattttttaaagtaaaaagtttcgatttcatcacgattacatatatcagaatattttccttaccttggatgttgtgagtcagttacggtatttacaagtggattcttgtagaattaagtgatattatcataaaataaacacatcatggtgtattagttagccccttggtaaatctgccagtctaccatttttaatatttagaataccttctgtctcctgtaagattctggtattgttgcttgttcatttgacatatgtttagtgcatgtctagtacatgttggacactaagtgtccatattatatgtccagtgcatgatgggcagcatattaagtaacagggtataaaaacaagaaaaacaagaaggacatctgacctgacatttagaggcttaaatcgagcaggtgatattatagtctggaaatggatgtgtgtgggtgtatctgaaaaatcacaatagactggttctgggaataatgaccgaaaagtctcttttgtgcatatttaagttactggcattaaggttagtatgcatggtttgaggacttgggactgggaaattcttaggtattggttaccatccctgactttgaaatatgaaaatatgatgatatttgacttgatacagttgcctcctttttttttttttttttttttgacatctttagcccttaaagtcagcctggcttatgattctgctcttagatgagggtggttcattcatggtatggtgctgaagaggaattagtgtagcaaaatcagaaggcttggggaaaagcatagggtttttcagcattaaatctctccttatataacattccttatattcttcttcccactgatgattccatttctatcccttggaatctagcaaagggctatttgtagctgcaagtattccctggaattgggatcctacaacatgtaaagagtcaagaatcgtaaaatgtaatttaaattaataatccagatctgaactgtactctcagaggttaaaccagacataatctttcaggatcttggtgggcaggttggttggtacattttatgtcttagggatatgtatagatcctcctttagaaaagatagagactgttttttgtttttgtttttgtttttgtttttgaataagacaacttttgctccagttctgctagcatggttggggaccacattaaaattccactttgatcaatagaaagacaaataccataatgttgtcagagtttttttctcagcatgggattgttatatgttgttccttccttttgctcatccttttctctaaattttctccagtcatgtacattatgggttttggggttttgtttttgtttttgttgagacacagtctcactctgtcacccaggctggagtgcagtgacatggtctctgctcactacaacctccacctcccgggttcaagtgattcctgtgcctcagcctcctgagtagctgggattacaggagttcaccaccatgcctcgctaaattttttgttttcgccatgttggccaggctagtctcgaacttctgacctcaagtgatctgcctgcctcagcctcccacagtgctaggattacaggtgtgagtcaccacgcctggcccacattatatttttaataaggaaagtaataaaattggtgtcttttcctggtattaaggatgacaagatgaattcaataaaatttccttggtgttttttctctcgtatgttcctttttgtgacaacaattttgggacttttaaaataagtatgtttgccatatcactgatagcagtgcattgattacctctgagaaatgaagccacgatgcatcctgcatatttggttggtttggagtccagcacatcagggttcagatctctggttatatgaaagcaggcaagtcacatcaagctagttatgtaaccctctgccctcagtttcctcatctgtgaagtgagactagtggtagcacttacattcattgtgagcatcaagaaatattaatgtatgaaaaggcttgagcattatgctttgtatataagagatgctcaataaaagttaaccttcctctcttattttcttttctctgaagggagagggtgagaattgttacaacttattctcatactctccaataactattttgaatatggaaaatggcatggcttgttgttaagtaaataatcatgttctatattagggaaaaagaataaaaaattttgcattatttagccttttgttatgtttttccatagtcatttctattatttcaagaaatctttctctgtctcttctcgctcgttctcttttacatccaaggttgactttctaagcatattcagtggtaaaggtataactgcatcatcccatatttcaataccaaaacggggagaagaaaacacttaaattcagccaccacagtgcattttccaaagtgttaattaaataatatacataatacaaggaagcttcagtttggcgattgaaaccacttgccattttgctaaaagtaagagcccatttaagtccatttaagatcatttgggtctgcacttatttgtcatgggtatcatttgagacaagaactttgtaggaacaatcttgtttaatttaatgctatttctactactgtagcttttgttttgttttgtttttctaagtggtttgcagatagttttgtagggaggcaaataataaaataaaacgatctagaatctttaaaactgcaaagaatttgccattgaagcattaggattaaatttttttttgtaaacccccaagacaacatttgtgcatgtatgtgcatgtgtgtgtatatatctaaaaactatactttttcctttccttctaactctttattatggaaaatttctaataaatacaaaagaatagcacaatgtgcctcttgccccatctctgagagcatttggcacacttctataatacttgaagagcaattagaaaataaaagtctggggttatttataaaattatgaacaaatgactttggaaagtttaaaaaatagattggaaagaaataacttttcaaaatgtaggaaatgaacagatgaaaaattatttgctggggtttttttttgttgctgttttttgttgttattgttgctgctgctgttgttgttttcagacagtgtgggcagcaagccacccaggcgccaaggcaagagaccgaggacaccagctgttccagtataataaaatataaaacaagaatagttataccagatatagatcttagatatgattatatatgaatatcattaatcattagtttgtagcaattactttttattccaatattataataatcctctctctgtaatcataacctaggaaaaaccaggccatacagagataggagctgaggggacttagtgaggtgtgaccagaagacaagagtgcgagccttctgttatgcccagacagggccaccagagggctccttggtctagcggtgatgccagcatctgggaagatgcccgttgccaggcggacccgtggtctagcggtagcggaaagtgtcaaggaacaacacccactacttagcagacagggaaagggagtctcccttttccccgggggagtttagagaagactctgctcctccacctcttgtggagggcctgacatcagtcaggcttgcccgtggttttccggaggcctaaccatctccctgtgatgctgtgcttcggtggtcacactcctagtccgccttcatgttccatcctgtacacctggctctgccttctagatagcagtagtaaattagtgaaagtaataatagtctctgatatgcagaaataatggcgtaagctgtctttctctctgtctcctctccctctctgcctcagctgccaggcagggaagggctccctgtccagtggacacgtgacccatgtgaccttacctatcattggagatgactcacactctttaccctgccccttttgctttgtatccaataaataacagtgcagccagacattcggggccactaccggtctccgcgcatttgtggtagtggttccccgggcccagctgtcttttcttttatctctttgtcttgtgtctttatttctacactctctcgtcactgcacacggggagagacccaccgaccctgtggggctggtccctacaagacagagtctcactctgttgcccaggctggagtgcagtggctcgacctcggctcactgcaacctccacctccctggttcaagcaattcccctgcctcagcctcccaagtagctgggattacaggcacacgccaccatgcccagataatttttttgtagttttagtagagacagggtttcaccatgttggccagacactggtctcggacacctaacctcaggcagtccatctgcctcggcctcccaaagtgctgggattacaggcgtgagccactgcacccggctgatttgctgttttatcatggagaatttgggagagtaaggaggctatatgtgaaactccgtaagcttattgtaagctaagcattagccaacttctggttttgtttgcaagtatagtaacgttcctttatttactattttatcagacataagagacttttaagtgacactctcagatatcaataatgcactcatagttgatgttcggaatgactcagaaacaccaaaagcagattcctagtgtgctttttgaaacattagaattgttcagcttcattctatatagttttagggcatagtttatcattattgtgttgaattgatcgttcttgatttatagcatagcttttcctgtccatctgactgtccagaactcaaatcagtatgaattcttgagtattgaattaggctatttacagtgaagatgacgtttcctgcaccctccaattagctagaaacatctcctttgcatgtcaagacaagatgtgaaataactcttgataactgtgaatatcagatataagaaggaagcatgtcaatagttcatgagatacctgtgccattcctggggcttgactagtttctgtgccttttctgaaatctgccactgaaaggagtcgggaaggaaattggcacagcctcttctaggataggatttctacactgtggcattattaacactgggacgaaagagtctttgttttgaaaggctgtcttgtgcatcgtaggatgtttagcatcaccgctggactctcgcatactggatgccggtagtagcaccccctcctcacatagttatgacaaccaaaagtatctccagacattgcctaaaattccttgaagggcaaaactgcctgtacagttgagagctcccatcttaataggcaggagcaccttactgtaaatttctgtgtgggttactctccctgtttcccccacctaacccttgggttgtaagccccttgatgatagaaatgaagtattttctttcatgttgaggtctcgctttcttttctgtctaccacacaatatatagagatttgaggattgactatgccattgctttttttttcagacggagtctcactctgtcgccaggctggagtgcggtggcacaatctcagctcactgcagcctctgcctcctgggttcaggtgattctcctgcctcagcctcccaagtagctgggactacaggcatatgccaccacacccagctaatttttatatttttagtaaagttagggtttcaccatgttggccaggatggtctcgatctcttgacgttgtgatccacctgccttggcctcccaaagtgctgggattacaggagtgagccaccacacccggccgccattgctttttagtttttgtttttatccaagccacataatatagtgggtttttaacaaaagggcagtcttgacatttctcttcttcccgtttttgttactgcttcacaactgagtacgtaacaactggtacttcagtgatacagtggcctattttctttcttataaaagacattactatatcatacagtattttaacctttcctttacaaatctcatgatactgagatgcctttggttaacaaaaattgccattgagtctggaagattgtttgtttgctgactgaccagccccctcatctcatccttctcacaaagaaagaaagaaagaaacaaaccctcaacccttaaattagtcaaagtcctaaggcagttttcccagaacaaatgtccatattgactttctccgttgttaggtcctgtccttgttgacccgttgctggcttgaggggctgattctgttcactttggaattgggtagcgttttggtttaacaacagtgtccacccagcgggggaccaaattctcaggagaagccttatttataataaagcacaaaaacaaatactcagaagaaatagtgattacataggccctctgaacagtttcaaaagcagaaataattccgttgaaaatatgaatcctgtaaataactcatagtttggtagtgtttcataaagtgattaggagtaagcctcaatttcctcatgctgaaaatggggataataacatctgctacttcgtaggattgtaatgaggattaaataagtgaatccattgaaaactttcagaaaaactacctgtaacatagcactcagtaattgctttattttctttcttttggagatggagtcttgctctgtcacctaggctggaatgcattgatgcgatcttggctcattgcaacctctgcctcccgggttcaatcaattctcctgcctcagcctcctgagtagctgggactgcaggcacacaccaccacaccaggctaatttttgtatttttagtagagatggggtttcaccatgttggcctgaagtgatcggcctgccttggcctcccagagtgctgggattacaggcatgagtcaccacacctagcctattttcactttttaattcttctcctaattatgaggagtctctatatcttcccattttcctacctcctttaaaattcctacctatattctccaaagaagtagtctatcctcttcctctttatatgcattatccattatttttatcacacaaatccaaatgggactatccaaaccacatatattggcctggtataggtgtgtcctccctttacagatttttatagattttcaaaaaattttaaatctctgagaatttgctttgtagagtatgataagtcataggtttttgtttgtttttttttggcaaagtactttttatagtgaggaaaaataaagctctgcctaaatacctatgtaagcttaagtttcagttgattacgtgttttagatgacatccatgtagatcattggccaatttgtttgaaagaggtagtcatgatttttttgatctgaaaaggtcaatatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnccagaaagaatcacaggaatcctcctgaatccataatcaattcatgcaacaccaagtcagatctcttagaagaaaattgctggtgaaggtccagaatagcaagctaaaaagcagatatttgatacttgcaataggctgataggtgtgctaagtgcttgcttagtaaacatgctaccataacacttttccttttatggagaaagaggacataaatacataaaaataaaatatcaaatacataaatatgtgtgcactgtgtgaatatgtacaggttgtctcaaatttatacgaaagcagagtgaataatagaatgaacccttcgcgtaacccatcacccagcttcgagagttattgactcggctcatcctgtttcacggatacctccctctaacttgcaaatcctagacataatttcatctttaaatctgtctcgtagtttgttcaacctctccccagaaaaatgtacagtcaaagtttgcttacaattttcaggaatttacaatttccctaaaacccagttaaagagaaccactgactgatccagctcatttggaagtatgagaggaaagatgtcacgaaagccttctgtatgagactgtggcctgcaagtgtcccagctctaacgttcatgtttttcccctttttctcttactctcacaatccatctatgatatttgagttagctaaagagaaaaagataaaaggatacaggaaagaggctgaatatttccttcatcttttaaagtcctctcgtctccttcttggtggctttatattttttttgagattgtgagctatatgatttaacactaatccacttggatgtgaaagcaaaaattccaaggtgaacaatcatagagaacattatttatttactgagcatttactatgtgccaagtacttttcatgcatctcatcacttaagcttatcagcatctccagcaactattaggtaggtaggatccatgagcccattttgtaaacagaaaactgaggtccaaagcatttaagcaacttgcccaggatttgaactcagatctatttgaaattccattcagatgtttaacaatactaaactgcatctctccattttactctgacagtgggtcgtattcttagctgtgtgtcccaagcaggcatacgtggagtattttatagctgtgtgcaccatttataacaacttcttcatggtggcgtgaggcatttcagagcattatataagaaagtctcttaatgtttatgctgtttttaaattagacttagtgcaagccaagaagaagccaagggcattttcaaagtgttcatcagatcatgttgattctctttattaaaacatctcaatggcttcttacaagtagtagagaataaaaatcaaattcctttcaatggcctgcaaagccctacaacatctggcccagacattcttttcagggctctcactgaccttgtcagtactccaaaagtgctggctctgtggttgttgatcttgtccttattcatccaatatgctgggctgcttcctacctcagtatctgatctcttctgtacctcaccatagctggcttctcatcattgaggttccacccaacttgttgcttctagaatagctttgttgcaatggcctttttttctcttttactgtctgcattgcacttctcattgtatgagattcttattcctttgttggttcattactctgtgtttgtctctgcttccccaccttaaatatgattttcatgcaatcagggcctgtgctttagttgctgctcagtcttcagcacctagatgagtgctgagtaaatcctggttgaatgaatgaatggtttgttaagtggggatggttacattaaacctgcatgcgaagctctcagcacagtgcatgccccagtcggaaagcactgccgagctgctgctgttgttggtgaggttaattccaatctggaacttcatcataacataatctataaggcaagttttaagaatttcccaagccaatgcagtttctcaaaaaccagaaggaccctcagtctcatgatatagatcctgaagttgtgttattaggagatggctgctttttgacagtttttagctcatgtgggcttgaccttcaaaccagtagcattcagcagctctcatctctgcctaggggctttctgaccttttgcttaggcccaaggcaatgttttcatctctgacaaacttgaccactgccagtttcttaagagtgtcggtacttatgagaaggagttgttctgcctgtgctgtaatcatctctaatacccgataaactgcaaacaatgggggcatttgaggggggaaatggtacaacaaaaagacgtctgcgattctgaggcagggctaaactggggcacgtggaaaagttctagcatgtggaatgctgcactcgcagctcccatggtgggggggatctggacggtcctgacaatgggccattataaaggcactattgaaccacgtaattgtggcctttggaaaaaccataaaaatgtgtcaaatattatacaaatgcaaactgtacaagcttgaatgttagaccaaaaatttcagaaaaaacaaagtcctctccatctgatcaaacagttcaagaaaaagttgaaacaaggcgaatttcaccattgtgtaaccccttcatgggtttatttgttgcttgcaaaattttcagtagaggaattctgcctgaatatattttcatttgtccagatctgtaggctttcattctcatggaatgtctagcttgtttaaattacaaaatcagtgtcatgtacattatagaaaataataaaataacaatcactgagaatttatcgctcgggaatagtcattgttgagacttgaccgagtaatttgtcattagtttttttttttggctttgcatatatataaatagcatttaaaaatcaattttggatagcagcatgtatagtgtttttaacctgctttatgttcccatttacattaatgaactttccgtctcattaaatattgttagattaacacagtaacggaaaaccaaacaccacatgttctcattcatacgtgggagttgaacaatgagaacacatggacacagggaggggaacatcacacaccggagcctgttgaggggtgggggacaagggcagggagagcattaggacaaatacctaatgcatgtggggcttaaaacctagatgacgggttgacaggtgcagcaaaccgccatggcaaatgtatacctatgtaacaaacctgcacgttctgcacatgtatcccagaacttaaagtaaaaaaaaaaataaatttgatatatgaaattcaatgtagtgtactagacaagaaataaacaaaaaattgttagataaaatgtggattgtaatgactgcataggatccatttatatgtagtggttctcaactgagggctgttttgtccccaggaggcatttagcaatgtttggagccagttttggttgtcataactggagtgggacatgctgtgttacttggcatctaatgggtatagattagggatgctgggagacagcaggcagttcacacatcacccccacaacaaagcagtatctggctccagtgtcaatagtgctgaggctgaaagcctgaactatatggcttccttataattaattgaatccatggcctatgagatatttgttttcaatttttttattagaaattaatggctgaaaaactttatctataaaaaacagagtgttttagacttttggggccgtcgggtccattactcaactatgctcttgtactgttatagcttgaaagcagccatagactatacttaaatgaaagtatggatgttttccaataaaaccttattgacaaaaatgggcggcatgccccaggcagtagtccacctacttctgttagagataatgctctaatagatgtctgtgtacctaaatctttgtcccgtatctgatcatctccttagaaaagttcttgaaaagagccattgctgcatgggcaacatgtatgtatctttttaaagtttatatccgtttattttattttatcttttacagttctacctatttattttattttctcctatgagattgttcatttcatgtagctttctgaacacacttgcgccaccatcattctatcagatttggaaccttgttcagggatatgaagtgtgaatgggtaaggtaggatttgcagatttaaaagtcttcaggaatcagacgggttaatgaataaagtagtccagttgtcagtgtcagaataaagagtgatgagagttgcagaatgaaaagtaagtgctcattgaaagggagaagctacttctcaactctgttgcttttcaactctgataagttgctggcccagtaggagtgcagtttggtatctctagatcttctgatttatcaaccagaaaagagaaatccaaactctggtttgagaaaccagattttgggttgaaaactcccaatttttcatcattggtgacaaattcatagaacactaaattctgtctaggtgaacagacttgcctgtggtttgtgtccatggactgccagcttggggaccttggaataactgtgacttatctaggggtctacagctagaggtgaaagcaaatctcaggcttccggccggtcatttgagacccacagggccctactggcttgttgtactgctagatgagagctgtaagaattggcaatctttgggcagcccctgatagataaggaagctttatcatgtgaagtagggtggcaggctgtgaatcaactgcctggcctgaagacttagttcctctagagctttctaacttaggaagactgagggactgtcacacttcatttcctcaggacgtttccagaggtggtcagaatcctagcctacaacccctgcctacacaatgtggccccttgttcttcggttctgccccttatccatgcacgccagccacagtggttccacactgcttcactgacgtaccaaatacttgctgagtgcccacagtgtgccaagctgtgttctggacaaagcagagcagaggagggagaatcaggagcactggtagcatgtgggctggatatgtgaatatgtccttaagatagttataggagacaaggtcaatgaggtaatgctcctggggtggggtggagtgggagaagtaggcacagtggacaggggtctgtagaatctacgtggagaactaacaagctagtgtggatttctgaacaccatacccagagattctgattcattagctctggtttggggccctggaatgtgcatttctaataagcactgtgaatagcattgatgtagggacttctaggccattgcaaatactttgtttttgtttttttttctcagaaataagtagggaaccattacagaggtggggtttttctttttgtttgttttggtttagtttctatagagaaatgacttgatctgacaatatcacaagatccccctattcattgtattgaaaatacaccgtcagagtgccaagacagaagcaggtagaagagtcaggaagctttccatcatctaagtttgaagagatggtggcttggatcagatggtaacagtggagcatgaaaatccatcatattctgattattttctgaagatggaaacaatatttcttgatgggttggatccagggtatgaaagaaaggagtcaaagataaccatgatttgtagaatgagcaactaggttaagccagaggaagaccattttttgacctacccccgcccccaacaaaaatggcaattttctatgtttcaacctaatagaaaaaaatggagttgccaactgtgaaaatgcagaagaccgtgggaggagccaatttggaagagtggatgaacatgctgagcttgagagtctgcagtcctccaaacggtgccgtctcgtaggccagtggagatgagtctggttctcagagacctctgttctggggtgcttaaatccatgtgactgggttcgatcaccagggctgggagtgtagatagatgaaatcaagctcggatccttgaggcactctgacatttagaggggagaagaggagaaaactagctaaggagagtgagaagaaatgaagaacgtgagagaaaaaccaggcaagtgtggtaaatcgaaagccaagtaaataacatgtattaagagcctccttgctgttctttgagcaaccaaggcttgttcacacctgagggctgtatgcttggctggaacgccgttcctgccaatctgcctggctcatctcaccaacttcaggtctgggcgtcaatgtcatactctgtgaggcccttacctaaacacactgtgtaagatttgcacagttgcctggcatctagttggtgctcaagcaatatttgttgattgaatggtgaacatataacttttgatgaaggcagcagtccaggtgagaacatatgaaagccttgctgctcgggatgtagtgtgttccctggaccggctgggtcagcatcccctggcaacttgttagaaatgcagaaatcttgggctctagcccagacttgtggcatcacactctgcatttaacaagatcctccagtgatttgtgtacacattaacatttgctcccagtcctgtatttaattttctatgaatgtcaagaggacaattgagtatactctctcagatgggaacaactcaaagtaagaagttaaaacaatcaaaatcaaatatcttcaatagttgtttctgtattcaatcagaaagctatgatacagtttaaaagcaaaagaaaactgtgtcgagactttcaagaatattttatgtgattatccccctatcttttttacttttattttatgtggttattccacatatctttcttacttttactttgaattgacataagctaggagcgcatgtaaaatgcatggcatctggtacatggtagacaagtttgagagaatgagcactaattccgttctttatattttaaaacatcgtgctatataatgtaacatatccactcataatgtcttataagaccctcatttaagagaaatggttttctcttctattcggctgagataaaaccacatgttctttttattatcatggtctttggcttattttagcctgagggagaaaaaaataatgtatatattagggattttcttatgataacaccttttttctgaggctactaaatattgtttgtcctaaaaccaaagtatgcccgtcttgtggtttataataagcatactgttttataggtcattagctaaggataaaagacttgctgggaatttttgatagggctagtctagtctattctgttttaacatcaaattttcagaaaagtacatttgttatccttttcttttatacatatttacagctcaattctctgaattcagaagcctacaatgtaataagacaggaagtagtatgaaagtatacagacccataaatatgtgatataaatgtatatatatttatttgtgcacacctgggatatgcacctggaatatgcacctggaatacacccctggatttacacagttttatcttcccttcttattcagttaaagtcctagatcagaactgacccacagaagagggagcttctctagttcgcctctgcggacagaataatggagannnnnnnnnnnnnnnnnnnnnnnnnnnnnnnnnnnnnnnnnnnnnnnnnnnnnnnnnnnnnnnnttgtttaggtttcctcttatttctgttttctttactttaaaagggtggggggtaattaagcatatcctgtattcttacaaagatgcttgtccagttaagacagtagttggaaaaacaactgtaaaattacgtatacatatactatttctctttattaaaatcaccccattctttccttcaaatcctgctaaaacttctgttgagtaggaaagttcaattctagtttggtgaaactttcctagagagcaggggtcagcattttctataaaaagccacaatgtagataattttaggccttgggggccctgcagactctgttgctactcttcaaatctgctattgcagcaagggagccgccctggacaacatgtcaactaatgggtgtggctgtgttctgataaaactttatttatccacattgaaatctgaattttatataattttcatgtgtcatgaaatattcttcttttcattttttttcaactatttaaaaatgtaaaatccattcttactttatagaccatacaggcagcagaccgagttgggctgatgggtggacagactcctgttgtagagaaaaagcactgggtttgtcaaccatagccatttcgaacctttctttatttaagactctttggtttgctttgtatttgcatctgattttgattcttctcccttaggccaggattcatacccttgttgtttttactttttgttaaggacagctttgtacagattgtacagtaaacaagattatatgtccaaggatatatgttctgggcttttgttttcttttgtggtaatgtaattgtgggactgaaaagaacctcgacacttaatcagatgtgaccttttgcaagactatcctagttatttaagaaagctagctttctctgttttaccgcttttttcaggaaatatgattgcataactgacattctctatggattgccatttttaaaacagtatgaaaagaatagtggtgtggtgatagataacaattgattaaagggtaatccctttagttttctttaaacttgctgagcaaaagaacaaattatctctctaaacataagtgataaatctgaacattttgttgaattattaaaaatatatatatataaagccatttgagtgtagaagcatgtcatagctactcaggaggctgaagtgggaagatcacttgagcccaggagttcaaggctgtagtgtgccatgattgcacttgtgaatagccactgcactccagcctgggcaacatagcaagacccttatctctaaaaatataataaataaataaataaactaaaaggattaagaaaatctacactcgcttctacttgaattctggtttacaaatagtagagagaatagaagaatagtggatatctagatagggatatttcttccccagtaaattctgttgtcagccaagatggtagtatctatagctaccatcttaaactgacatgtgatgtgctccaggatctctttagaatgaaactgatggaaaataacctgtcagttttacccaggaagtggtaaagctgaagtgtgacagttaggaggtgatccattccgattctcttgctatccattcaagatctgaatgaagaaaggaaacaggtgaaattacaggagtgctaacaatgaataaaagttacaaagcctttgggtgtttgccctttaactcagatagctagcataatttatatgaaatataagttatatcaataaataatattttatgataaagtattctagctttattttgctgtctatacttcaggtgttcagcagtactcaacttttgctatctgaatttcttagtgtggttagtcatctggaaagtcaaaaacatgcaaacattatcaggaaatcataaagatgtttctgtcctctttaatgctacatatatgttctcatttgcatacttctttggctatttaaaaattaatgaaagcaaagttattgactaaaaagctatgaattagggtggctgaagacagaaaattatatttatatggctttttaagttgtcaaagggctatagagcctcataataatgctatgagggagtttggacagggttagtatctttctccagcatcttctcagggagggaagtaaacatagagaggctatgtcacacaccacctgtccacagtggggagtgacattgctggtgcagtgatgatgctagaatgccaaccacattctagatcaggggttctcaaagtgtgatcagagggccctggttgtatctaagacccttgcaggagttctgccagatctggactatttcagaataacactaagatattgttttcctttttcactctcatttcaccagtaaacaatagagttttccgaaggctacatgtcgtgttgagatgtcattgttctgacatcctgtgagatatctactaatgtataatcgtgtgttttcaaaaattctcaattttaatttctaatatgctaaatattgatagatataatccatgtaaacacaataaatttaaagagtgtaaaaggatcctaagacaaaaatgtttgagaattgctgttttagatattgtgctaaggccgttagaaacatgatctcatttaatgcagaaaacacacatatgaggcaagctctactgtcattcccattcaatatgctaggagatgagggcctggagaagttaatgaattgcagaaggtacacgggttgttaagttgcaaagatagaatctgaacccaggtttcaagttaagaactccactgtctgtgttgtcaggcacattgtctttcaaagaagcaccaggaaatgcctggatttggactaatttctcagaagagaaacttcttcccataacctaggctatctccaagggaatgtaaatatgaagattatccttatagacagtgtaaaatagagattattttctagtagtttgtgggccgaggcttgtactctgtgaaacacaaaacagttgagcatcggatctttaaacctggaggattttacttaaaaaagaagtttggattgccagctacccttgaaaaatttggagattttgagctaggctggactcatattcccacatggccacaatcagctgcagtttttatctgctgttcctgctagatagatgtgtgtcctctggtttgccacagacctcactactccttattaccttcctcgtagctcatgttcctcatttatgttgcctgtttgaggtatttgggttagaaacagctggagatgttctgtctactgcatagtgtttataggccatctgctttcaacttacgtgaaaaataaaaagttattaacagtaaaagagccaaatatatcccattctgcttacccaaacctggatgtaataaagacctcactgacagtgccacatagaaagcaaattgcttctttctttactaaagcataatattctgattcattaaagaattaggatctgccagtgaattaacatttatttttaaacatgaatctcttttctttttaagtgtaatagtgaaataagcacattctactcattgccctcattttatgtttattttagtaatgtctactgtcatcattatcatgtctggaccctttataaaaaaaaaatctctgtgaacctctgtgtacatattaaatcagtcatttgaaacaatatgagattgtcaacctaacggactgcattatcctgggcatttagacaacattattgaacttcaaatttttagcttaacataacatttgtcagcagtagatattaagcatttatcataatttataagtatatatttgcttgcctcttttctttttttgcctcaccccagaatataagtttcataaagctggaaactatatctgtttgttcacaatgtatattctatgctttgtacagtgtttagcacttaacagtcaataatgaatgaataaaggaataaatatgtaaatatatcagtgttgtatatgataactcattcttctgtaatcttaagaataatatgtaaaaattctcagcaaaaatgctcatgcttttttcatttgagaattaaataggggagatatttatttcttattatccacataaatatatatccacttctgtgtgtgctatgttctatttaggatagtgcccggtcttcctgatgtgaggtcaataggcaggttacacatctatgtagctaagaataaggtgcatattaagaccaggatgcaagaagaggctgttgaacttgaacattcagcacagagtctcttctcttctatactaaaagatagtcatcctgcagtcggaagtggcagttattcggccattggaaaagtctcatgtaatagtagcttttagatgatgtctcctccaaaggggcattctgctattaacctattgctgaaagagaaataccattgtctattaatactactggaactaaagatgaatagtgaattggccttgatctgacagtgagtttgactttgatagctcgtcacttaaaaaggttcttttatatttatgaaaaaaagcatgacgtcaagccagggggaaaaattgatatcaacatttaagaccaaactcgtagggcttccaaaaaaaaggcccttatgtgaacgtttttttttacatgcataactaattagcttaggttattataagcagggcttctgtgataaagtttccggtggtgtctcgggataccttgtttatagtaccttctctttgccagtccatcttcaaattggaattatagaaagtagagggagggatagtctaccgtctctcactggattggtgccacctaaaacattgttatgctggaaatgctagaatataatcactatcaggtgagatttattctgactcatattcagtctttgaaatataatgcaataaattgatttaatccactttttgttattgtaatagacatactgttttcaataagtataaatctgctcttttaatgctgtttattatttgatgccataagaagtaattcaatgtagttttgaacaaagtaaatattagtaggattcttttttttttttttttttggcctagtgtgtggctaaactatcttcatcagctcctgttcattgctcataagattaaattgtctttatcaagaaaaaagtgacttaaaattgaataatgttgttttttggggaaaagtatttctcgttctgaattaatgtctgtaggaaaggagaaaaaacatcctgttggcttgttaatagtcatgtcttttaaaacacatacgtgtaagtgttatgcatttgaaagaaactacttaatgtagaattgctttttatgttgagttttttcttaattacaatgttgaataatcatgtccaaatgaaaagtgggagaattaatccacaactagttgatttaatcattggaagatttatatttattttctacagccattttacacagttggttcttaaggaggtgtgtgtgtgtgtgtgtgtgtgtgtgtgtgtgtgtgtgttttaaaaagaaagctgttctgttcgccaaggaaagtgaaacaaacaattatgccacttctacattgttgtttgatcttaataaaccctttcatgtgtgttggggaaatttttgccctaagataatttcaaacttttaattattagatatgagaagaaggatacaaggtttgaaagagacgtatagttaattagcagggaaataaaatagggcaaagtattacaccaaatcctactagttagactttaaacttcagtaatatcaaaatccgttagcacagtgcctggtacataacaaaggcttaataatttattctgttggtggcctggtcagtttcatgtttgtgcctgaaggaagagccgtctgaaactcacaaataacagcgctgttttcttttccctccatggctatgttcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagaggtaattcatgtctcctctcctctcctgttttcttatgctaaataacttgtctgttgaatatgattcccacacttaactgtggactctagtttgtccttgtggccacatttaccagcctttgtccccgattcaccatcgtggctgtggcattccagcctgttgtctccatcgctgggttattgggtgtagagcacatgacgggagacctggccctctccaagtgaaatgtggaggcgaggacacttttgccacttgcttcttcttccttagctgagtgctctcttctcttccatgcctttcagtttatgaagcagtgagaatgcagagagaggagaaggggaggtggaaaaggaaaagcaaaaatagaagaggtgtgggacatgctgtttagaagttccgcttgttgtgaatgtctggaatattatttttatttctccctgagttgggggaagaaagaatggaatatgcatggatggatttgaatcatatagcacatgagactttaacggaaacgcaaaggtttaattgctggatacattctgtttcataataaaattgccactgcccgttaaatctgctttggtgaaggctggattggaaacaagactcaaactaccttcaagctaattggtgcatcaaaatttgcagcatacaaatacctgagagctgtgatttaatgctcattatttccaaattatgagatgatgagcttcatctcaatgggatttaccgtactatggactatgaagtgtttatgcaaattcggaggcaacttttctagagttggattgattttaatttctagagggactaaaatctttgcccctatgcccaaaccaactgctttatttttctctacccaaatttgtcatctagcaagatgatttgacacaagttcttccttcattatttcatcttttggtcagattccactttgtttgaaagcttagttcatcttgttgctgtgccatcagctttgtgtgaacaggtcattaaaaagtcatttgcaaatccaagttatagactgtttttgcttgtgtttttgcagggattttataagtttgaagagcaaaacagggcagagagcgagtgcccaggcatgaacacacattcacgagcgtcctgtatgcaggtactgaatgacttggcagcctgaggatgaacactttgtaatgagaatctatatttgtggtggatcacaccttcctgaaaacttaagcatttttttcccccattgttttttttttttttatagagaaagctaggaacattgccattttcctcatagtatctcatgattaaataatgacaagggagaataaactaaaatgtgtttttcccctaagttgctgcaaagattaaaaacttcttaaagtacataaattttaataagatatgaaatatgtactttaacataatccatatatgttatacaaatttgtaggttagcaatttttgtattagtaaaaccaagatgtgtgtgtataatctagatattgtttcctaaatggaatctcatggaacatacattttgaaactatattaatttaataacatataatggatgctttcccaaataactaaagtttcttctactacatcctatttaatggatatataaattatgctatatctatttatatatctatgcatgtatatagatataggagagaatgataagcaacaaaatttgttgcctttctatgtttcctgtcatcaacttgcattatttttgtcataagagaaaaaaatattttaaaaatgctattacatcaagcccactaattttatttttctaagaacaaaattaaaagtggcaaggaaatgttgttcataagtttcctagcctatttgcatatttaccaactcaattagaaaatcatctcttaaagacaaacaaaacaaataaaagtggtgtcaatagaaatggaacctaacaaacagtggatagtagttattcaaaactggccaattattctttttaggggtcattaataagactccttttttgagtgtttactatgttcctggtactttgaatgctctgtacagtttgtcctgaaatcatacaagaatccataagacagtaaatattatgaacccccattttatagattgacaaactgaggctttaaaagattggaggctttgccctaatctagaaagcaggagaacggggattccaacccaaacctatgaattttggattctctcctctttaatggaagtggcaagagacagaagagcatccctgttagttctgtgatttcattgtgtaactatgaagtcctgttaagacccaagcacagacacaccaactagctcaaatacataaggtgtttatgaagaaatgttttcacaggcttgtctttgcaactgctgcaatgcacatgtaatcactgttgtttattatcataacttatgttttggtactttagaaataaaattgatctagtgggaatgtcagctccacgactgtaatgataacctcatcctggtgtactccctggggagtaccaagcacactggtagctgtacaaggagaaacttattttacaagtcactgtaagatgggtgcagggatagccagtggcctgggagccacagtgtccacacttccctgtggaacactacagacggtgttttccttctgcaagaaaagggtaggggccatcgtctttagggaaaaaaggaagtagaatgacagctgtcattcaagatgaagtgctgtggtacatctctcctgtttagggcaggcagtttagcatagttgtgaaagcatgggttaaattgtggctccagtctttcttcagtgtgtgactttgggcaagctgcttctcatttatttcacctggaaaattgctataataatagtacctgccatgatacggttttcgttagggcaaaatcttagcctatgaaaatcctcgaacccaatgcttggcaactcataatcactcattaaatgctggctacaagtattatcctcatcacctattcgtgttaatggtcttcaatactattttatacttcaatactattttagtggaaagaggacagttacttcttagaatctaactaaagaccattattgctttgggtaaaaaaagaccatgagtctctttttaggttgtgttgcatagtttatttatttttgtctctcttctcttaccctttttcctacagatggatgatgtaatcgatgacatcattagcctagaatcaagttataatgaggaaatcttgggcttgatggatcctgctttgcaaatggcaaatacggtattgataacctttttttaagtagaaaatcttgaggtgtttccagggttcttttcttttttcttaaacttttattttatctttgtaactggttcactgattaaatgtattaatagtaaaatggagaattatctcaggatcacaaataagtgactttaacatcagaaattaagaagtttttatgagtttatgaataatcccatgataaaactctacattccctggagtccacgagcagttttgatagggcattagcccttccaattcccttgacatctaatgcccaacccagtacactgcagccaagggaaccattgtgaactgcactattcacagtggtgctctagttggcctgaaaaagttggttcagtttttcaagaaggttttctcatattcttaggtgatagagggacattggagttacccttctccaacagcaaaatctattccaacctcagttcataaacaagtggtcctatttgctattgtatgttacttgtttttctctgtaatttagagccttgcctatattgtttattttccttcattccttacattttagtcttatgttactgttttaccaaagtcttattgcacatcttatttagtccttgcagttattctgtgagtcaagttcggatggtatcattgccctcagttttaaactgtaactaggttagacagtcttacgcaagattacatagcttgggtgtatcagagccaggcctgcttggtaggtctttgaatgccttctccaatccttttctgtttcctctgagagcaatgctatgagactatcatattcttaataactagtgttttaaagaccaatatttattgagaggaaagggaaaaggggagttgtttaatgggtatggagcttcggatttgcaagatgaaaaattctggagatctgtttgataacaatgtgaacatacataacactactgaaccatacacttaaaattggttaagacggcaaattttatcctatgtgttttttaccataatgaaattttttaaaggtatgactaacttccagtagtaaattcccttggccaaaggacaaaataacacttacttaggtacaccagaatcctcagaaaattgagtcttatagttagcattttcttttcttttttttttaaatccatcttgatccaattcttcaagttcacttccttgaactcatgtggggtgaggacttcccttgaaacctcaagcttcttttatgatatttagagtttgtctactttctacccatttaaacccaccccctgattttggaagaaccaggtgttctactattgtgatgaaagtttccatgccatactctccgaacctcttggaatccttggttggcttctgtggaaccttcctgcttacaagttgttgcatcctatgaggccaaactacacttatctagcactcagaatcctaggacaaacatgagtaaaacacttgggggagcatgccctggggaatttataaatatacccaaagacatgggtatatttacatttcactgctctagcagcattaattagcaatggcccagtcatctcaaaagaactttgctgtgagagtggtcattttgctagtggtgtcaaatgggtccctgggcacactcaagtgaactgtagaattgacatgattctgtaaaatcattgactttttttgtaatggcaaagacctttgatatcatttggtctaacctagtactcaatgcattagcctcctctttttttttttttttttttttgatacagggtttcattttgttgcccaggctgatcttgagctcctgggctcaagtgatcttcctccctcaagtagctgggattataggtgtgtgccactacacctggcctgaccttctcttgcatctcgttagtattctccacaaaaaaatcaaggcatccagcttcttggaagcctccaaaaaaggatctgtactagctcactagggaaatagcaaagcacaatggttagaatttagaggtttctgaccagatctggggtcaaaccctgaatcttccatttcctctgtgaccttgcatgttatttagcttcctgaaaccctacatttccccatctgtaaaatggggctgttatatatacctatattatgtggtcaactcacttggtaaagcatctgtagtatttagcattggaaacataagttgtattcaataatgttatctaaattattaagtataacttattaattataatatcaaataatattgatagtatttgtttattcagctgatcttcactgagcccctataatgtatcaagctctatgttagctatctgtgagacatatctatctcacaatatccctcacagtaaataactctgtaaattgcagcatgggtcccagtttgcttcatggagaacttttccacataccaccccttctgaagacagttgtcatgaccccatatatgcttctgtcctttagaatgaatacttggctgggtccatggttcacgcctgtaatcctagtactttgggaggctgaggcaggaggatcacttgagaccaggagttggagatcagcctaggcaacttagagagaatccgtctctgtaaaaatgtaaaaaattagctgggtggggtagtagtacatacctatagtcctagctactcaggaggctgagatgggaggatcacttgagaccaagagttcaaggatgcaatgaatcatgatcgtgccactgtcctttagcctgggcaacagagcaagaccctgtttttagaaaacacatttaaaaataaaaaagtagaatgaatcctcatacctcttcattccatctacattagcattgaggccttgttccttcattatctcgttgttccgaaagtatattaaagattaatttagcatttatggatatgcctaataggtggccagcaccaggcaaggtgctgtggatgcgaaggtgactaaggtgtgcttcctgttctcacgggggttaccagtctagaagggggagactcttttagcccttgaggggagaaggacaattcaggagcagagaggccatctcaagggaatttccagataagaaagatcctctgggcagagttgaattaactcccagacaggagaggagtcccctgcagccacccttagaagtcactgactttatcccggcatccacttctcttctttatccccatactggaaaggctaaatgtggctccattagagtctttcaacaaatctatttcagcattttgccattaggggaaagacaatgtaacttcaacattaggagcacagactctgaaccagacatctgaatacatactcttgacggagtgattcaacctctctgcttgtgtttccttgtctgtaaaatggggatcataatagcatctactgcaatagaattaatgggagaattataagaggtagcccacaaaaagcatttagaacagttgggccctgataagctctcactaaaagtaagttactagctcttattcttgatgaacttgggttttagttgtcaaaattaagtaacaaagctactgcaacctattaacattttaattttttcccacagtaaagtttaatgttcttcgtgttaggcatttttttcttttatttgattatttgaaatgctttatttcaagttaactacttaggaaaaaataaagtggaaggaacacttagagaggaaactgtcctaagggaattgaagtctagaaataactattctgagagcacaagggccctcttgtactatcacaaacaaagaataaaagtcccagtttacttgtgttaacagtgctcaattgatattcagaaaaggggaccatccagagagaaaaaataataacgttttacaattatcatttacttggaaaaatattcattttggtggagcacaacattgaagaactcaattcagaccagtatgggggcatagacccaggcgcatcttccttcaatttgtttgtccggattagactgtggctttcatctgtccatggtgcagtttgtgctctggaagtgaaatcttgtcatttaggtaaatggcctggataaaaatcccacaaagatgtgaaatatacatgttaatagaagaagtctcttcctttttcttagctctaaaggtgttattttgacctaattatgatgttaactgtatttatcgggaaagttttctaatgcagaagaaccaactacagaatcctttctttaaaatgcatggctaggagacacattttaaattatttccatcaaccttccttttagtagcttcagcaaataagagcggttgatagaaagaacatacaccaccatttaggacacagtttctcaaatgtggaactgttgacatttgggatggataagtctttgtggtgggagactgtcctgtgcattttaggatgcttaacagcatccctggccttcacccactggatgccagcagcaaatcccctgcaggtgcatcaactgaaaatacctccagatattgatccggggaaacaaaatcagctctagtgtggaatgcctgacttggaataatgactggtcacctcagccttgcagattccctgatttctgttcctagatttgcattgcagtctggtaaaaaattgtctaatcgttgacaatgtacttagtaattaacatagcaagtggttttgttgatcaagtgaaaattagctcacctgtcaaaactgtaaagtgggaatccagtactccctagaaaattagaatactgtattgttaatcatagcagttaccacttattgatcactgaagtagcaggcactgtttcacctactttatctctattaaatcttataagacccctgtgagaagaatgttgtcacttttcaattggagacactaagcctcagagaacttgcttaatatcacatagcaagttcgtaaagaggcaggattttaatccggatctctgactcctaagcacaggctataaagttctgcaccattaatcggtaaattggagtatccacattcggctagtaagcggcagggtttttatttcctcaggtctaattggagatgaattgaaagtttgcagtttctaactggttaatatcagcatgttgatactctccccacccccagttctgctgttaacatgggacgtgagcctccgaccaaaaacctccattaggcaatggcaaaaatcttggcttttctttctgtaaaaagcagtaagatgccatacacaaagtgccattttaattctgtgcttggcccaaagtaggcacccaaaaaatgagatgacccccagcaaaatattctgccatgctttctgcttcccactcctaatcagcaagtatgggaaaagcagccgaagcaggaaatctttcagagaagtagatagagggctataagctttttcaactggaagtaatgatgtctgatctcagtagagtgcccaatgaggcatcttgctatagggattttaattcatttccctttttgatgtgcactgtcgtcaatccatgctaatcacagcagtactttctgtagtttttcatgcatctcaatccatttctcactaggtatcccccacgttgctctttgtctcccccaccctgtccatctcgctgtctatggcagaaagcattctctctctcagtcatgtacatatctcttctttagaatatagttagaaaatatgttcttgtccagaagaagcttagaattagatatctgttcaacataggtctatcaatgacttggagatgtgtatcagttgctattatttatccctaacaaatcatcataataacacagtgagttttgcatacaatttgcctatgaaaaccatatgtgtgatttacctttctagagcaagtggaataatttttcttttagcttattgctttgaattttcaagtcacattcttggtttgttaaaacctcaacgttttcccaaaatccaaaattctcaaaagataggggaataaagctttggaatccaaggagttaccagacatcatggcagctgtataagtttagtctttctggtactttacagggctgttttgaaacatgtgagtgcctttcactttgcgttaaattggacaagaataaaactaaacacacacagagcaaggttgaccctgagaaggtaacctatttcaactaaaaccacttagtgaaatgacagctaataatcaaagtcactttttatcaattccttagttagagggccttgaaataccatacaagggcattttaaatgaccacgatgtctatttttgtgcctgtgtatgggggtatgtgtattaggttttatgcatatactataaacgctgctttcaaaaaggagcaaaagagggagttgtattctgctggtctgtctgtcctccctgcctaccccaattctgttcgagccagtgtctgattcacccatcaagaagtatcttattccatgtccattgcctcccacccaaatctctttagctaggggtttaattcatagagtatatgtttagaggctatcacagaaatagatgcaatggttatcaatgaggggaagcacattcgacttgtattttgtggtatattttcatctgtatgttagtggtcattggagaggatgcaaggtactctgttgaatacagtttttactagatacttctcagtcactaaacactttaatcacacctaaatgctttctgaatgtacttttctcagatgtagaatacaattccatgtgtaatcaagaaatgggagggctaaacgacttaaagtcttacccagtaatcatggttatagaaattgtttgaatcaatctagtaatggtacgtgtctgcagtggaaggagtgaggtcagtcaacgatttctccatagttactatttcaaactgtatttcagggcatgggaagggagatcaacttgggccttttctacaaaaacaggcctataaactgctgcaaccagctagttaccaagaaatgcacatacacaaccaaaggaggactcgctgctttaaaacagcccattcagaactagaggaaaaactctgacgctagcttggggaaggctaaatatttcttttactttttttttttattattattctcttgaaagtgtaaatttttgctctcttttaaagtctgtgggctccctcttgtggctttgtggaaaatttcaatttcaaggaaacgctttttctctctagcaataaggaaatcatttccaattaaaaaaaaaaaaactttcattgcttttccttgtaaaagaaaaagtgagaagaagaggtggatacgagaaggaaggaacaaaattaactttaatggaaagtcctatttggtgaaaaggtcattttatatacaatcctgttttacaataatagccaacatttcctgaacacccactgtttgctactagttgtactagataatgcattcaccacattattcattgcctccatgctcaaaataaactgactggctagttagagtagtcattttatgggtgtgagactgtactttcctgcctcaaagggaactggttgaggagatcctgtacctctcttttaatacctgtgaatgaaaaagtaaacatctcatattttcctattttaaaaatgattttttgtatcaaataatttttcttaaataaatcctagagtaggatataggttttatctgaaaaaacatgggaattgttcaacagttaatttctgttactgtttgtctctctctagttgcctgtctcgggaaacttgattgatctttatggaaaccaaggtctgcccccaccaggcctcaccatcagcaactcctgtccagccaaccttcccaacataaaaagggagctcacaggtaaacacctagtaaatgtgcctcttactgcagatttctgtccatttcctgataagacaaagttattgatatagtgatgtgcaaactatatccaactcatggacgtaacttttataggtctctgcagtggttaaaacattatgcaatattttaagacggagaatttatacttgaaaattctgttttttttcaaggagatccttgaaaatctcctgagatactgggaatcggggccaccattactgcatgtcaccaatcactgtgtgtgtggtgaaggtcccctttgtgttggggatagtaggcaactctttcagctgtaactgtctccaccctacctgatatgtatgtttctaacaagcccctagaggcatttgcatttgagaacccagatctgaattttcctttgacacacattcaagcccacaattgggatagcataagaatatatttctcacatcttcagatgcctcctgttgtcttttgctgtattgtgtgcaaaagatttattacacagaggggaaaaaattataaaatggagcaatggatattatttgttcttgaggcaagtgtgaaattacttatttctctactttgcttaatgctttagggaaggcatttatttggtcattaaaacatggcggaaactatattagaactggcattctaccatggtgaattttatggcccttaccacacccctctttttattatttgatccttgcatcctgcaggattggatgaacagactgagaatatggaatatggatttggtacagagaattcctgttccagtcaaggatgtcttaaaaaaattttttttagaaaataagcaggagaaagatgttttttaaaaaccatggatttgagtgaaaagagtaattaataagtaaaaaccatccaaaaccaaaacacaagtagctaccctaccaaaaaggaaaattactgcaagacaacaacaacaacaaaagcaagaatcgtcgggcaggcacagtagctcacgcctgtaatctcagcactttgggaagctgaggcaggcagattgcttgagctcaggagttccaggctgcaatgagctgtgatcacaccactgcactccagcctgggcaagaggaatgagtcctgtctcaaaacaaagcaaaacaaaacaaaacaacaacaacaacaacaacttaagaatcattgaagtggagggtatgtaagtcatgcttctgtgtgaggaaaaaaaaactagaaaatgatttgaactgaccatcacaactgaaagaattcaacttctgagttatatatatannnnnnnnnnnnnnnnnnnnaacttctgagttatatatatatatatatatatatatatgcacacacatacacacacacacatagatatgcatatatatgcatatatacatggatgtatgcatatagatatgcatatatacatggatgtatgcatatagatatgcatatatacatatataacacccatataataaatatatatggtgtgtatatatatatatatatatatgcttcagtggctataagttatgctaaaaagatttctattttgagataaaattctaaattatggtagtgtaatgcttcagctatcacttctgaaaaggaaataacagagctttctggatccccagattggtcaagtaacatgttttgttttgtttttaattctgttttgttttgttttgttctctgtaaggcaaaaagtaatctcttatcccagagatgtcacaagagttgctatgcaaatagagctttccaattgcagttgccaccaaatgcctctattcctattttgtttttatagactcaagctagtaaatagtggttcctaagttattagatgatttcattacagcaggttttaacagaatctggcaccaacttctgaaaaaatgagttcattctatgaagtagtgaactagttagaagagacagagatccaatttggcagcttttttttttttttttttttttgagacagggtctctctgtgtctcctgagctggtgtgcagtggtgtgatcacggctcactacaacctcgacctcctgggctcaagtgatcctcccacctcagcctcccgtagctgggactgcaagcatgcaccaccatgctggacttatttttttttattttttgtaaagaccaaggctgatcttgaactcctgggctcaagtgatctttccacttccacttcccaaagtgctggaattacaggtgcaagcaaccatgctgggccactactcagtttttatatcagcacgttacacaggcatcaaaaaaggattgaaagcttctatggcctgaaaagaaaatatatcagacccctgataatagagtatcaacagcaaattgacatagttttctaattatcgatttctttcttgctagtatctgtatatgtttacagtgtgctatatataatttttaccagggtttttttttaccattttgtggaagcccagtttttacatattgtatatatgatatatatattgcttttgaaaacatgcaagctttttaaaaagatatcatttttaaaaaaacgtatttttacttagagtcaagtcaaataagcttctgtatgtttgggaaatgagatattttgtagtttacattttgtgcaacttcaaacagttccaacttctaatgacttcattcacgtgcacagcgtgtatttttcccacagagtctgaagcaagagcactggccaaagagaggcagaaaaaggacaatcacaacctgagtaagttggttttatttatgttcatgacatttgatattaatgttccccatatatcaaaaatgtttccagaaattctgtagaggagagttgattcctacagctgttaaaattctctcttatggaagaaaattgtatttgacagaaaccaaggtatatattttccccatattttatctcagatcaaattgaattttgtatatatacttattttcagtttctgaagagtttttatttttcttgtttctagtagtggttttctctctctctctctctctttttggtaagagggagaattgatccccaactacccaattataagtgttgctcacactggaacttattaacaaaaggggattagggaagcaccttctccaatgagatttgaaagaaaaagaaagaaagaaacagatctgaaggggagtaaatggatgaggcagcctcctaaatttctgacatgattcgtgacttaaaaaaaatagccctaaagcatttaaaatattttttacgtgtttaatttactcttgatcaaatcttcaagttgtctcctacgaatactttaattttggtttaatataaacatgtaagacaagttgcacagatttttttaaaaagggattgggcttggaggtaggaaattgtgtgtgaatttctcatctcatggcctcatgtcctctgtttcttaaattgatttttaagaatgtgagtcatatataaacactttctccttataaaaatgatagaataaggccagagttcccctttagtccccaggaatatgcgtgttggtttcaatttggcattgctcttcctgacctttttctgtgtattaagaatatagacacatgcacacagaaaataaatcatatggatttctatatgttttaacacaaacggtatcatattgtccattttatgttgatttttttctactaagcagcatgttttgaagaccttttgctgttagaaatctagatctatctactttttgaaaacaaattgcatagtattttatagtgtgactgtatgatatttagtaacttcccaactgctgtgtgtttatgttgtttctagttttttcctatcataagcaatgccacagttaacatttttatatgtgtctctttgtgtacaagaaagtttgtttctctaggttagaaaccgaactgagaggcacaacttctgggtcctgtgggtgctggtttttactttaaaagctacacccctccccagttctcatgtcaagtgtaagaagctctccttatcttttaaccaagagataaactattatctccaaggcctcctccagcttctaagtaattttaccctaagatatttcttcttttaaaacaccttagaaacaagataattaggcattatccaaaactacttaagtgagatgtggaaaactgagttggatcttgtcaaaaacaatagatacctgtaattaggcacctgaactctcaaggtcaaggttgtcagtaaagtgcaaacatgatcagctcaaactctgaaggctatgaagcaatctaaaagtctcagccaaccattgggaattaatactcaaggttagattgccccttggtcaagctgttcctcttctaggaatttattttgtaagaatattgccaaaatgtacaaaaggatacattcatttattcactcattcaatcagccattactgtatgtatgtgtgtatgtgtgtatatatatatatgtatgtatatgtatatatatatatgtgtgtatatatatatgtatgtatatatatatatatatatagagagagagagagacagagacagagacagagacagagaaagaaagagagagagagcgcccctgttttgtgtgaggcacttttctacaatgtgaaccagaaaatgagtttcccatcctgggaagcttgcctttgagttaggggtcatctaccatgtattgctgagtaagatgagcaagggtcagaataatatgtataatatcccattgtgtaaaaatagcacactggggagagacgtgcttgtctctgtgtttatatgaatgtatatgtgcttgggagacaatctagacatcacccttatcagtgacaatttgcccaggcatatagatgttggatagtataaagacttggcttttactttttctttaatacacctttgtattttttgaaattttttactagcttatatcttctttctaataaatgattggaaagggaagtcatggaactaaaaataaaatgtagtacacctaaatattgacagtgaaaggtgtcagctatatgctggtgagtgaaaaaaagatgcagagtcctttttagtatgatcccactttaaatgttttgtttcttatttaacacatatttgttgagagcgtactatgtgccagatgcacaaggttacttggaatgcaacagtgaataaacataacaaatagatcaatgggatacatgaatatgggatggcagaaagttccacgtggagtcaaagggcaggcaagggagtatagtgtcagcatggacatgggaggtagtgaatcagtttcaaagagggtgaccagaaagtctcttaggtaaatctgagtctacctgagggaggtgagtgcagtgctgttcacatatctggaggtacagtgttccaggcaggtggaacagccttatgaagtcctccaatggggcgtgtctggcttgcttgaggaatagcaaggagccagaggggctagagtaattttatgattattatgtgcttggaaaaaaaataagaagaaagtatcatacttcagagttttggggaaggttagctagtggatcaaggaccccacaattccttcttcaaaaccattgaccatcatttagggtttctattttatacaagcctaatggtaggacttcgtattatataaaacggatttcatcattggaataatccctcagccaaaacaaactgcaatttatattgggaaagcagggaatcacattatttatctaggtgtacagactattagtggaacaaaaagaagcatatattctggtatttagagtaactattaacaactttaatccattttgttagactttaaattatttggaatttatttgtttgactacattaattagagacatttatcatgtcatatgccttattatgtcatcctcccctaagaacatgatagttgaccttacactgagatttataaaataggaatgctgtgaagattcatggtacagctaaaaatgctagacttcagttctagggctgtgctatctagtacagtagccattcaccactggtgcctactcagacttgaaatatggctggtccaaattgtgacgtaaaactgaaagtgtaaaatgcgccctggattccaaaaacttagagtgaagaaaagaatgttaagtacttaatttgtaaatgtttacgttgattgcctgttaaaataataatattttggatataatggatttaagaaaatgttaatttcatgtctttctttttactttttaaatagtactactagaaaatttaaacttatatgtaaattatattatatttctgttgggtagcactaggctagggcatgggttttttgtgtggcccatgagttaagaatgttttttacatttttaaatggttaaaaaaggccggacgcagtggctcacacctgtaatcccagcactttgggaggctgaggcggatagatcacttgaggtcaggagctcgagaccaacctggccaacacagtgaaacccccttctctactaaaagtacaaaaattagccaggtgtggtggcatgtgcctgtagtcccagctacttgggaggctgaggcacaagaatctcatgacccaggagatggaggtcgcagtgagctgagatcctgccaccgcactccagcctgggtgacagagcaagactccgtctcaataaataaataaatgctaaaaaaaaaattgtgacatgaaaagtatatacaacgcaaatttcagcatgacaagtaaattctaatgcttttcattgatttgccttgcaaaaaattgtactcgtatgttatattttgaattttgtcagtaaaaaatgtgtggaaatttgttttccctccgcttaagtaaatatctgcataatatcctcaattttgctacttatcccacaaagccagaagtactaacttcctggctctttgcagaaagtttgctgacttctgctctaaggggttaggttagaatttgggctttcaccaggtattgttggatgtcctcgccaagtccctaataacagtatctccaaggcaatttcattatttgtaactaaggatagtaactgatttcagggttgttataagaacaaatgagaaatcgtctgtatctaagggctttggaaatggtaaagaaatgtagctcatttttaactgcaataccaagaacatagtaaaaatagggaaaaagtaggttcaggtttccgttgtcatgacctggagaagttaatatgcacatgcctttaatgagatgtgctaaatgcatacatggcactgttactaatagcctttcctgtgctcttttcttgaagttgaacgaagaagaagatttaacataaatgaccgcattaaagaactaggtactttgattcccaagtcaaatgatccgtgagtacaatcgcgtgttaatctgcatcatatatttttcgtacctgaatgttttttcatacgttgtaaaaaatgcagttgtaaaaactaaagtaaagaagtctcccctctccctttggttctattcctaaattcttcttacacctttcttttggttagtctcatcaagctaaaatttcaagacaaaagcattgaattgtgcaaaaggattgttggacactagatgttttggttgtgaggaggtggctttctgaaacctaagaattctttgcaaacaaatactgagcttaaaaaaaatttcctttaatggttcatgcagaacagaactttcaatagttgttaaagctagatttgttgactgtttgctctttgacttgtacagtacctctaaataggcactgatgaacagacattagagacttaaagtttaatgatactccacagacaaaaagggtcaattatttttatgaaaacttgcctactctttgtatgttttaccattgtaggggaaaaaaagtagtgttttaatcctcttattaagtacaggtcagctaatttagatttcagcttttggtctctctttacccaccctgtccccttcagagataacagctgtaaagatgattttctcaagtctttcctaccagcctatagttacctgcaacatcagcagataggacaacaaacacacagtttttatccattagaaattggcccatttgaagcaaggggctagaaaatgtatacattttaatggcccccacaggcattctgtgaaattagcctttgaatatgaccttttagctacctaataaaatgtaaagatgaaatcaagtattattcatgccaggcttattaaatttgctgttcacgttactgttagaggatttgtaacaaaataaaataaaaccattacctattgtgaggtggttttgatgaatgtacaagcacaattccatcttcaatgttttgctttcccaggtttcaaggaaaggcattttcaaacccgaaacatttcagattctcagttctgcagcacaaatttatcctactaaagggctgtgaccttcatttcctatagtcagtcttgcatgatagttgaaattgaattcccattttcctcttctttatcagctttcactttttagcatattcttttaaactgtagcatgtgaatctctttagcaacatattatgaaattatggggctgcagtgaaagcctctatttgcatatcttctttccccgttgtattagaatacttgcgggtttataatctgaactgataatgatctttaattgtaggcattgttttaagacaaaacagactataatctatatggtggtttcccacaccaggtttctagaatgtgccttggggctgctatagagacacagtcttacagactggggtctcagcccggtaccttttctcccaccagagcaagtctgcatttgttgattttatataatggagatctatattcactattctgtgaaaaaagagtccctcttattaccaaacaaaaaaaaagtttgaaaaccctttcttaaactcagaagcataattgattgattggatctcacaaggaagcaaaacccaagataattggttgaaacaatcacttcttttaaactgagtgacccttcaaatatcccaattctgatttctcttcttgctggcctatgtgaagcatcatttattttaactacatttctctctggctgctaaagttacttctcttactttgatcttagctctgaatattaagtctctgcgctcactgtgggtatctcaggacattcccctgggttgccatctttggtgttcagaccccagggatcaactccagggaattctctgggggctggaactgtccctcttatgggagaacttctgtgttgttcttcatgtaacccagatgaggatcaattacttggtgacttgtttaatgaccctccattcaccggttccacctgatacttgtagatgaggaaatggacaaagagaggctagatagcctgcccatgataatccttgattaaaaaaaaaaaaaatagaaggatgctgagtttatgccataaacaatttagtagtgagatctcacagatctgttttaccatcgtttattctcactgagttaacttttgtagttttagaaacctataactctttaacatagtgtttaaggaaactgactttgtaatcaacagacctaactttaagtcctgactctgccatatagtactgtgtggcctaggacaagttgaattgtgtctgtttcaacatgtgcacagtctctctcttacaaggtgcttgtctgggttaagtaagacaatgtgtacaaactgggtgggcaacactaggcacgtggcaaacactcgtgaatggcagctataattaatgtatgattattttatttttaaaattgaatgcttttaaaaatgatacaatggactttggggacttgcggggaagggagggagggggtgggatgggggtgagggataaaagcctacacgttgggtacagtgtacacggcttgggtggtgggtgtaccaaaatcgcaaaaatcaccactaaagaacttatccatgtaaccaagcaccacctgttcccccaaaactattgaaataaaaaaaaattttaaaaagttcaaaaagaaatggagtgctttgaatattgaattttcattgagcctcaaatcctaaaaatatctgttttcctccattttcatcgcagagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggtacgcagcctgagttgtgtaaagtttactgctttttaccgacttcaagacagtagaaacagggatataatgagccataggggagttgacttacgtgatcctaacacagtcaatccttattatttgtggattctgtgtgtgtgaatttgcctacttgtaaccccaaagtcagtatctgtggcacttccacagtcattcttggacatgtgcagagtggcacgtttgagctgcccatggcacgcatttccaggtgaggtcgaatgaccctgcctgaggttgactgtctgctgtcttgtttcagctctcatcctctaaacaagtgctcctttcgtggtctgttgagtactttctacatttttgtggtttctgttggtgatttcgctgtttaaaatgacccccaagcataatgctaaagcactgtctagagttcctgagggcaagaaggccgtgatgtgcttacagagaaaatacatgtgttggataagcttcgttcaggcatgagctacagtgctattggctgtgagtttaatattcatgagtcaacaacatatattacataaggtgaccttcaacagaaacatacataaaacaagattaagtgttgtgactagggtctcacaggaacctaacttgtaattcccctgggaacagtgcttcagtgttcaccaattcagtgttcacagtgactttgtagaacataaaaaaaataagtactgactataccacgttaaacaagaagatgccttagtatttgtagggtccgggaagcagttgatggtcaaaatctgtgtttacagggaacttgggaacacccagaggatcttatattaaggacataattcctggagatagttataaatagtggaattatagcatatatatctttaacttaaactatacaccattagaagaagacatactaattttattaatatgtgccatttgtgcgtcatcctactcagtgggtatatgcaccagtgtaagccggagatggggaattcctctttggtatcaactcctggaacttctctcaggggcttggcgtctcttgttgagtgaaagggcactacttcctctgaaatgatcctcaaaaacagactccctgttatggaccaaagggggtttgtgagggtaattttaatttgctgactttgaacacaacctatctgtaagagtcagtgacaccatatcttcttcttgagtaggctgacccaccttttactagattttgccataaagcaagggttgtctttcaacttttccagtgcaactattcatggagttattttacgaaacagcaatgagaagtatgacaccctagcgaccattgtgtttcacctagtggtgctcctcccggacgttgaacttttcaaacagagcaattcacttataataatggtctccagtcttctgaatgcttatattttgaaatgccacatctctcattcactgcagtgattcctcagctgtggggtggggaggtgggaagccacttccctgttggggtgcattttagattctgggtagtgaagtagaggtagtgtgtaatttgaaagccctcctttcccctcccctcctctactttggcttttgttgttggttttatgttctgtctcttcaataagtagctataggtatttaatctctcaaacatagtctacctatttataaaagcagcttgtgggccgggcacgtggctcacgcctgtaatcccagcactttgggaggccaaggcgggtggatcacaagatcaggagttcaagaccagcctggccaagatgttgaagccccatctctactaaaaatagaaaaattagctgggcatggtggcgggcgcctgtaatcccagctactcgtgaggctgaggcagagaatcacttgaacccgggaggcagaggttgcagtgagccaagatcgcgccactgcattccagcctaggcgacagagtgagactccatctcaaaaaaaaacaaaaaaataaaaataaaaataaaaccagcttgtggccgggtgcggtggttcacgcctctaatcccagcactttgagaggccaaggtgggtggatcacgagttcaggagttcgagaccagtctggccaacatggtgaaaccctgtctttaccaaaaatacaaaaaaaaaaaaagaaaagaaaagaaaagaaaaattagctgggcatggtggtggatgcctataatcccagctactcatgaggctgaggcaggagaacccgggaggcagaggttgcggtgagctgagattgtgccattgcactccagcctaggctatagagcaagactccgtctcaaaaaacaaacaaaaaaaagcagcttgtactaatgtgttgtttccttctacaagtattaaaatgtaataactattttgaaagagaagctaggttttgttttattttagggttccaaacatgtatattcatatgaaatacgaatattgtgaaatatgtgcattggaaattccatggtgacgatatcttggttttcttccagtgacggtgtgaggcagcctttagaacttttgcatatcacagaaaacattattaattaggaaagctctgtgatgcaattaagccagagttctctagatgagatttatcaccttatttagaaatctgagtaatgctttaatcgctgataaatatttttaattagacaacaaaggattagagtgagatgtttgcctctcttaatccaactttattattctttttctgaaaagacaatctgcctgtgtggaggtactgttcttattagcatgttggtgtagatttacaagagtccatgttttcagtatgggcctaagggctttctttcattttcactctaagtgatgcatgcaaaagttttcacagaagaaagagcatgaatcctttatgtcagtggaactgccattttattaaatagcccagggctttcaaatggtgcctgaagaaacttgtgtttctggagattatgtaaaggaacttgaaggtacttgtgtgacatgtcaagctcctggcttttactcatattgtatccaaagaaggattttgcagacccaaaaaccttgaatttagactgaaacgtggctttgcaggcacatatgtttctcagcttgtgggcagaggttgagaggccatgtcatatggagagtccttcccctctctgataaggaaaggtgacttgcttcaaatttatattctcttgctatatattattgtttcacaaccgtggaagggatagcattggaatggagaagcagaatgcttatcaggaatcaattaaagtctgtgtggttcattttaggagtgcccagggatacactcagaaaggaaaaagggaaagagcttgcttggaaggcattttgcaatgagttacagggggaatcaagggtatttaggaagtgtattacccagctagtgctgctgtagtgaaatgccactgactgggtggtaaacaagagttattttctcataattctggaggctagttgttgtccaagatcaagttgtcagcagggttggtcccttctgaggcctctctccttggcttgtagatgcctgtcttctccctgtgtgttcacatggtcttttttcctgtgtgtgtctgtcccaatctcctcttcttacaaggacaccagtcctattgggtttaggcccactagtaaaatctctttttaaattaattgcctctttaaaggccctatctccaaatacagtcacattccaaggtactaaggttaggacttcaacattcaaatgttttccaggacacaatttagccaataataggaatgtatgtgaggaaggaaaggaaaaaaattgttcatcttatagatgagaacgtacttgttgagttaaaaaaatacttcccctttgccatggtgagatgggctaaatgatgcttctaaaactttagttactggcatagaactttcacagcttttgctatcactacccaaattttttacttcatggcactcttagtgttttagcaatctttttaccatccccctagaccaaaagaaatacctactctttttgttaggtccgaacaacttattaagtatttaggttctaacaacttggtagccatttgaaaaaataaaacatataaattgaaaggaaatagcatttttattttgttattaaataaccatattacttactaactggatgtgtgtgtctgttgggcactgcacgacttctaaagtcttggaatcagattggacaccatcaccccatcgcccttgtttcccaggccacaatgatgttcatgtggcacttgttttccttcaatcacagcaactgccaaaagctcaactttgcaatgatatcatgtggttgaaaagtatatagcacagtctgatgctagaagagaactatcttgagtttagtagttctcaggtagtattgccattgcccttgaaatgttaggctatctccagtgctctgtgagttcattgcagcacacatggggacctcagtgcaaagctgaaggaccatgaaagctgaaggaccatgaactctttactgaatatgtttcttttttcttttcttttttttttttttttttttttttttgagatggtctttcactcttctagcccaggctggagcgcaatggcgcaatctcggctcactgcaacctccacctcccaggttcaaacgattctcctgcctcagcctcccaagtagctgggattacaggcatgtgccaccacacctggctaatttttgtatttttagtggagacggggtttcaaccatgttgaccaggctgatctcgaactcctgacctcaggtgatccgcccccctcggcctcccaaataatatttttcttttatcagctcgcatttaaaactttatttttgtattttttaacttatcctcagtgtgaacattaatatctgtgtctaatgacgcgcatctaccattatagtatcatatagagtggtttcacaggcttaaaagtcctctgtgctctgcctatttcagtgttttatctttactcttattataggaacttgaaatgcaggctcgagctcatggactttcccttattccatccacgggtctctgctctccagatttggtgaatcggatcatcaagcaagaacccgctcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacatagtggtggcctattgtgttaatgccaattttgaatgctatctgccatatcaaaaaatggtagtgcacattttcttctgatttaatgaataacaaattgcatgaaaatttagaaaatgccagtaagtactttttttgtttaaaatgccactctaagatgttactttttggttttaaacatttttgattactttttgacttacactcagatgaggtgtaattatgcaccttttttatccccctctgaatttggggagattttaaactcccaaatgccaagacttcattttagatataggagttttatttaaaatgtttcattgagaggtggctttaaaaaagagaaattgtcagagaaacccttgcatatttacagaaaagatattgggtttttaaaatacaaatttacaataatgaaagcttaatatacccaggctgccagctcctggttgccttttttttttaatacactacttaagaatcatttgataaatgttggatttgaattgggaagtgtcagacaaaacatgtctttattccctagctagaccttaaacttctgcccttttaaaaaatatattctggcttaacctctggagaaaatgagcaagaaacttcctgtaatgcttctgatctgactgtcagctttttcctacttttaattttcttcttaaattgtaatatacaataatcaaggcctttcttttttagacctatttgaattatttatattttccctagaagtataactgtaggatcccttaaaaacatgtaaaagtagaaagatttccttttggaacaagagagaatattctgggcaaaatcaaaagcaagtaagttgaaaattggggcttttcatctccgggggatctgcagcaataccttcacccacatttctgtcctgatatttaccagtaaatagtcatttcacagcccataagaatccttcatctttagcttcccccacttacacacagacacacacacacacacacacacacacacacacacaattaacgtgttatagtggtgttacctgaagattagacatttgcctacagtgtgtatgacttcatttgatatccacagagttacatttcttaaaattttattaagccaattcactttcaaataaattatatccgttcaatcaccacacatgacctctcagttaatcttcctgggtttgaatcttatctctgcccatgtctagctctatgattttgcgcaagttatttggcctccctgtgcctcaaaagtagctaccacatagtggtcttgtgaagaccattcgagttaataatactagaatttgtgcttgacagcacatagtaaatgcttagtaaatgatagcttttcttataataatcaccttcattactaaaatggaaaatactttctggaccaactaaaatcatcatatgtattagcagtgacatgcacaccacatttggcaaagcactgaattacaacatagattgaagacatgtgtaaactggccaggggacagaagccacaggctatttaggagaaaggaaccttgctgtttgtaagacctagggtaggaatattttagagaattagtaataaactcaatgtatcacattaaaatatcttcagcacaaatgacctaaaatttaaattgttttaaacctgtacattctgcatgtatgcttctgccatgagaataattatattattttcataaaatatgccttagtgaagctgaaatctttattatattctttagaaaattaaactgtttaatcctttgcaatatacactgatattatacagctaagagtggtgtcttgactatatcctgtcttcagtttcctatcaatattgaaatgtttctcaggattttattttcaattgtacttacatttgatgacttctttggaaaaccatctgagaagttaatcttcataatccagccaacataaatgaactcttagaattactctgtttttatttttttgtgtatgccaagacttaatgcatagccaagtagcatgaggaaagctcctttaagaggagcgttgtaaagttagattttcattatatttagagagaggttgtgatgatctcttaattctttgctgccacatctgaggctcaatagcagtggctttatgtctgtacccataataacatgaatccataatacacgtctgaacagagtgtaagtgaagaagcttttattatcccagttttcccaagaggcatatatcctcctcccctcaaaaaagtgtagagtaaatctgccatattaaaattgtcaaggtcctgtatatacataaaatgtagacatggttaattgtatttgtgttcagtatttgtaggtcttttgagcctattacctataccagatacactggaaagtaatatgagtatacacaaaaccaaataaatttcagcaacgcatgtaaatggtaaagacagtttgcttttgaaaaatttgcattttaaatttctaattatggagtcagttgaagatatatccaaatgggtgcaattgtcactcaaaattccttacatattattcagacagcaaaatctatgtaaatagaagccacgaaactagtgtttcccaaacttcactttatggaactagttccacaagctgttgcacaagttgctttgaggaatgggggtttggaggtgggctggggtcaggaaatgctatactgtagttaattttgaggaagttagctttgggaaatgctgagctaaacaaatgtgaacaagtatttctactgcaagacttctcacattctaaattatgctaatgggattgagagttcgtaacatttcccagtctcatttggccacaggattgtgtgtgtgtgtgtgtgcgcgcacgtgtgtaagacacctgctaattgttccaaagaacacagtttgggaaattctggagattttacagaaattatttaaactcaataaattttttttttgttttcctaaggcaagtatgcttacgtttgtttatgattccataggtagaagtcattgtcattaaaaaagtattactctgaagaaacaaattagcttaggttttcatctccattgaaaatataaaattctgattaaggaaaatattggcattaagaaactgttattcctgaatttaaaaagtaacatgttttcattttcaaagaaaatattcactctggttacacacatgttcaatgtaccttttgtatgagtggtactataaaaagttctttaagttgaatgtctcccacatctttaaatatggacaacctaatgtttaggaaatatttggtttataactttaggttcagctcactggtttttgctggaaggacattaggaagaattgtatggtattcagaattgatgtagtcttgtcaatgactctttttcaatgaaggtaagttctgacagagggatcaggttgtatctccaaagttcggttgttaattggttataggccaacccacaagagctatattaattcttacatgcctgtagtatattataggacttactaagattgttttagaatttaaacactgtattatgaagcccaagggaaaatacattaacacaccttttccactccttacagatgagatcacagatttctttcattcaatgtcttttaaaaatacttttcagccctcactcttcgcctaggaataaacggtgagcagaggaatttcactccagtggaatgaaggaatttattggctcatattaccataaagtccaaatggcaaatataacttcacgtatgcctgggttcaagggctcaaacaagcattcaatctgcttgtctctaattttcttggtgccaacctcctcttggaggcaggtcttctccatgaggtcccctctggcagtttcaaagtccagtagaaagccagcacctctttcccagttgctatggtgaagtccctgtagtagttctgatcagccctacttggttatgatcaccataacccaaaaatggaacacaccagtgggccaggtctgggtcacgtgtccactctgctagattcattcagcagcacctaaaccttgtagaccaagagacaaggaggtgggactcacccagactccaaaggatactgttcccaaagcgggaagaggaatctctgtaagcaaaacaacagatactcattgcttggacttcaagaggactggacaaactctacccttgccaatcttttgccttttcagatgcacagatttgggacttttttcttccttcacccttaaccccagggtgatagaaagggagggaaggaagatattaaatccctacagctgcatctccctcttcctcattattcatggctcatttctcataaccagctctccggctctcaccccctactcaatcctctgccagacagagatcctaagacccaagttttgcaataaaatacagtcatgtgccacataatgatgttttggtcaatgatggattgcatatgtgatggtggtcacataagattacaatggagctgaaaactttctatcacctagtgacattgcagctgtcatgccatgagctcaatgcattactcacatgtttgtggtgatgttggtataaacaagcctaccgcactgtcagtcatagagaattatagcacatacaattatgaacggtaacataatacttgataataaatgactatattacggatttatgtatttgctatttatcattattgtagagagtactcctaattgttaaaatggcaggtccttcaggaagtattccagaagaaggcattgtcatcagaggagatgacagctctatgcatgttcctgcccatgaaaaccttccagaggaacaagatgtggaggtggaaaacagtgatattgatgatcctgaccctgtgaaggcctaagctaatgtctctgtttttgtccttgtttttaacaaaaaagttaaaaattgttttaaaatgaaaaatagtaaaaagcttatagaataaggatataaaaaagaaaaattattttatttacttttatttttattctctttgagacagagtctcactctatcccccaggctggagtacagtggtgcgatcttggctgactgcaacctccgcctcccgggttcaagcgattctcctgcctcagcctcctgagtagctgggactacaggtgtgtgccaccaagcctggcgaatttttgtattttttggtagagacggggttgcgccttgctggcccagctggtctcatacttctgacctcaagtaatccacccacctcggcctcccaaagtgcagggaattcaggtgtgagcctctgcgcccagccaagaaaatatttgtgcacagctgtacaatgtgtgtttcacactgtgttattacaaaacagtcaaaaagttaaaagcatcaaaaagtttataaagtaaaaaattatagtaagccaaggttaatttattactgaaaaaagaaattttgagtaaatgtaatgtaacctaagtgtacagtatttataaagtctacagtagtacagtaatgtcctaggccttcacattcatttaccactcactcattgacccacccagagtaccttctagtcctgtaagccccattcacgagccctatacaggtatcctatttttaaaatcttttatacagtacttttactgtactttttctatgtttagatacacaaatgccattatgttaaaattacctacaatattcagtattcagagggctcaccaagcactcactcctctaaatacaaatggactcttacttctgtcatttctaaagccaactttgttatcatgatgttttcagttgcccattgcagaaacgaaactccatttggaaaaaaaaaaaaaaaaggcagggaggagagaggggagtttactggttttcataacaaaactccaggggtgaaactcagaatggtgacttcaggtgctcaaatgaccacttcatgcatgcattgctccctcttcttagatgtgctctcctctgtgttggcttcatttttaggcaaactctccctgtgaggtggcaaaatggctaatggccccaaacacaaccttgcagtttatcaaccagcccggaaagagcatttctctcctcccagagtctcattggcccaaattggccagtatgtttaatcctggaccagtcattatttccaggggcatggaatacattgacaggctattcctaatcatatttttacccattgggctgggattgactcagcctttttggaggggaaggaggcaaccctaaaaactgagaagccctcatccaagttgtcctttctgactatgtccacttgcttttccaacaatcagctccttatctttcaggtttcagatgaaatttcaccttctcagagaagaggtcaatgaccaccttacataatagaaaggagactctatttgcctttccttaacctaccatcttgtttatttccttcatagccttgggttgccttttctccttctccttctccttctctttctccttctccttctcgttctccttctccttctccttctccatctccatctcctgctccttctccttctccttctctatctccttattctatcagtttgcttctccttctccttctctatctccttattctatcagtttgagctggtttctcgtccctttcatagaaagtattcatatttgtgatcagtagacaagggttggcaagttttgccacaatattgtcaataagaatacagtcttattttaaaaaaataaaataaatgaaagtactaggttaagagaatctgtttgctaggactgtggaagtatttgtttataagcagcatgttatcacatcttatttacatgagttcttgggagaataaaacttccacatgaattaacttatggatagctgaacttagcgctttaaatggccaaaattttattttcactatttttgatgataggctttctcaagtgtatgattctctacctcttgaaacagactgtaaagaatataattttacctgtgcttgatggctcagggtcatctttaagattattattactttgagctctaacgcaatggtgtccttggaggcttcagagatgtaatgaaggttttggtccctatatgaagaggccctagagagcagcactttcactccatcttctttccccccaaaccccttcagatttactgctccagctctgctgtgggcttgagagaattgctaatccagttaagtctttaatagttaacagaattgtgtcttgtataaggtaaatgtgcctcgtgtaaagatctgggcattctgctgcctgtgctgcaatgcataagctttagtgctttgattttggctatgaagaaaacttttcctcccctagttgcctgttttttccactggacttcagctaattagaagttgctggatctgtgacctagttaaataagtttttctataattagaaacacaggttggactcgttagggtcatgagatttcattttgttaagccacttgtaagccattctttcaacactttgtagaaattctgttaggttagtccaactcagatgatgacagagtcagcaaacttttctgtaaagggccaggaaataaatactttaggcttttcgagccaaaaggcaaaattaaatatattgtattggtgcttatgtaacaagagagaaaacaaatttctataaatttttcattgatgaaatgctaagtttaataataattgaatatcattcttgtaatacaactctactatgaagaaaaatggaattcttttgggggaaaaataacattttgattaattgcggttcaaagttcctgtcccctagcctcaaactgattgtaaatgcttatctgtaaaagctgctcttaactcacaggctgttcaaaaacaagtggcaggccagatttggcctgcaggctatcttttctcaacccctggactgtggcagtctaatgtcccctgataactgttttctcttcttcattttagcaatagaatgccctgaattgtaggtcagcacatagccgtatttgtgggttccatagttcccagcctctgttataagtaggtgtgaccctatcattaaatgctgcataatgggatgtgagcagtcctccatttcttcctactgtctaggaaagagtgaaagctgaaatagcttccttggaccagagataaaggtcctatgttggatatggtggagctgcttcatcttgcatctccggaatgctgtgtagaaaaaaaaagaaatggttgtcttatttaagacctgtgtgatggttaatactgagtatcaactttattggattgaaggatacgaagtatcgatcttgagtgtgtctatgagggtgtttccaaaggagattaacaattgagtcagtgggctggggaaggcagacccaccgttaatctggtgggcacaatctaatcagctgccagcacggctagaatataagcaggcagaaaaatgtgaaaaagagagaccggcctagactcccagcctacatctttctcctgtggtggatgcttcctgtccttgaacatcgaacaccaagttcttcagttttggaactcagactggctctccttgctcctcagcctgcagatggcctattatgggacctcttgattgtgtgagtgaatatatatatattccattagttcatatatatatatatatatatatatatatatatatatatttttttttttttttcctttagttctgtctctagataaccctgattaatacagatcagattttggtaccaggagtgattgtaaaggaacagaatattaaggatggggttctttagtcagttttggggtttctggagctggctgcttaatacgattagaccccaaaattctaaggactctacctctaatagtatggagaacaccactggtagtccttggcattaaccatttagagaattatgcaaaataaatgcatttgacattcccgattcatcgctagtgagaggcaaagagtttagtgactctatacataataactttgaccatatagagagaaccaaggaacataatgaagctggttggttgctcctaagttcagtgagcaaagtgatgaaagaaaatgatgaactcagggattctatgtcctggcttcagtagcagatactgagcctcaaatctgcaaagattgccctgagtgaaagtcttatcttccgtagagaaagagctgcaattgtagaaaaacagacacaagctcttatcatataagtggctgaccagcaaaaaaaggtgcatgtacagctttaccaggtgtctactgttgaagtgagagcattgattggaaaagaatgggaccctgcaacttggaatgggaatgtgtgggaggaccctgatgacgctagggacactgagtttgtaaactctgatgaacccttttggccagaagaaacagcttccccatccccagtagtggcaacattccctccccaaaccacgctgccatgaacctttctacctttgtctgaggagataaaccccgtgctgcctgaggcaagagcgatggcctcccctgaggcagttgccaggcaagataatgttgattctcctcaagagccacccccaacacccctgtttgcttttagatctgtaactagactaaagtcctggtgggcccctagaggtgaggttgagagtgtgacccatgaggaggtgtgctacacttgaaaatacctgcttgagttttctaatttatataaacagaaatctggagaacaggcatgggaatggatattaacagtgtgggataatggtggaaggaacatagagttggatcaggctgaatttattgatttgggcccactaagtagggactctgcatttaatattgcagcttggggagttaaaaaatgttctaatcatttatttgcttggttagctgaaatatgaaattagctgtgagtgaactggaaatgcctgatctcccttggtttaatgtagatgaagggatccaaaggcttagggagattggg

SEQ ID NO: 2015 - DNA, 4786 bp, Homo sapiens
agagctcggcactgccggggcgcacggctcgggggacccaggcccagctaccttccctccgcccccgggctctgttctcactttccagcagtggaaggacgggaagcgggagccatgcagtccgaatcggggatcgtgccggatttcgaagtcggggaggagtttcatgaagagcccaaaacctattacgaactcaaaagtcaaccgctgaagagcagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagcgtgtatttttcccacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgctcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacatag

SEQ ID NO: 2016 - protein, 526 aa, Homo sapiens
MQSESGIVPDFEVGEEFHEEPKTYYELKSQPLKSSSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTACIFPTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPALENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 2017 - DNA, 82660 bp, Mus musculus
  misc_feature (1)...(82660): n = A,T,C or G
aaatttgacaagatgtgattacaggtaacttattacatgctttggataaatgttaagtagtgaaggaaaacaggtacctctttctctaggactcatactgaagggaagaaacttcttcatggacagattcatctaagagcccttgggcacaggaagtgtctaaatgggattctgagaaggaatcctataatgcaaagggcaatcagggttaaataaaatcagctccaacctttatcttacagcctttgagaaatcaaagaatttcatgtccctacctctgtcaccaacttctgtggcttctgtcctgagcagggcaaatggactctgaattttgtcacagtgccttaatcactttgccatctcctgcccatggttagtcagtgctgaccatcatgtgacccagttcctgtctttggtttatttatgtcctcaaagcagttgaaaagtgttggtgtgtgtagaaaacaattaaagtttgggacaatggagagaaactcatataaaatataagtaatctaatactgaataggcattcttgttctaaaagtaatttgatttttttatgtgtgtttgttgtttgattctcaagacttagtttctcagtgtaaccttggctgttgtcctggaactcgctctgtagaccagactggccttgaactcacagagacctgcctgtctctccctccaagtgctgggaataaaggtgtgcgccaccatgactgatcatattaaaggttgttcttgctgacatcatcccatctaataaacacagaaggaagggtctgcatcaactttcaccatggcaactgcttcaggtgggaatcagcaatagttagcaaaagctatgtgttttatttatttatttatttatttatttatttatttatttatttattttgagacggggtttctctgtgtagccctggctgtcctggaactcactctgtagaccaggctggcccaaaactcagaaatctgcctgcctctgcctcccaagtgctggaattaaaggcatgcaccaccactgcctagcaagctatgtgtgaaagtataagaggtgggctatttataggttttaaaatacacaactacaaagggaagaacattcactttggtaaagctatcaaggctgtagtagataaagacagaagaactactttaggttaaagaaggacgaatgccatgaattatcctggatagggtcttagaacaacaacaacaacaaaaaaatcaaaaaacaaaaaacaaaaaatccaacccccccaaaaaaccctacaaaacaaaacaaaaactccaaccaacaaattaaccaaaaccaaaacaaaaaccaaaaaaccaaaaaaaaaaaaaaaaacaaaaaacaaaaaaaaaatcacaaaacctaaaccaaaccaaatcaaaaacactttaaaaaaatataaagaacattagagagaatgttctggtttgaatgcaatgtataaggtagataatcaacactattgtgtcagtatcaattcctgatttctgtcatcacgaggaaatgatggaagagtatgtctcagctcagagaaactactgtgtactgaagtcatttacagtggagaaggtaaaagggcaaacaaaccgcacccttaacttagtctcaaaagctttagaagaacatgggtagatgggaattctttataatattttgccattttcctttgagtctgaaacgactatgagataaagtagttccacctgtgcatgcggtgactgtgcacttctctgctcctctgcttgcccctgtcaccgtggccgagcgatggccctagagattgtcatactgctctccctgtctaaatgaccttgtgctgttgtttgagatgagccctctctcttgttaggctgctgcaatgagggcacccaggagcttccttcactgattcactcacatctaccgaaggtgtagaaagtagaatagtgcagagagaagaaagagactgctcatagggtgtgtgtgtgtgggggggaagaactagcagggaaattaaggatggaccatacggggcatctggcaagaggagaacctcccgagcgtggcatgcaaagttaagaagcagaaaagaagatccaagggggaagaaagatgtttgggaatgggactcttcctggccattttccctttcaccacactggtcacttttgtgaatgtctggtcctaattccttggccagatagcagaactagtgtggttgtcagtacagaagagtagagaacatctgggctgatatagagacactcaaagggtatttagtggggtatatgagaatcaaaatgggtaacaatcacagtaacagcagcagctgatacaggattcccatcttgtccttcggactagtccacaaccttagtggctttcattttgttcaatctacacaatgtgatcagtgttcctatttcagagtagactgagcctcaatgaggttaaggcaacggccatctgcccgctacagaaacaagcttcagactctaaactgaagcccaagggaatcccaaggaacccctttagacctagcacactccactcacgtttagctactcacttttatgaccaatcttagagatcatgtaactaagggctatgttattaatatccagcagctttgctgcacatgacctgtgctgtgtgagagtcaaaagggaaaacttggcttcagttttttattttagaatttggaggtcatttctcaaatcagtagaaactagtggtcccttctctgggcctgtgcaaagtggaagaccccttgatacctgctttttgatcttgcttatgccatcattttctggacatgtgtctcatgaagagcaaggatgtttgattatgcacgcgttgacccctgacttccttactttccctgacctctaacaaaccaccttcccccgtgcttcctgtccgtcctgcttctttttcccctgaatagtgctgagtcccacttgagggattcagtatgattgaggcttcctttctcatctccatccataactgttgtatcatttattttctcattgctaggacaaagtgcctgagaagtggaacgtagtttctttcggctcacagtccttaaagcccagcacggcaagggaggcatggcggcgggagtgtatggagcctggtcacgtgggatctgtgatcaggaatcagaaagacagatgctcctgttgctcattcaatctgggacccgaggtcatgggacagagccgctcacatgcaggatgggtcttccctcctccgttaagcctttcccggaaacatcctcacagataaacacagcagttcatctccagggtgcttctaaacccccgtcaaggttaagagtcacgacggacttctacatcagccctttctcttttgaaacactccttgcttcagtatagagccctgagggatgagcagaacaggcctgatccaataactgaagataactctttgatccttcttttgttctcatcgttctcttccctctccagcaatctatgatggcaaaatcagagtcccagaaagcatggaccttctccgttgggttgtggatctgctctccggaacgtactttgggcagagcagggcaggagaggcctggcagagaggatgaagcaggttggcccgtgacccactggagcttcatgggaaggatgaaattgtcagtgtctgatggcaagagaaaactgtggctcagaagggcactgctcacctcccctggttagagttcccctgtagccagtgtgggggaggcacctggcgaggtgtagggcacagtgggtcccatagcccctgtcctcagccctcttcagagccttgcctctcacctgtgaggtgatggagaaggagatgggagatgggtcaaagcagggattcccttgggggcctctctgacttctttcttattttaggaggagtaggcagcaagttccagaatgtctggaacatgaaaaagagacttaataaatacactttcaaacccgagactcagctcctggccaggagacatgcaaacgttttaatatccttgttctgcatttacttaaatggaaacagcccgtggtatttttagctgctgtgtaatcaacgtaagaaggaaaggggaatgtatactttttttccttctcctagttagagtaagagaatgaattgctcaattctcaacagagtccaggaagggaggaaaatcccggagtcccattgattggctcctcctctgtcatagccttgatttaaacccagggagggaagcagagggagaagatattgagggacggatcggcaacgaagtctccagtaccaggaccagctcacaggaggcagggggattggaagtggtgcccagcagcctcccaggtaagagtgccagctccttgaggctttatcatcgattgggagggggacagtcagtgtggggaagattgtagactgacgtgcattgttgcaaatctaggcaaggcaatatagattaagttcaaactatctcccagggcctgtgaatcatgtccatagctggtatcagactctgccctccccaagccaggagacaccatccccttacctgccaagctcagtgcgtggggcaccagattctacgcggagcagtgcattttagatgatgtgttttctttaagtctatttgtgtttcttcttacacagacctcttctctccgtgtaatctcttatgtgctatagctcgttgttctcttaaaacagagctttcaatctggctgtgtttaggaagctatgcctaactttcccctctttgagatttttgtgtgaaccgatgaagatgatgcttgccgactccctcgaaggggctcattgagttgtctgtgttttaatcattacatgacagaggagactttctcttcccctactgcactatggttaccctaacagtgcctcaaagcgggcattttcaatcacttcaagagtgatgtgggacactggtttttgaagatctgagtttttatttgtaatttttgtagggtgggagagggctgggtgaagagggtagagggagagtcttcaccctctaaggaccagattagcttatataagcattgacagaatcataacttcaacatagaaatatcagattatccacatctgtgcaggtaagccatggctctgcccagttgcagactcagggtgatggtgacagtgtcaagagaagactcaagaggagggagagagtatcaatacccgggtcctttccctcagaaacaaaggagaaacagggcctgactttctctcatgctactctgaattcttttaatgtcttcaaagcaaagaaactgggcagatgatttccatcccatcttgtggcttctggctttcactctggtgccgtgctgtagggtagaccagctccttctgaggaaattatacccaggcccatggaaactctgccccttccagagccctggctcccataggctctggctgcagacatgaggtcatagtttaggttctgttggagcatttggaaccaccagtctgcaagctgatggtgttgtggtatcaggcctggctcctgatggtcagcagctcggcctggttccaccccagacgactcaggcagatgccagccagctgccatctaaatatgtgcatagcccatgtaggcagaacggtgcaaattcctggaaattagcattggctcttcagcttgatagaaggctggaactctaaagttgtttcagtgtgtggaaaaccacattaaactgaagggagaaattgtaacttttcattatgcatctctcctcattagcactcacctgaagcaagtccccatcgtggctgtggagaatagaaataattgtaggtcagcaaacactttatcattttgagggactcggttggtaaaagaaggttctcaaatttagatctcgtgtctattttatctccccattgtgggtgagcctggactatggaggctaacagaaaacctttctgtgaaaaattagttcattcccacagggataaatgatcatctttgcctattgttcacagacagcttttaaggctcttgacatagaaactggtatataaggagtgtttagaaaatggtagctactattatcatcattcattgggccctttgcaaaaggcagattaagatttagttgataaaaggaaatgagcctgtcgaaactgctgagaaagtagttgggccccagggctgagcctcattcattgtcctttctagtgggtaggctacttatatagtcagaggggttgttgcacaaggtgtaagaagtcttacaaacactccctagggactcattcaatggacccagtggacttggagcacaggagcacacagcctggaatgtgctgtcatgtgctgttttatagagccacatcttcttcatccttgacctgtctcacatcctgtacagagccacaactaagaatgtttgtatgcatttggctcaactggagggtgacctagaggaaacagtgctgtctcatatcctagattctcttgcaagctgaagaatgggaaatggggacattggttgtctgagatctcacatccaggatgggtcgtgccgcagtatgttgtttagctccttgagaacttgattttctagaccgagtattctagtcacaagactcagaaccactcaggggccaggctgtagcacactggcaaactatgttcaagaagaataaaggaaggagtgaaggtggccagtgatatttgtgacatcagggcatccttagccacctactctttcttttttcttcattgtttaccgaggtctaccctattatttggggagagaatatcttcttagtgactctactggaaacccaccgtaatacagcttttctaagacccaaagcagtacactcatttgcttgtggttaaccattaggcaggatgaggtcatgaaggaacagagaaaggcctgaatttaagtacaaagctcgttgccagtggctagaagctggcaactgctctatttgaagtaagtagcattttttcctgactcagtgtgtgtctttctttagagaaaatgaggtgacacaaaggccatacagctctaatgagaagtccttgtgaactgagaaacattctctcctcctaaggcttggttgacatatgccctcatggatagaggtcttggtagtctctgctgtttcctgccttgtggtgggaagtggtgggaccttagctttctgtgaggaaaacacaattcatcttcccaagcatcagcttgctctggctgaaggccaggcaagtccaggcttccattcctgatttattaaggttttgttgaatacctggtataccttggctttcttttcctttcagagcctctctcttgaaggaaatatagcaggaaagaggatatttggtgtttttctttccacatctacagtttatattgcagaaagatgaagaatccagacataaggagtggataagcttggtgtgtgatcccagctctgctgtttaactagttgaatgccctgaccaaattacctaacattttgagtacttatgacaaataatattgttgattgactgtcatcattttgaggattaattgaagctaatttttttacttgtttggcccagtacccacaatctaataatcacacacaaatctattgtcccttattatgtaactcacacactatttggccaaagctatgatgggtagctagaaaacaggagggacctgtgtcatcctagcctctaccatccatgagctgacaggcattctgggcagggaacagacttggatttctacacggtcgattttggctagaaattaacaccacaggagtggctgcagctatgaataagaaagagcatagaaccctgtgacgctagtgcatctcaggcagatccacaggaccatccatctaggttgcactgagcagtcaatccagagcaaagcctttctcatggtggccaccgtggcagcagttattacggatactgtctcagtcctcctcaccactcagtgctcctcctcctgcaatgaggcacagctttagtgagacagtagttcctggaggacccctggtttccatggtttcccgtgtataaatgccctttgcctcacgaattcccccagtatctctcccactttccatcaggagcttcgtcacaaagaatcatctttattcagaaatgtctcaactgttgtttgtcttggggaaccgtctgtggtgtgccatgcatattaatacagaggatgaagtcatgccttcctcatgctgctcagcaaggagaggctgtctcctgccacacgctggagccagagccagcagcttcccttcttactcacacttcacagtgctagatagattgaggatttcccctgctcgtcttctttctagcaatcactctgcccaggaaaatctgagctcagcgtgtgcaatctgagaggctgcgattagcaaggacatcttgttacaattcgggacgggcgacacagagggttccttcaagagcttctgggccttctcatattccaggcttcaaaagcaaacaatgtaagacagggttttggacagcgcttctgtggtttatggcaggagttccccattttttttcatttgttaggaaactcctttggggggaaaatctgcatcccatttagggctcaggagcagtgagcatgcggaccgtggcactgggtggtaggagtgagcaaagaagttgacttggttggctctattgttgcccagaggggatttgcggtagtacagaccatgccttgcaatacccacagtaggtgcttgagtgggtgcagcagatctcagaagcgaaggctctattgctcactgagttcaaatctgtggccttgcacttggtagtcacataaccagcagcaagttgttatggtcgccactccttagctcccaacttcagagtcaagcggacaatttgttttgttttatcactaggataaacttttgaacgaatctctattccgtatttctattccacacccaccttccaactccttttactggctcccccattccaccttctcactcacatccctggctttcctatttaatcactttcctgaactcaaatcctttttcttgacagaacccccatctactccggtggacagcctttcttattccctggatcaggttgctaggagctgcataatatgaatgtctgtgatgggtttgtgtgtgcttggatgtagtcctttctcttctctcaacttctatcactgttttggcgtttccaggttgctttctgaggtacagtattatacagggaaaaggatacccctctaccaaggccctatcattaaattgcctctggctagtcaggtacccatctctttgcctgccactcaattccattcattctggcctcaccgaccttccaaactttgaggagatgcatggatgcttgctacctactcattaatggaatcctggcagtgagagaggcctcctgactgtcctatttcatctggagagggtcccgttgcctaaaatatagaaagagtttggaagagaactagtttcacctgctattaataatagcacatgcctcaaaggacagcagagtaaggactgagtagcacatatgggtcatatgaagacccctcttctgcaacataactaaatggatatgaaatccccatcacacaaaatagctaaggtgtaatgatatggaagtgcttattgccctcattggatcaatacacactgcacacatgtgttgaactaccacactgtgcaactattactgttgatcaaagacatggttgatattcaggctcctataaacactagggactagggagatgaaaggctggcttaggcaagagaataggagccctttttgatactgtgaacagtgtgtggatgcttaggatctgttaagagagggtaagttccattcagccagccctcatggcgttcttggttgtttttcccttctggatctaggcctcctggagtgtctgatccctttctccaagaatgggtctctgggggatgctcgccttccccctgggatttctgcttgcttctgtgctcctggtggcttcggccccagccactccagagtctcccggctgcagcaacaaagagcaacaggtcactgttagccacacctacaagattgacgtgcccaagtctgctctggttcaagtagagaccgacccacagtcactcagcgatgatgggacgtcactcttggctcccggggaggatggggaggagcagaacattatcttcaggcacaacatccgtcttcagacaccgcagaagaactgtgacctggcagacagtgtccaggacctgctagcccggatgaaaaagctggaggaagagatggcagagctgaaggagcagtgcaataccaaccgctgctgccagggagctgctggtgaggctaccatctggtattcagtctacaaacacttagtgtgtgcttatgtgctgggtcctccactagcctcatgggtgctgtgagatcttggtgcatgtccctttttgcacttggcctttttttcaaggtacaagccatacccctcctctttattctctgatacagctctagaggcgtctggaagcctaggcagggagggttcagcaggctggtctcccagactaatgacaccagatgggaatgatcccagggctgttctgctgacaggccaaattgctattgaggagggaagggaagtgaaggtgtaaaaagaagagaaaggaagccgaatgcgatgttgaggaaattctcgaagtttcttcaactgtctaacaaggctggttttatcagctagcagagttctgcttactagagaaggtgtatattagagccctggtcaatagtaggtattcagaaaactgttaatgctatattagtaataaagtacaaaggacaactttttttttttcacctctaccgtttaagaacatggatgcccaggtgacaannnnnnnnnnnnnnnnnnnngtgacaggggcaagcagaggagcagagaagtgcacagtcaccgcatgcacaggtggaactactttatttcatagtcgtttcagactcaaaggaaaatggcaaaatattataaagaattcccatctacccatgtttttttaaagcttttgagactaagttaagggtgcggtttgtttgcccttttaccttttccactgtaaatgacttcagtacacagtagtttttttgagctgagacatactcttccatcatttcctcgtgatgacagaaatcaggaattgatactgacacaatagtgttgattatctaccttatacattgcattcaaaccagaacattctctctaatgttctttatatttttttaaagtgtttttcctccctcccaccccccacccaaaccccagccagcagccccactttggaagtttccctaggaagggaagacgacattccaagaggcagaaggcactgcatcggatgacctgacctccagcttccccgagctgtgtaggagagccctggccaaatgccctggctcactcatcactgagcctaggctaccctgccatttctgtacacgcagttcacaaccagcagtgctgggtccagctccattctccaggataagatcaagtcccacctgcctctctccctggagcactggaacccaacaaccaatgaggaccatttaaagtccctttatagaaaaacaaaacaaaacaaatcaaaacaacaacagcaaacgctagtcatcactattcacaaggaaggaaccctcttttaggcaaacaaaagagaagctgagatttggctcaagtagaaaacattttcctcacaaagaccccataagatccagaaaatgtcagccacctctgactagtctccaaggaaggagacctccaggcctcacccatgtcttcttttcctggcagatctgagccgtcactgcagtggccacgggaccttcttccctgagacctgcagctgccactgtgaccagggctgggagggcgcagactgtgatcagcccacctgtcctggggcttgcaacggccacgggcgctgtgtggatgggcagtgcgtgtgtgacgcgccctatgtgggggtcgactgcgcctacgccgcctgtccccaggactgcagtgggcatggcgtgtgcgtgcagggtgtctgccagtgccacgaggacttcacagcagaggactgcagcgagcagcgctgtcctggcgactgtagtggcaatggtttctgtgacactggcgagtgttactgtgagatgggctttactggccccgactgttcccagggtgagagtcaaaatgcacgttgagggccacccttccttcctaatccgcggtctcagttgcattaactctattacaggttgccttacttggagagccaaacaatagagctggttggtggggagggggcccccaagtttcaccaagccctactggaggaactatacaattgatggctgctgggtgtggcttctagtagggttacccacagttcagtgggcaggctgcatacccaagggcaaacaggaagcactaactggattaaccaggaatatgcaaaaggaaagaaagggaggcagggagggtgggaaggggaaagggtagagggaggaagtacaagagctgagaaggaatgtgttgaggggaggaagtgaggggtagatatggttgagatacattgtatccctgtatgaaatttccaatgaattaaaaaaaaacataaaacaataaagtcctgggtctcctgccagagcttgccacatagaggtccctgggaggattctgaaaatatgcatttgtacagattcctcaggtggtcctggtggtgtcggtggtggtcctgattctgatagaatgcacatgttccatgttagggcaaccaaacagtaacttccaggggaacggtgtcaagaatggtgtgataggtaatctgcaccctgcaggtctaccaacacagccttaagtgaatagtaggtgctggagaatattcatttggccacccagtcttaccctctccatcctcacctcctgctcctcttctgcccacagtggtggctcctcagggcctgcagttgctcaagagcacggagaactctctgctggtgagttgggagccctccagtgaggtagactactacctgctcagctactaccccctggggaaggagcaagctacaaaacaggtccgggtacccaaggagcagcacacctatgacatcaccggcttgctgcctggaaccaagtacatagtcaccctgcgcaacgtgaagaaagacatttccagcagccctcagcatctacttgccaccacaggtgaggaacatccagatacaggctgtctgcagggacagtaactctctcctgttctagttctgatctattgctggttccttctggctggacccaaggtgaagggtctggaagacttaagtcacagagtccccaaaccttggatacagaatgggatggaggatgcaggagactggctagattggcttgcagggcatggtcaccactgcatcagcagacaacaccagactgataaaaagaatcaacatcacatgtatgtcactaatgcttcaggttcatgtctcagtgaacatccagggaattaaaagaatagggaggggtttatgacttgcatcaaataaggaaagctctgggaacaactctcgaagcagtgttcttctccaaacaaagaaagcaggggaggggtgggaacttctattcagaaacgcatacagcagattgccctgtcacacacatgtaatgacaagtacattcctgagcattgaaaaaaaaaaaaggctagggtcttgggagtccttagaaaccaggttaaaaatggttttccacgtaaacactaagcacttataatccgaatactgggaaggaggagccagtctagcctactcagtgcgctccaggccgatgtgatgtcctgtctcaaagaccaaggtagacagatcttgagaaagaatcctctgtgcacctgtgtaagtacaccacacacacacacacacacacacacacacacacacacacacacacacacacacacacaccatggacacgcacagcggctaacattaatgtgtaaagaacctggacttataatgcaaatgatgattcacagtgactggaccgttctgactggctccttgttagttgctttaaaggcctttagctgcaaatccaccacactgacaccaccaccatcacagccaccaccatcagctgtactggcacacgtctgtaatcctagcccttaggagaaagacacagcagcttgagattctgagagaccctgtcagtatagtaagtcattttaaaagacggctttcttcctctagctgtggggaggctacactatgtagcagtctagcagctaacactttagaaatccagtttttcatgaatattcttttttaagtttctattattactattacgattgctattattattattattaaatcttttttacagtctagtcattattgccctcagactgttcctcatcccattccccccactccccgcatcttcaagaggatgtccccacctccccatacccaccccatcagacctccccactctctgggccttaagtatctcagattaggtatgtgttctctcagtgaggccaaaccaggcagtcctctgctgtctatgggtcaggacctcatatcaactggtgtatgctgcctggttggtggctcagtgtctgagagatctcagggtcagggttagttgagactgctggtcttcctatggggtcaccctcctcctcagcttcttccagcttttccctaaatcaatcaaaggagtccacggcttctgtccactggttgggtgtatgcatctgtatctgactgttgggcctctcagagggcagccaagctaggcctctgtttgtaaacacaccatagcatcagtaacattgtcaggccttggagcctctccttgacctggatcccgatttgagcttgtcactggacctccttcccctcactcagtctcttctccattttagacagttcttttagacaggaacaattctgggtcagagtttttgactgtggcatggcaatcccattcctccacttgatgccctgtctttctactgggggtggactctacaatttccctctacccactgtagggtatttcgtctaagcagttttgctgtttgagagtttggatcagtctagttgtctgagtgactgattccctctattacccaagggccccccaggtaccaggtgctgttctaggagctgacaaatgcactgtcctaccctactctaaatccctggggaagatctggatgggtaggatgatggcctgtagtcatctttgtggaaacagaaggctgccttgcctgttttgttaggaatgtggtgaactatggtagatcagtatcgtaagggctttgagaggcgtggcaggattttgttagcaagcactaaaaatacccctgcagttgaacaagttgggttttgttgttcattttatcctgggaaaatacatcatgggggaactccaggggtgtctcggtgagaatggaaggaagggcttgttctaggatatggggtttaattagataacctggggaacagggatttgctttgattgggatatagccaaggagtgtgtgttggggggagaagtgggtaactgtgcttgggcatcttagggactcttctctagaaagagggctcactagaagcagcctaagcggtggttggaaagaagtaagcaccatgtctgttagtcagaagaggggacattttgtcatttctgtggaaaatagtcttgcttttgtctgtgtttagacacggtcatagaatggctttgtttttgtctcagccttgcatgtttgcaaagtgtccttggctaatgctaatgttctgtggaatgacttatgagcacgggagaatactaagcatagctatgagagccaggccaaacttctgaacaataggggctgcttttgtctgtagctacatctgctacagacaggatagtgctgaaactcccagggaagggctggaacatctgttcgaaagcctcagcaactcttcttagaggctttctctgagaatttgtaagatcttgctacaatgaagtttgtctttctgtctaaactgattcaagttcaaatctgtcttccttgcacttcagggagctttagacctactaatacgtattcccatcttgaacattctccttaattccttgctttaaaaaaagtgtgaatatttcccaattcttttaagccatgtcagacctcttctacaatcctgaagtcaccttcattaatttcctattggcttttcatttggagaattctttctttgaaagaagtctcaaagcagaggctgggcctagcaagtaggggctacagtgagaagaaaggctctgagaggttcttgtctatagaagagagaatcagagatacaacagagggaccttgggataactaggttcatactctgcctaatataaaagttcattgtcatacatccttgatgaatggtcagccacaatgggtggcaatgcctctaaggtaaagatgacaagatcttggaagggggcaaggctgggaatcttggaggttttctttttctttctttcctttttttttttttcctgtctcatactgtaagagcaagttctatcagcctgggatacagctattgtaattctaagtgttcacaaaagctctcagttgaccccttccaaaagtttttcccatagagtgccatccatttgaattaaaattttagggttgttttccaattggcagggcaaatgttcagccctcttattagtcttattgtgaacaaaggaatatgatgagtgtcctttacaggacagagcaaaagggcagcatgaatacactggggaccttgtgaaagtattataatttgatagaaggttcaaagaagatgaaaagaaagaccaggttatacatcatctgctttgcaattttgttttgggttaatgtacagtgcacatgaggaccatgcgctctaatttgagagttagaagaaggatctagttgcattagcaatgttatatttttaaaagttgaaatatattgccccagattttatatgtatatattcctgtggctagtgcaaaggacagggactctgtagctaaagggagaacacccattaagagcagctgagccttgggctgggcactttggatactgccccaagaggagcaactctgatgtggtcagagtctgtatggaaggatgagatgcgtggtgcatagtggaatgagccatggagtctttctaggaagagtctgccttccgtggagatggccaagagcaacagccagctgttacctgggttagctccaagattcctgttaaagactgtgtctttagctgaagccagctctaagtgtgtcaagaaagaggactgacttagtggccaatgtactgtctcagacctttgtgacttctgcactcaaccattttctcttgtcttctctgatttctgctctagatcttgctgtggtgggcacagcctgggtaaatgaagagactgagacatccctcgatgtggagtgggagaaccctctgactgaggtggactattacaagcttcggtatggccccttaacagggcaggaggtgacagaggtcactgtgcccaagagccgtgatcccaagagcagatatgacatcactggtaagagtctacactgggagattccagatgttggctgcagaagcaaaggtggagggagacagtgtatcctgggtcttaggaaccacactggattccagactcctagatataagcctaccctggtggcctggtgtctctgccagcatttaagggctgcaatcccaggacacttcatttacaatgtatgtctcaagtgtccttccaagtcaacatattttttgaggtcctatgtatattttaagatgtatttgatggtgtatacatacttcttttggaggaatattgggatagactggggtgggaggaagatatatatatgtatatatatatatgtgtgtgtgtgtgtgtatatatgcatatatatgtatatatatgtatatatatgtgtgtgtgtgtgtgtgtgtgtgagagagagagagagagagagagagagagagagagagagagagagagaatgagagagaatgaggaagttgatttggtgagaatcatgacaagaagggttgcgttatccacaggatatggaatcctttcttagatgactgaactaagtctactaagaccaggaactcagaaaataggaatgcagggatagaccaagctttgtaatacttgaagtttctacacttttcaaggacttctttaagaacagtggtacatgtacacagccacgaataccacaggtcattagaagaagccatctaaacgaaagatcctcaggctcattagcctcatgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaactggtcaggagattgatggggtccagtggattaacgtttaggggagaaacaatagcatgctctcatctttccagtccataagaaagtcaatctccacctagaacaaccagggaaagaggaacctcagcttccattcttttgaccaggagagtgtgttatgctttcccttaataggattcagggaagccccgagacctccatcttttcatgtgttattttaaaccccaaggaggttaattgtgaagcttcccttcctaatgttacccaggggaaacaggatgtagagcccaaagcatgatcaggagggaagatccaccgtcattggcctacaccacgactaatcctggtaacacaacttctacttcttgacgaaagccttttatagtcacattaaatgtcacagcctctgagttcttacaacaattaattgcgtgtgccattgaattggtagttaacctttcaagtatattatcccaactagactattagcatctgagaagtgtttttattgtcaattatatcctaacatcaggatgagacacttcactggatctcaaataaatctagggtatgtgcactactaaaataaaaaagaaaaagatcctatcgtttctgaggtcagggaagaccatgagttaatttaggagattaaaaatttgttttctccaaattttttgtttcttgcaagctgagaaagagcaccaggatttaagagcagtgtatgcgtacgcaggaagggaatgtagttcagttattttccacttaacaagtcaaccaatggaacttgttaaaacaaaactcttaaaactgaagggtctccaaataaaagggtttattgagctgttacagctgctagacaggaacaaaataaaacaaaacaaaaccctgaccaggttcttggacaagttcctttgactattagcaacaaagctaaatagtagttgaaactatgtgagtgggacgcagagagccaagaatacatttataaaatcctgggaaggaacacgtatgtgcataacactgagtctacactgacaatagataagagagatcagattatcacggagatggaattccagcccataagaatgtagcttgaggaattctcccaagaaacctctgctccttccgctacaatcaggaccttgaattatgctggaggaaaaaaaaatgaggacaaaacaatgaagcaaactaggctttatttaggaaagtagagaacatagtgaggggacaggtataggcttctcaagagacagagactaacaaggatttaacactatctacaaaggattttgaggtcagactggtcaaagaacatgatcccatatctaaatataaaaatctaaaattaaaacattgaattaaaatattctagtatacttattttttaattcaagaattgttttactcgtcaatgagattataaggtgttttatgagtgtactcttcaggtttatgaatgagctaaggggttgctgagaagagaagtttaagtcaaaaaggtcaaaggaattattgctgtaccttatatcaaaacaaaatcatgaccttttgactgtaaactctgttcacaacctttttgagactttttttttcagaaaaaagaaaatcctcaggtttacagacaatgaacaatcggatatggttgaactcaaagggcactaacattttgtccttaaacattaagcatggttcattacttgttttaactctccagtttcatatatctctcagggaaaagtaacattgtctccctgcaggcaatctttacaatgtgggtatatgaagactgcatctttccattctcctatccccatacgtttttctgtctccctgtcctgctttgggattattcagagttgagaaaaccttggagtaagagagcaatgtttgtcgctctgaattattcagttttaatacttctggaagctttcaagtaggcagggcgtggtgattctggtcagtgactatatttaagacaaggtttctatgtagcattcaaaaccagggagagagatcttacctttagtttcacccacagttaataacagattcacttcctttaccatcttcctcccccctcctttccagtcatccctttatcaagctaatatcatgagaatgacaaggctgatagaggtcagtgaggaccgccagtgtgcggcaggcgggaagttgtagctgaaggaggcctctgggagcaggttggagagatcctgttttgtagatgaggctacagctgtagttcatctatgatttggcccaccaccgcagctactggaagattttgttgcatggaaaaacgacttaatgttccccacatcccctcctggcagacagggagggtttggtcttgcagggctggcttcatgcaactgtgtaagtgtgtggggtccatcggtggggtctacttctcattctcagatgccagcatctgactgctgtctttgttccaccctgtgaatgatcagggatcacagctctgtgaggatccccctttctagtctatgctggtaaagagttgagagaaagggggtggggaagaaggcgtcactgagttctaggctggttctgtctggcaggacttctgtggtttaacttctagatctagagtggctgtagacatagaactagattaaattttctttcctggtgttcataaccaagatctatctatctatctatctatctatctatctatctatctatctatctatctatctatcttctatctatctatctatctatctatctatctatctatctatctatctatctatctatttatattttaaacgctagtgttctttaactcaggtctagaagctcaccccacagaaaacccaatgttgggaagattagtttttcgtgttttctttttttttttttttttttttttttgagacagggtttctctgggtagccctggctgtcttggaactcactctgtagaccaggctggcctcgaactcagaaatccgcctgcctctgcctcccgagtgctgagattaaaggtgtgcgccaccaccgcccggctggggagattagtattacagtgaaagaagtgctttattcagtgggagcttttacttgaaaatcacccaggaggctaaagagttgaggagttacagacataggaccagaccaatgagggagagacaccccctccaatgaagaagagaaaggctactgtctcttctctgaacaagcagagctctttcagaaagtcagatgcctcgtcttttcattgtctcttgttttcagcggcatctgatagggttttttctttctataaaccctgaaggagaaagagagacttagcaaggtctcggtcaagttaatcctgcattataactttaggcaaagcatttcttaaatgatcaatatctctacatgcagagcagagtagaatctgacccaaaggttaaagcaaaagagaggacagacacagaatgaaggcagagatagcaaaactttccatcccacatcaatcacccatcagacacgtgcacagaaaagcagagtcggtgttctcaggaaagagttcctcaagtgcttgaaaagcaacctaggctactgttagcattgcaacaatgcactgaatgctttctacagcaaagcaaatggaaaactacagtgtctttagctagattatgtaacttatgaggttagtgtttttttttttttaaatgaagggcaaatgattctagaggatttgcttagggttttccttggcaactactccatctcttcagtgttctgaggctgctgagggaacacaagctccaaggctggccaggttggatctctcagtgcacatagacagttctgacgctaccaaaccactggcctgtgctgtgacaagatgttgcaggctaagtactgacaggggcacgttgtgggagtgagaggtactgctaggatgctggactttgtaggtgtgggtgggtcactttggagaggatgagagtcagggctttcaagagctggattgcactcctctctttgtgtctttaatcttctcttctcctttcatcaccattgctgagactgagctatggcctgggggtgggagtggggctgtgtcagcatccctgcctcacaagcacagagacattggggtaaggggtcagagagagaatcctctctgttgtatacatgtcttcttctgaacgatctcttagagcctcctgatgttggcattagggatcttcaggcttctgcatccagacaccccctctctcattccatggaactccctttgccagtgagatgtgtctagcacccctacagcccaagctgttttctttctctttagaattctccccaagttcttatcaactactcctatgttatttcaggttgcagtagcctttcagagcatagtttattccatctacaattgttaatgtttatcccacatagattgaagagatgccagtcacattggattggatccacctaaatgactccattttaacttatgatctctgaaaagacctcagatgcaagtagacaaagattgttagtgttgtgacagttgctagtatttattactgccgatcttacagaagttatctaacctgtctgggcctagcgtatacatactattctaagaggggaagactattagttttcctaacttgtgaggcacctggtgaatgccttgtgtttttaccatgggatttggtaactaatgtatgaaaagcaccatgatccttggtgtgtgcttggtaaatggcagttgacttactaaatgaaatatgaactgcctctggtaatggaacacatttcatcttctcttgcaaataaaacactgcccttatgtttgataaaggtgcactgtagctaaggttgaaaaatgggactatgtgaaattgtaacttctctctgaaaaatccttggctgagagaccaagaatagattgaggggcggggggggggggagggagagaggaggagaatttagctgctttagaccaagaagttgttttgtggatttttcagttaaaaagatgtagatccatatacagaggacattctagggtcatgtcttagcggtgttctgtttgacatctttatcagtggccttaacgaatgtgtattgatggcttgcttataaaattctccagtgtcaggaagatagacagaaaagtgagcatatttagacaaaagattaaaatataaatggaactttaagagggcaaaactaatgagtataaatgttggccaaggacattattaaacatgcatagattggagatggtgggatttaacatggaagtccttattctttgatgcatatcagaatcacttaaaagttttgtttatgtgtttactaaattattatatatttttagataaggctttactcactggatcagtctggtgttgaacttcatgtatagccccggtttatctagaactcatgtttctcctgcttcagacttctaagtgcaggaatgatgggcttgtcttaccacaaccaaggaggtgtgtgttatgtggtgattcttgtttctaatcccagcgttcagaaagctgagctacaaggactgtgagttcaagccaggctgggctatatagtaagattcgctttttaaagaactctcataactccccaagcataaaacaaaaccaaccaaacaaccaaacaaccacaaccaaccaaccaaccaaccaaaagtccctgaaagaagctaagcgatgctagggcttactctgcatttcttgaagtggaatctctgctggctgtacttggcagggacccagtgttggcagaaattgaggacacctagatagggggactcctgaggccacaggtacagggtgtgtcttcaggatacagttggaaaattgttttgaacaccaatgacctcaaaaaagactgctgactgtcttatttatttataattgccgaatgccatcctatattccctgtcacatacattgttgtgggggtaaataagttaaattttcggcacttttatttcaggaaagaaagacggaaacattgtatagatagatgataaatgcctggtcaagaaactttaatttgataggagtagatagatgaggccagttttgatttcaggggaattgagaaaagaagggataactgttcttgaagagttgctgagtggtctcctgaaagggagttagaggcagcccacctatacgtatagtagacatgttatgggagttatatttcacagaaactactatgtcagtgatagcattgattactttctggtttatcagctgcacctaatagagtttcttctaatgtagtcagtaacctgaaactagaacagatttgtttttttaatctaccagggacctattctcagtttaagattaaggcagaggctagatatttgcctgtcatggttgaaagagagactcctttgtattgttgagagaccattgatctagaccttaaagtgactgtggattttaccaggcaactggttcctctaatttttatttcttatgtatgaagaaattgatggaccaaccaatgtggtcacaaatcaggtgacagaagacacagcatctgtttcctgggatccagtgagggctgacatagacaagtatgtggtgcgctatatcgcccccgatggggagaccaaggagaaggcagtaccaaaggaccagagcagcaccgttctcacaggcctgaagccaggagaggcctacaaagtctttgtgtgggctgagaggggcaaccaaggcagcaagaaagcagacaccaaggccctcacaggtaacgggagaatgggagttaagtaggtttcctcagggtaaggaggaagttgcttttgaaggtgaagatcattaccatttggcatcagctcttttattggtggggttggagaatatttacaaaagcaattttaaaagagcgttattttaaaaaatttttaatacaatatattttgattttatttgatgatattgttttcccttcccatctactctcagataccaccttgcctcgctgctcacccaacttcatgtttttctcttgctccaaaaagcccccaaataaaacaaaacaaaacctcaaaaatcaaaacaaactaaaaatataaacaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctttcttttttttcttttttctttttttttacattttaacttcacatgggagctataagtactatttaataggaatagtcatatttatttgggatgaaattccatatacatctgtcttggagtagagtaaaatgttgtaatttttactttttaatgacaactgaagactttggaccaactataaatttgaatgtttatctcagattacagtggtgatagaagtagtttgcatgcagccaggagctctctttcagacaaatggtttgcattggcatcaacatttgccaaatgcacggatacttcccgtgaacctttagaaacataagatctccaactgcatctgcttggtctgctcagctcaggccttcagatgttctgagacgtactgagacagagcatggccagtctttgtgctcacacactctgttggtcatctctgaattcacaacagtctaattggtatcctcctgctcttccaaagcacttagtaggaactcagagggaaaggatccgctgattgtgtttgtacagtcactgaatacagagaacttcagagaggcatgcataggaattaggaatatggtttcagatccttgaccatttaaaatttaactccagggttgccatttattagctgagtggtggtgggtcaattactggtttataaaatggctcaggaatgtctgtgatacaggaatatggggagggttacataagtgtcttagttagggttactattgctgtgatgaaacaccatgatcaaaatcaagttggagaggaaaaggtttattcaatttacacttccacatcacagctcatcatcaaaggaagtcagaacaggaactcaagcagggcaggaacgtggaggcaggagctgacagagtggccatagagaagtgctgcttcctggcttgttcctcacggtttgctcagcctgcttgttttttaatagaatccagaatcaccagcccagggtggcaccacccacaatgagctgggccctttcccatcaatagctaattaagaaatgccctacagccttgcctacagctcagtcttttgtaggcattcccttaattgatgctccctcctctcagatgactttagcttatgccaagttgacaggaaactgtctaggtcagtgagtgaattcacttaaagcaacgggtgcacatcacttttgttgctgtgataaaacactgaccaaaaccaatgtgaggaggaaagcatctgagaagggacccctgaagagagcctggaaggacaggtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctaggctccggcatagtctcacaagagacagctatatctaggtcctttcagcaaaaatcttgttagtgtatgtaatggtgtcagcatttggaagctgattatgggatggatccccagatatggcagtctctagatggtccatcctttcatcacagctccaaactttgtctctataactccttccatgggtgttttcgtcccaattctaagaaggggcaaagtgtccacactttggtcttcattcttcttgagtttcatgtgtttcacaaattgtatcttatatcttgggtatcctaagtttttgggctaatatccacttatcagtgagaacatatcatttgagttcttttgtgattggattacttcactcaggatgatgccctccactataacaacaggaagtgctctttctttctgggaatatgcttcaggaactggctcctagagcggggttatgaaggcatcatgtttaggaatgcctttttgtttgtaccatattgtttggagttttgactctaatccttacattttgagggagaagggatatcccatcccttatatgccattcttaatagcaagccttataagcacgtaccacgcagacgttcatctatgaggaaggatggctctttccttctttgtagaggggcagagacagaaacttaagttatgcagtttgttctaagtgaggaaccaagaaaaccagagcctagtttctatcccatttcatcacacagatactcgggcagattctcctaggctccttctcatgaacccacacctcagtaccaccagtttacagctcaccccattccctggacacacacataacgttctctgtagaaagcactgacagctcctacttcaagaacatttttcatcccaagagcagggaatagcagagaagattattgaaatatacttatttcaggtgcaaggggtcagagaactgcaagagggtgctatgtaatttatgataaattacatacaaatggcaaaagaaaagtttatggaattgatctatttattggcactgtctgaattcttcctttcagtcatactagcagtttattcttagaatacctgacttgtctacttagagcttagctctctcaatcctcagcatatagctgactgtggagttatttgacatcactattttggctgtgcctttggccttttaggaactagagagtaataaagcttaccctcctcctttgtatctcccttaaagaaattgacagtccagaaaacctggtgactgaccgggtgacagagaacagcctctctgtctcgtgggacccagtggaggctgacatcgacaggtacgtggtaagctacacttccgtggatggagagacgaagcaggttccagtgaagaaggaccagaggagcaccgtcctcaccggcctgagtcccggtgtggagtacaaagtttacgtgtgggcagagaaaggcgatcgggagagcaagaaggccaacaccaaggctcccacaggtaagcagagagagatgcaccattggaatgaagtgtgaacatacagatttgagtgtgcatggtaccacaggttgggacctgagaccagagactacaaggatgcatgagaggtagctcagccggtggcatgcttgcggcacaatctaagtccaatccttagcacaagctggatgtgggggtgcacacttgtgactctagctctggggaggtgcacaggtgggatccctggggctcactggccagccagcctaacctagtcagctagcctcaggactcggtgagaggagtaagattgcacaggagtgatgcttttagcagactcggtggttatgcgtagagggtctggttttggaaatacttgtgacaataccttcagagtgctcaccggagaggcagcccttgataaaatgataaattagttaccctgacagtgtgacaggtgtttaattggctgtcttgatatgccatatgttactatgaagagaatattccttctacattttagggagccaaaagtcaagaaaacatgttaagtgtatagctagcctgatattgagatagagacccagaaactgcttcctcgcttgactcacagcagaggcttggcttggtaaaccattgccttgtgctgaatgttctggaagataaaaagcaagataagggggtgtgtggcttccattgttatagcttagacttctcaaacatgttcctttcagacatcgacagccccaaaaacttggtgactgaccaggtgacagagaacactcttagtgtctcctgggaccctgttcaggccaacattgacaggtatatggtgagctacacctctgccgatggagagacgagagaggtcccagtgcctaaggagaagagcagtactgtcctgactggcctgaggccaggtgtggagtacaaggtccatgtgtgggcccagaaggggacccaggagagcagaaaggccaacaccaaggcccccacaggtaatgggacacgcattgcgctgtgcatgagatggcgaggttggcttctccctctctgacatgattttgttgattagaggcaatgatgctccctccggaattgtatacctccttctcttacaatgcatgtcttacactgtaagtctctaaaccgtggtctttacagactgatgcttcctgcttacagcctcccctgcttgcctcttcttctgcctgtgaagatgatttgccattagacctaagtgtttcactctggcaggaagcaaatatgaagggagtgcaagcaactgtcaggcggagagagccagcctcgtaaggttgtgatccaccaacaacttctttttaaaaaatccgcgcttgtttagacccttcccatgaagtttgttcctgtttctgcccttcggatgagtgctgtaggcagaaataattgcagtgttttgttctctacaaacaagccagcgactagtcccccctgtgttgacttttttagtaatgaaaatgtccatttccatgtatgggtccatccttcatttgcagttagtcatttgcatgctaactgcttgctgtgggaagcggtactgctcagcttttcttctgttttcctccttgaactttaggtcccttcctttccgctggctatctctcattgttttccatcctgacccgttaccactccttcctcctaatctcctagcgctcttcatttagtggttggttgattcaaggttggttagctgaggacccccaaactgccctgatggtgtcacctcacccttctagctagtcctccaggacagctcctgacacgatccccaagcactttctcaactgatgttcagttcatgggaactgcatcccccttgctctttgtgagaacgtcctgccattttctcactgatgaagaattttagccacatgtcaaacacctgctgatgtgttccccgtgctttagaaagggtgtctcaacctcggcgctgctgacatttgagcaggacaatcctttgttgcggggctctttcttttgtgttggagaatgcatagcacaccctgtatctccctttcctctgccaagttgtagctgtcagaatgtcttaggcattgctaatcaacctggctgaaatcttttgctctatagcaaacacagtaagccctaccagggatcgaggtgaaacagattaaagttcagacctcacccaaggtacacaaagtctttttatgtaattccagtttctgagtcctaacatactggcctctccaacttccttaataactggacatgtttataaccatgttagccaaggaccttaaaactattgatccctccttacctgtgggcttccaggtgggaagttagataccatttttcttgaggtcatagcctaaagcaacatatgaaatagaacctttgaacaaatcaccttaggaaaatggcttttttaatgaacttctttaaaaaaaagaaaatattactagtttattgataaaatatattttcaattactttatgttatgtagtatggaggacaaaaatcccttggatttataaagtgtcaatgaattgatctcatcatagtaatgatagttgaaggtttgcacatctacctggtgctaagaacagtcctagcatgtgattaactcataggatctaacactatgatgtaacacctttacaagatataaatcaatatcttccatattccatttttgtttctctcagaagaaattgaggcacaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccatctcctcccaagataggttgttgtcccttctttcttctttataacccactaagtccactttatactacccatatactcaggggtgtggggccatccgtggttgacctaccacatccccaaaggccctttttcagaacctatcaattgtcaatagcctctcagctggggggccgggtcccattcatgctgcacggagttcaagattacagtggtctggtcatgtccacagacatgtttttgtgcaggtcctctccaactctgactcttacagtcttactgtctcttcctcgtcaatggtccccaagctagagtgtgtgggatatagatgtcacatttgtgggtgagccctccacagacatttgttctctgaactgtgaccagttgtcagtttctgcatcagcttctgcccactccacaaagaaacctctctgacttgttatagatatatgtcacatttgatgtggcctttagtgattgacttttttcatgaaacattattcctcaggatctgtctcattgtagcatgaatccattctaaattttatccttagtgagtgtttcattgtatggccgtatgacaatttgtttctccacttgtcacttgtgaaattgtgcattgtgtcatagcatttgtccttgagtatgtttccaggacataaatgcctaggagtaaaatttctggatcactctcttattctgtcctttatttttcactatattacatatgccagtatatttccatagtgtttaccccactttacacacccattaggaggaaataagggctttcttcctttcctcagaggagtttgctgagttgatagcacccctgttttacaataaaaaaatcctcaaaccagtgaaatctttgacttcaccaagacatatagagagctggtgaaggcagaatctgattcatgaagtatacacggaatattggcctatcttataacctagtctaagggtcacatttatgcaaaaggaaactggctgtggtggccatcccattgtcctattctttctctctgaggaaccaagagtctctgtctatgagatcacataatgaaagcagacatatggggtagaaaactctaagatcaggaaactcagcccaagcacaatgacttcagtctttgtgtctactttagttagtgtttattgaccagtgcttatcctttcagatattgatagtcccaaaaacctggcgatcgaccaggtgacagagaccactctcagtgtctcctgggacccggtacaggctgacattgacaggtatgtggtgcgctacacctctgctgatggggaatccaaagaattcctgattgggaaggaacagaggagcacagtcctgacaggcctgaggccaggtgtggagtacaaggttgaagtgtgggcccagaaaggagcccgggagagcaagaaagccaacaccgaaggtcacacaggtaatgaacagcatgggttagcagtatgatggctgccaggccaagcttaggggaagtcaagctttaatttcttcctgtgatacagatgggtattgatggattttggaagagcagctttatttcttgcacgatcaacttcacataccattccttactccctgaaactggtttccttatgtgctagaccagtgcttttccaccttcctagtgctgtgaccctttaataaagttcctcatgttgcaggggtctccaaccataaaattatttttgttgatacttcatagatataattttgctactgttatgaattataatataaatatttgttattttccaatggtcctaggtgacccttatgaaagaattaaacctgcaggttgagaaccactgggctatgttctccaaacagtctccaaactgctcagctgaatagttcctgatttctcttccaagtgcttggatttcttgccagagatattattttcatgagtaagaccggaaaatgaaaaaaaaatcaaaatttactttaagattctagattttacatctgctgtcacaagtaaaggcttgcttctctacatccaaatcatattttaattataaaacaaatttgtcacggtaaatgataagccccgtgagagagctctattgtcatgctaatggacacaaacttgtttgcaaaagccaaggtctccaacttgaatctctgtatgttgcctgtcgcatgccttgcatatagagcaaaagcttgatagctttactaaatgaatgagaaattagtgttttttttgaacttttaatagaaatcatactttcggttgtctgattctggttgtttggggtctccatgtgggtagggaagcattcctgggaagagatgtgaatgtatgaagacaagtaagaaacaaacagcaaatgaacaaacccccaccaaaatagagtgtctgagatagaaaacaacagaaaatgaaaactcaccactcaccatagccagcagtgtctgcactctgagcctcttaatggtatatatcgatttcttgttgttgctgccatcattatcaccaacatcatcaccaccatcatcaccatcatcatttttgtgcatgtgtgtgcaagtgtgtgtgtgtgtttacacataggcacacataggacatggtacatgtgtggagatcagaggataattttctagagttagttctctcgtacagtgtcagggatgacagtcaggttgccacatttgtgcaagcatctctactgactgagccatcttgctgacccaatagcacatactgactaagacttttaaacttgtagacattgacagccccaaaaacctggtgaccaatcaggtgaccgaaaatacagccaccatctcctgggacccggtgcaggctgatattgacagatacatggtgcgctacacatctgctgatggagagaccagggagattccagtgaggaaggagaagagcagcactgtcctcacaggcctgagaccgggtgtggagtacacggtccaagtgtgggctcagaagggggcccgggagagcaagaaggccaaaaccaaggcccccacaggtaatggatgctgttcattgggactgtcaagcttgtcatggaagagcaaacattctttccttttcttacactgatgtaaaataggaggtgaggaatgaacatgctgggttaataatagaggttcatctattactgctgtgtgatggcattggtgatttggggtctgtgacctcaaagactggactgttttaggaggacaccttaacccattttctccgacatatatagcacctgtcagagacaaggtaaatttgtaaacaacaaacgtttattttattttattttattttattttattttattttagatttatagttgtagaaaagaatcccagtgtctgggttgtcttgcatcatcacacacatgggacaaataaacatgtaagacaaagagaaggcagaacttaagcctagatctgagctgatgtgcacagtcctgtgggggtatcagtcctttagtgagggctctgctctcaaaagttctacttcttaaaaccttactgagggttttgatgtaaaataggaaggaaggaaggaagggagagggagagagagagagagagagagagagagagagagagagagagagagagagagagagagagagagagaaagagagaaaggaaggaacccaaacctttcattcactttcaaagagagcaaagtagagcaacagatcctctgctgagtagtcgccctaatgccttgaaacttttcccgtagcacatgcccttaattgttaatgttccccagctactgaagatttcaggaactaatgcgaaattaatataaaagttctgggttaaagaactgtgttgaggcaagctgttccacgtagacttcacctaatagaaagcatgtggtataaagttataaatgtcaccctgggaagcaggagagccctgtgtctagtatgaagctaacttttcatcgccatcttttaagggcatgacggacctagggatggagtgacgaacaacttagtatgatctgtgctctcctgacagccagtgggagagacaggcaatagatgaaaaggaaaatatgtaactgtaaattatggcacgccctccaaaggacatgaagatggtggaggttgagagaagagtgggatggaagatgtagtgatttgataggttgagatggtcatagggtgcgcattgtcagatgcaccaaagagctgactattaacaatgcagtttatacagaaaaatagagtgtaagtgctcagggctgacatggtagctccctctgtgcaggagacccaggctccttatctgttgtatatctgtcacccttaaggaattgtattcatttacttggtaaacatacatttgcattccagctcatgaaaagagtccttggaaagggcagggcatgactggaatattccatgcatcagttctcagaaatctttctaagatccaagatacagtgcctagcctcagtgataggcagctaaagaaagaggtcctcagacagatggccacatgctcagcttcaactctgctatgctgtcctgttcagttgtcctccaaaacaaaaacaaaacaaaacaaaacaaaacaacctccaaaaccaactactttaattagacaaatataagtaaataaattatttggtcagactaaccacatttcatgttgtcagtagacatctgactaatggctcagtgatgtgttggacaatctggaggagaagctggccatttctggtataagtaatttcaggactgtaatctgtaatgagatgattgagaaatgggaagaggtaggtatcattggagcaagaggtgagagagcaattgtcctgagatgaggtgggaaggaagaagtcatcaggttacacagaagcacatggtgcctgaaggagaaactgtgccttagctatagattagaaacacagcatagtatttatctaaaactatttttcaggacacagtgagaataagttgaagagatgacaagggaataaatagatcagtaaaggagttactattaaaatctggttagtgacagtggaggggtgacaacaatagggatacagagaaggagatggctgacaacatattttggagctacaagcaatagtacttgattgataagacatggaataaggaaaataaagaatcaagtatgactgtctgcttcgagcaatatggaagattgcagtactatttctttttccgagaaaggaggctgaggggggtgtttatctcttcagggaggcaatgaagacttaaatgtttaaatttgaaatgcctgtgagattcttttgcttaatatatggtttgcttttattagtcccacaaatacatactggggatgagccaggcattgtagaagatctgcagtagtatgtacaaaccaggggcttagaattgtcctcttgttccacaagggtagccagtaaatatttcagagcacagatatgatagtatcatatttgtgacaaatggggaggtagggaagaagagagagagggagggaaggaagaagggagaaagggtgaaagagaacgagaaggagggagagagaaaaagaggaggaggaagaaaagagagaagagggaaaagagagacagtgagaagcagaggaagaggaagagggagggagggagaaagggagggagggagagagagagagagagagagagagagagagagagagagagagagagagagagagagagagagagagagaatatgagagaaattacaatccagtgtttagatgttccagcatatgcaggttacaatcaaagggctgaagaggtgaggcagaggtgccaatgtattaagcacattggaagagtatgaaactatggaagccaagagttgagagttttctgagaatgaatggatctgttttgtacaatgtcactcaaagattgagtaaattaaaacaaacaaacaataaaacacaaagactgagtgaactgaggatgtccatgtccagtagagagttgtccatctagaacgttttagagatctatactcgcagatttggtggtatggtgcagggccacagtggagctgagcttgaatgtgaggtgagtgatgttgaaatactcagatccttctctggtttatagagaaatgacatgaaatgtgaaaagaaggggggtccttgatactgattttctgagactgatagtggaggggaaatactaatgatcaagagatagagagaggaaaagaagaaagccctggaggtggaggaagacttaaacattcagagcatagaggtctttgtttgaaaacaagaaatagggatgagggtcttcattgctcttcttttataagccaaggggctggaggatatttggtgaagcacagtaggtacaatggagagcatacaggagattgttccaatgacagtttcagtggcttagctagttctgattttcactgtgatgctgatgaaaatgggaaggacagaacatttccagaggaataaatgtagagaagacatggttttctgttggttgtaacatccggtgtctatttccctggaaaatggactctgggggattctcattcccatacccttccttccttccttccttccttccttccttccttccttccttcnnnnnnnnnnnnnnnnnnnnctttcctttctttctttctttctttctttctttctttctttctttctttctttctttctctctttctctgaaatagtaccttaccatgtagccctgactgtccttactgtctgtgctcctctggcttcagaactgttaggattgcaggaatgggccactatatcttcttgtttctgtatttaccactgttaccgataagattgtaccagtcataattagactattattagctctcttgaatggaggaaaactcttgtggaagggggtggtgagatgcttttccatggttctaaactcagccttttctaaatcttaaaaaaagaaattgacagccccaagaacttggtgaccaaccgagtgacagaaaatacagccaccatctcctgggacccagtgcgagccaacattgacaggtacatggttcgctacacctctgcggatggagagactaaggagattccagtgtcaaaggatcagagtagcaccatcctgacaggcctgaaaccaggcatggaatataccattcatgtgtgggcccagaagggggcccgggagagcaagaaggctgataccaaggccctaacaggtactatgacacttcactctttccaagagtgagtcttcctctataaaaagggtgaggaggggaggaggagggatggttgctttatctgaagatgttttccaaagtggttctccattaaccttgcttgtgtgtgttgtatgtgtttacatgttcatgtgcatgtatgcatatgctcatgggcatagaggtcagaggttgacatgaggtgtctttctcagttgctatccatattattttttgagatggtctctctttgatttggctaggctgtttggtcagtaaagctcaatggatcttgtctgtctctgcctcctctgccctggtattacagatatatgttactgcccatggctttttatgtagggagtaaggatctgaacttatgtgaaacacttgacccactgagacttctcttcagcctcatagttctctttctgaggtagtgctttgacaggttaggtaggactgagggcacatagtatatggttgtataagttattcttccccagcctattggctgaggccagatgccaggatctctgtacctgatttgtgttagaaactggttgggtctcagctcctgctgggagaagaaagaaacaggaactgactgggcctccatgggacccaaagtctgtggtcccttcaggcattttgaacaaggtctatttatcttctctatgaccagtagaggtgccctaaatttcttgatggtttttattagttaaaattaagctctccacacacattaaaatctactaagaataaaaaaaatcacattggaaatatttgtaaaagaaaaattaaaaaccaaaccccaaacgcctttttccctagttccagactccctagaatctggctccctagaggcaatggatggccattgtcctccccttcatctcccccactactcttcctcttccatactcatctcctctctcccatttatcttctcattcctttactttccccagtttaaaacctttaaattatatttctctctccttccttttctccccctccctccccttcacttccccccttcactctccctctgtgtatgaatgtttgcatatgagcatgccacagcacacatgtggaggtcagagaacagcgttcaggagttggttctctccttccttcacgcaggttctgggattgaactcaggttgttaggctcagtggcaatcactcacgggcaagatgttgctagccccactttttccaaaatttaaagacagcaacgaagctatcaccttcctgctccatagaaacaggaaattaaccaagtcagacatcccaagtccacagccaggggacagtggttaatcaaagaggaggcagaaactgcctcaaaatatgttaataactatgtgctgatttgattctgaaggaaattcagtctctctatgtgatggatagcgaatgatccatgccagatgttaggctttacaaaatcaaaccaagctgatattacagagactcaaaatttgtcaaaacaacctaattcaaaacaacagctgtctgatttctattaaaatactacaattcagttctcagctgaaatgctactgggtagaaaatagcctggagatgtagttttgggaagttctaaattagaatcgccttttatgatttttttccttcaaaatggaaatttccattcatatcttatttgcttaaaaatatgaacattctgaccagctttggtgggaattagtatttttgctgagctttcgttttctatggtacatgctcacatactcatgcacaccctttggtgtgtgctcacacccccatgcaagccctctggtgtgtgcttacatacccatgcacaccctctggtgtgtgctcacatacccatgcatactctctggtgtgtgctcacacacccatgcacacttccagtgtgtgctcatacacccatgcacaccctctggtgtgtgctcacacacccatgcacacttccagtgtatgctcacacacccatgcacaccctctggtgtgtgctcacacacccatgcacacttccagtgtatgctcacacacccatgcacaccctctggtgtgtgctcacacccccatgcatgccctctggtgtgtgctcatactcccatgcacacttccagtgtgtgctcacacccacatgcacatttccagtgtgtgctcacactcccatacacaccctctggtacatgctcacacacccatccatgccctctggtgtatactcacacacttgtgcacactctctggcacattctcatttttgtgcatgcccttgaatctttgctcacacatctgtgcatgccctctggctttgtctgtacccatcttagccaccattccttccccctctgtttctgagaaagagtctcacaggaaggtctctggcatcaagctctctgaaatcctcctggctctgcctcttgaatgctgatctggcaggtatgaatgaccacatccactttctttttaaatatctaaatatttaacatatatatttctgtactgggtatatattgaaggcttagatgcttaagaaataaacctttgtattttataccaacttaaatttatcccaagtccccttacacattatggtccctaatctcagtatctaagtctttggggctctctcagtactaggcataagaagatgccagtttttcattgcctctccagacaggtaggtgcctttgagtgacccctgtgttctctgtgcagggccctttgtaatctgtggctctcacctttccaagtcactcaggaagctccaccaccatagagaacctgtgtgccaaattagacttctcagatctgctgctcttggaatctactggggaaacgaggcccagagttccttcctctagagactacacaatgccgtattcctagaccctcttgaactctacaggtccatacttctagaggcaaaggctagggagactctgagcaagaacagacttgccagcagctggagggctggatgagaaatgggacaactcgcaggaggaaaagaaaaacagatgactgaaacttgtgcatggcttaggaacaataattacgtggcttctcatttacagaaattgaccctcccagaaatctccgtccgttcggggtaacacattctggtggggttttgacctggttgcccccatctgctcaaattgatggctacattttgacctaccagttcccaaatggcaccgtgaaggtatgaggacttcttgtacttctcttggtgccttctcttcccagcctccccgtagaacaacttgttggcttgacctgctgatctgtcacctgctaagggcagttatttgtgaacgccatgctctcggtgtaaggactaacctctgtgtctgctcctagatgactactacatatttgctggctgtgtgtattctccattttatcattctttttttttcaactgcttatttttaatttctagcggctcaaactcaaggtcttgtgcatactaggcaagctctgtagcgccaagctccacccgtcagctctgctgtttcctacttcctcctgctcttcctgcacttcctcctgctcttcctccagcaccagctcctcctgtatctcctgcttctcctgcacctcttcctgctgcacttccttctgtgcagctcctcctcttgctcctccccttctctatcttctcctccccacttcccctcgccctccctctccttcttctcctcctcctctgtaaattgttgggcctgcttaatatatttagattccaggaggactgagactttttttttaatctaaggcatttagattaatgcttcgcatgtgaatattttcttttgttttatttttggcatcagcgaggcttgaactcagggccctgtacatgtcaggcaagtgttctgcccctgaactatgtctgtccctagccctttttagtatttttattctgtgacaaggtctcactaaattactgagctgacttcaagcttgcactcttcttgctacagtctggaaagcagctcaggtcggagtctgtgcagccacacaccaggccaccaataaaaatccactgaataaacagttgaccattattttaagggctagctttccttgggaatctctgaagtccagcaaacctggccagtagaaaatcgttgttctctctgtagcaataaacaaacagataaaaaaaataagaaagaaaaaaagagaacactttgacttactcattattacaatgactgcatctgactgtccgacttggagagtttagtccaatgtttacagagtaaggcatattcagggtttcttgaaataccaactacttcagtgtctcacagttatgatggccagtttgccttctttctaaaaccatgttcttaatcaaacattgccagcctactgctgatagcagttactatcgtcagtgcctctccaggtatctgaaggaccaagtccctaggcaacctggctggggttcctgtgttggccatgcacagcctcagttcccagctagcccttctagcagggtggactgtccatggcatggccctccaggaaagtgactgacactggctgggattctgggctgccactgagcacatggagcagttttaacgtcatgtgtgtaaatgctgctgacgcccaggctgctgggcagagaaactgagttgctcactgcctgttatcgcttttgtttataggaggtggagctcccaagaggccagcagagatttgaattgcaagacctggaacagggtgtcacctatcctgtttccttggttgccttcaaaggtaatcagcggagccggactgtgtctaccaccctttctacaggtaacgtggaatctagtcttttaagtgacaatacacagagaggcattggagcggccagggaggagtgtggaattatagagaagtaaaaatggggttctggtttgcaaaccagtccaccccacagtgatgtgactaaagagggaagtggggaagctaggagagtagacctaagacactgagggacatgagcctaacttaaaggtgcatttgcagagtttgatggaagcagagtgatggccagctggccttccttctaaaaacatgtcccatgatcaatatgtgagctaagaattggaaaaagcaagtagtgtaggaggcgatgaaataatctccagaccaagcgaattgtctcgtaatggggaaagctgcaatgtctcttctttcccgtctaacaacaccgtccttctgcttggtctcagtggatgctcgctttccacacccctcagactgcagtcaagttcagcagaacaccaacgctgccagtgggctctacaccatctacctcaatggtgatgccagccggcccatgcaggtgtactgcgacatggacaccgacggaggcggctggattgtgagtcttaacggtgctcagagaagctccatggaacatcttgtttcttagcccagggagatggtcgtagctgctccatggaggtcctatttcatctctgcctatggagggaaggaaatttgatggcttgcaactgtgtggagggagatcttgtcccattgcaagggcttaacactcactggtcacagaatgggcttggttaaaccagagtgaaagactatgagtttagcatcatcaaaaaatgcctaaatgtttctaaattctaccctcttcaaagcactttgaaaaccatgaccttcacatgatatgttagtgtgagaggattatcattcttgttttgcaaagggggaagctgaagcttacagagaaaacatctttggttgagtcagtcacacatgtcagtgacattgctgaagccaccattccaggagacacatatgccagatcctcgatcttcctgatggcttgtgtcaggtcacacaagatggaaatacacagcttctttgggggagtcagtcctttgaactagggcctctggtttttggtttacaccttggctctgtaggacagaaacaaaatattagggctttgatttgaagagtaaggccagagctagggaagcttaggctgtgtctaagctgtcccagtctgccaggaagttttactgtcttgggccactgtctccttgcattctgagagttctttcattggttgctgattcggttctatgatgaatctttgaagcttgccggtggattattcgatctttctctcttacttggcttctccctgtgtctgagccaattgagggtcttactttctctaatgaaaggtagctttcacctgctgtacattggaaccaattgtgggagagagaaagcatggcctcatagtgtcgagctatgttcatttacacgttttcttagtgctctgggaagccagctagtttttgagcagccacaggtaaaatgaaatcatctgacgagtggcaatgaagagcacagagcacacagtgtctgcccagtgacaaggaatagtgggatgtctgtttcatccaacaattggttggatggcagaaagtcttgatttataaaataacacaacagattgtaacatgggaggtctcccacctaagcagccctgtatgtctgtgcctgctgcttttcatcatcaccattgtacctgagctcagttccctcaggcccacagcccaatttaccacagttgtgcttgtaattgaccactggcaggatgtctgtactgtttagtgtggtctttttttgaaagcaaagcttgtacaaggaagggaccatttatcctagggcaggagagagaaagagagagagagagagacagagagagacagagagagacagagagagacagagagagacagagagagacagagacagagagagacagagagagacagagacagagacagagagagagagacagagagggagagggagagggagagacagagagaggtagaaagagagagagagagcagagagagaaaaagagacacacagagagaagtagagagatacagagatacagagagagacacacagagagaggtagaaagacagagagagatggggggagagatagagagaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaacccaatcaaccaaacagaaaaaaaaaaccccacccaatccaagcgggggaagctttaacaagtgggcaacagggagaaaaggagctaagaacagcgtgctaattagctgtgttacttctgtgtgcaatgacttgctgtgattttccctaaattcttcttgtcagtttatgcccatttatgggacatttttggaggacatgtactgttccatctagccttcccagaaacgctgtggcagacttctcttccccactcctctctgctttacagtgagctggctgggatcagaaaccaaaatgactgactcactatcccccaggccagaaagtgtctgtggctgacttggagcctggaacattctcttcccatgggtgtctttattcagcacctcctcagccacagagctgtagtggtgctgaagggagttaatggtgagcggccacgtgtaacctcagctcgtgtcacttttagagaaaaatgtaaagattccacaaccattaggtttccttcaccaaattcaaggctatagataatagaatttcatgttggggcttcttcctttagatcagtacaggggaaacagaggtagacatacaattctaggctttggtaagtggttgctaatcatcactgaatgggccacaacgacttttagtttggtctcaagttcaagtggaataatagcattactcttttcaataccgtgtgcaggtgtgtttgggtttaggaaagttttcgagtttatctcatataaaggagtctgatttactcggagggggaagtggccttcttttcccgtgtagagatctttttgtatacaaagcagctcatctttctgaaacagaaccaaatctctagttctcatttttcttactcctcagcccagcccagcctgcttcctgcctctctctaacccagcccttgctgaagtaattggggattttcatgtcactaaatcccagggagttttgatcttacatcccttcatccctcatcagtactggggactactgaccattatttctcggttattacacaatgttttttagtttcctttctctgtccctagctgctgcttctctccctaacgagatcatccatgcctatgagcgtattggaggtctccaaggattgatttcagttctgactttctttgtatatggcagcatctttccttcctccgacccccgtactttcactttgaatctcactggatccttgtgttcattaggacagcatgattccacagcaatgacagtgacaagccactctcccactcccatgctctaagaatacacatgcagtcacttctgagtgctgtctcagcagttcaggttgcttccgatttgtggctaggccatcgcagcatgtagcatttaccaatgtgcatgccagtggaagacagtgtggagaaccccacctactctggtcctcctgcctttagcttaggaatagtcacacgctttttacttacctgcaaaagaagttgaaaaccgtcctgtgttcttgggacaaggagagtgaagtaggacttggtgaactcctgccatttctcccagatacacttccaacttagagagcaagcctaggtctctcatcagcaccctacccccctctgctggttacatgaaaccctgcttcaccaggaaacctcagaaagaattaatactggaccagggatgttaatcagtggtagagtacttgcttggcatgcacaagaccctacatttgattcccagcacagctaaaaggaaaggagaacaaacaaactcccaacttacacagtgtccccaagtgagcttgatacagttgcaaaagatgtccctctcagaatcttccttctgcaagaacagctgagtaaataattatccagtgctgcaatcaaaacttctatagaacaggacagccctggtggggtggggtagtttctcaagtcctaaaaacatggactggaattccaacaaccgatcaactcatgtgtatgtgaactcttagtgttgacccactttgtcaccatgactgtcaagtttccttctgccgacatctgtctatcttcagggtagtttcttgtctaactcaccatccactgtgaacagcacagtacagtggtcttcaaactggttaccatgtcttccactcctgccactggacaggcattctctacactgtagctagaaggatctggggaaaactctgtttcctgtttagtcttccaaacttaccattgctttttacaatggaccaacatcttcaaccaaactgaatcccaccagggctgacctttgcctgttttccagcctcctctcctagtccttcgtgacgagcacccagaatcagggttagcagccttcctttctcttcttgatgctcctgctaaccctgcaagcttctgatattttcccaggagagtcctgttggctcttgcttaggtgcagtcccactgtatctttcttcatagctcttattgttggtttaactgaatttttctttgttggattacttaactcatgtctatcttatttactggaatgtttgctccattcagacaggaaccatttcagctttattcattttggccatcaccttgtgtgttttctacttatacaggagatgctcctgctgttccacaaatactaaatacttgctctgttaggattcttgagaataaaaataattcctcctttcaaattgtttaagtggaagataaaagacagcatatatagaggtcatgctccaaatgagttggaatggttgacagttatatgccacagacagtaaagatctggaatcttctatcatacacaaccaacaactagcaatttatcaccagctttcccaagtttttctgtgctctaggattaaaatttcttaagggtggaagtgttccctgttaggtactatacattttcatacctggaatatatattttacctaaaattcttattaatgtaatagacagtatactcaatatactgagatataaataaaaattgcttttaaagaattaagatgtattattgcagggtcagtttatgtgcaggtccatagtgtccccttgcctcccagggccacctggaaaacacaactaccatttctctgcccctcaatagtatctgtacaatggcagagcaaagcactcatttcctttttcaggtcttccagagacggaacactgggcagctggatttcttcaagcgttggcggagttatgtagaaggttttggggaccccatgaaggagttctggcttggtatgatctcagagaatcaggaaggtggggttgtggggggataatatccctcttgatgggctggtcagggcatttatggaagcttcccattttcaaggagccattcaagggacagggacactgtgttgtattgggaagggtctggcccagcagggatgggtgaagagataggactgcctgaggtggcttttattccatacctaagctctgcagaatcttctctgagcctggatttcatataactgcagtagaaggacagttgatggatttggatcccaggctctcattaagaggatgtaccagtggtccctgtaattctgctggtacagccagacattaagggcccattttccctctgctctcttttggagcagatgttcatagagagttaaatagccaataaaacatctactgggaaatacaaaaatttaaaaaaaatcgaatctggttattcagtgtcttccagagtagatgatgtttgtgcttagctaggtacagagttccatttgaggtctgaggataggcagttatttcatctattcctttacttttgagatgtgtggacacacaaaagagggctggcttctgctttggagaggtagagccagtgggcagattaccccaatactttgtcctccctgatggcatcccacgatgtcattagcattgccatgccaaagaaataagggtgagaatattagcaccccaggagaaagagttgggaaagctctttattagcagagaagattaaatataaagatgacttttatctctgactgtctcagatgcagacagtgagaactcttacacacaagttgattggttatttgaattccattccatgtttttaggacttgataaactacataatctcaccactggcaccaccactcggtatgaggtgagggcagacttacagactttcaatgaatctgcctacgctgtatatgatttcttccaagtggcatccagcaaagagcggtacaagctgtcggttgggaaatacagaggcacagccggtaagagagatgtctcactatggcagtctccttgttaccatcatctaaggattgacttgccatgtgccatggatgtgggctgtgggatactggtatgcagaggttgggtgtcttcactaacaatgctctctgaaggggcttgagggtaaaggaagcaagaataatttttaaccattaaactggattgtttttatatgttctttcccccgcacctgaatctccttttattctcccctggtttaggctgtttatacgtttttgagcaattttattctgagcctttcagtgaacttccatacacagtgggactgttatgcttgtgtgtgtgtgtgtgtgtgtgtgtgtgtgtgtgtgtgtggtgtatgtgtgagtcttattataacattttgtggtattttgctgtgtattaagacagaaaaatgaaagcaccaagtcaagcagtaagaactttagatctcattaacttacacgacagggacaacacaaagacgagtagtttagccaaaagcagggactctttagcctccattagctgctcactggcttttggccagtgggtggtgtattcagttgtaccgtgaaaggaacacaattaagcatcatgattgaactactgcgattatactgacaaacattttaagaggggatggtgtggttgttggtctaatatggatattttaaagatgatatttatggcttctctgcctttggtctgattctgactttgcttgtagtcatgtctaagtgtgttactggcaaaattagctgattttataggaagcacatggaaagagaagaataacttttgcagaccaagtggtatggtaaataaagagctaaggaatgggaatggtgggtatatcaaggacctgagtggctaggggaagcttcctggaggacatggggatgggattggctcagacagagggccaaacacagacaggaggaaaggaggggcttactacatctgagggtacccaggaggaatagaggaccaacccaaggcaaacagattgctgttttgtagggcatctcaaaattgtatactcaaggatctctgaggtctggggttatgatctgaaatagtcaactacgaatggaaaatgttgaggttctttgctatgtattgtaatgctaaatactggccctcaaggcctggttgtcctaggaatgagagaatctttatgtagacccaagtgacacatgtaaccttgacccccaagttattcctgattggtgaataaagaggcctacaggctatagctgggcagaagataggtgggtttttggttttggggcttggggcttagttttggggggcagggaccataaagggggggagagagagagggagagagagagaggggggcagagagaaagagagagagagagagagagagagagagagagagagagagagagagagagagagagagagagagagagagagagaggagtggagagatgccatggggtaggtgagttatgaatacatggccatcagggctgatgactggagttaagagtggcccagatgcaacatggcaagttaatatggtcattgatagagtagataccaaaaccatagagggtaggtatctgttcagctctagtacataaggcttattataaatataaaggttgtgtgtattttatctgggaattgaatggtcaaaggtgaggtagaaacctctgatagggattaaataatttctataacaggaaaatttctttgagttctataatttcatttcgtaaaaccataatataattttgctcatttcatagtaatctagcacaaaacctagtacagagttagtgagttttaaaacaatgagatttccagcaggattcctcatgtctaatctcgaggacactcaataccttgataggaatagatcctgagtttatttgacaagggactatgggagcaggtgggtgcctgtcaccaaggtggttgcacttgaccaagttggaactgttcaaggattctaagcaggagttacatgggaaagagtgtgcaaggaattgtttctagggaaaataattgccgtgaaacgcaccacagctaccaaggtccattttgctttggattcaccccttccttccttagatggtctgtatttctctgggctagagatgggctgtacagcctgccttccaaatggcacacaaaccgtgggagtcagctctgaaagccaggctactgggaaagtgagtggaaggattcaacacattctaaattaattgactctccctaggtacattatccatattttcagtctgactaggctctggtaactcctgttttaaagttgctcaggccaacgaggccagtcagtgaggattttttttttttttttggtttttgtttttgctttttgttttttaattcaaggagaaagaggcagcttggatacaactgggaaacagactgacctttgttcatgtgattatcagggtagttacagaatgatttaaataatcataatggttattattttttaagacaggctctgatcatgtatcccaggctagcatgcaacttgtaataatattcctgccctggcctcttgagtgttggaattaaggaatatactatcacacacaatgatcataataatttaatactaaaataacttaaattcatagtctcaggggacagagcccattacataactcttaccccacctttaaataaggtcaggttgtgtttctgatggcttctaaatgatctctaatcatttagaataacaaagggccagcaggtcagccctcagtttcctatttgggcttcctcctgctccggtcttagtgtacctgtagtctatctgactatctttcatgctgtcagtgagacttaggctttcctttcaggttagagtctcaatttttataaaccttatacctgagatcttcctggacacgtttgaagtcaggtgtttctcctcggcttccatgtcttctgtttcccccaaacctggcatccttcctagcttcttggttgagacttcattcagacccatcttttcagtttgtccctttctttccctttcctttcttggaccattagacattgccttttctgagtctagttaacataattcagcaaatgagctgatgctaatgggaaaaggagtcaacatattcttaaattactgcgactctcctcccaggtaccttatttccattttaactgtgactagggggtaattcccactctaaggttgttcaggccaatagggcaagccagtggaggatgtctttttttaataggaagccttgggagactctcaaatcacatagcatttaggcagccagctagtcttcctgtgtgtgccgtcagtcagtcctaccttgatgtcctgcattactacagtggggtcagtgccattttagctttccttgtctatgctttggttcagatgagggttttaaaatctaggaagcttcaggctatgatgcagtatagggtagaagacagatgttcaaatggaaggtgaaggtctccctgtctctgtgagtgccatctattcctgtgtctcgcttcattaatgcttttattacaacagagatgcacagcattggtggaaaggagaggcttcaagcttgtccccacctcggactgtccagctggaccgatagcttcccacttccactgaagtcatactgctttttgtttgcttctgcttcttttccttctcctcctctcttctgcttctcctccttcctcttcctcctctcctcttcctccttctcctctcttccttcttcttccaaaggaaacttcagcaaggcaatagaatgttagcttaatttctgatgttgaatcttataggctttcctatgagtcccactgttgggatgcttgcttatgtagagatggcaacacaaacatagactctgtcagagtttccattgggctacccaactttttccaacttatctcatgtccctcttgcatggggttcagccattttagggtacttaatggatgggtcctcctcctggggacacttggcaaagtgactgaggatctctaacaacacttagtagtccaggaatgacaatgtctatatagagctgtcttaacccaaagccagtgtttcctatattttttaaaaaaatttttcttaggtattgtcctcatttacatttccaatgctatcccaaaagtcccccatactgtcccccccccactcccctacccacccactcccacttcttggccctggcattcccctgtactgaggcatataaagtttgcacgaccaatgggcctttctttccactgatggccgactaggtcatcttctgatacatatgcagctagagacacgagctcctgggggtactggttagttcatattgttgttccacttatagggttgcagatccctttagctccttgggtactttctctagctcctccattgggggccctgtgatccatccaatagctgactgtgagcattcacttctgtatttgctaagccccggcatagtctcagaagagacagctatatcagggtcctttcagcaaaatcttgcttgtgtatgtaatggtgtcagcgtttgggggctgattatgggatggatccccggatgtggcagtctctagatggtccatccttttgtctcagctccaaactttgtctctgtaattccttccatgggtgttttgttcccaattctaagaagaggcaaagtatccacactttggtcttcgttcttcttgagtttcatctgtttcacaaactgtatcttatatcttgggtattctaagtttctgggctaatatccacttatcagtgagtacatatcaagtgagttcttttgtgattgggttacctcactcaagatgatgccctccaggtccatccatttgcctagaaatttcataaattcattctttttaatagctgagtagtactccattgtgtaaatgtaccacattttctgtatccattcctctgttgaggggcatctgggttctttccagcttctggctattataaataaggctgctatgaacatagtggagcatgtgtctttcttaccagttggaacatcttctggagttttctatattttgaaacaggcttttaatggctggtgtttgagaaaaaagaattaatagattcacagagaaaaagaaaggctagatgctcaccactaccctttccttgctaccttcagtcccaggggacagatactccaggcctagtctcacagccctttgtctgaatgtgactcacaggggctatgatgtttatggcttctcctggtcttaggtcttaggtggaggctgcagaatctttatcattctttctgcactataaagcactggaggatactcagagtgacattttgctgagatggtcagtcaccagctcagtggctatactggctggttttgtgagtcaacttgacacaagctagagtcatcacagagaaaggagcctcccttgaggaaatgcctccatgagatccaactgcaaggcattttctcaattagtgatcaaggggagagggcctagtctattgtgggtggtgccatccctgggctggtggtcctgggatctataaaaaggcaggcagagcaaaccagaggaagcaagccagtaagcagcaccctctatggtctctgcatcagctcctgccttcaggtgccagctcttcttaagctcctgtcctgactttgaactatcatctggtagtgtaagccaaataaatcctttcctttctgacttgctttttggccatcttgttttgtgtgttttgttgcagcaatagaaaccccacttaagacagtggctataccttgagtgtgggtttagaccttctatgagtcttctataaccctcccaacccacacctaagaacagtttccagcaaagccaaagaacagggcattttgaatagggttcattagcagtttctcctaacactaatatgagggagtctaagcatgattggcctaactaatttttattcattatttctgagcttctatgtagtccattcgggcctcaaacttgcatttctcatgccttagcttctggggctaaggagtgtccatcacacccagatttaacttggttttacttagggaaaataaactcattgattcagaacaatgcctcggctagagccagttattttctgattcatgagcatagtcattttctatactctgaacaataatttggctttagtttctcaaaggtagaaaatccatattcagaaataataataacaattaataaaaaaaaatgttccaaacacatcaaagctcacttcctttttctagtccagggtccaaggttaggataactgaagatatcttcaagaaagcatttgtctgggtcttggaaaataagctctgggaacttcatattcagtctaggaaagctgtgcttattgaaagaatgttactaggggagccattgtgtgttatttcaagctgtagttaactgtctgtgggaaatctggagggaggagaaaaacgtaaacaaataaagccacaggctgtctttttctttgactggaagaaactcatggaggcgtggccatcttggtgtcgaagcaccaaaggatcctgcctttgctggtcaaggcatgaagggaacaaggttgtgtttgcagacttggaaggacagattgctgctaccttcctgtcttagtgtttccattgctgtgaagagacaccatgaccaaggcaactctcataaagaacattgaattggggctggcttacaggttctgaggttcagtccattatcatcatctcaggaagcatggcagcatccaggcaggcatggcactggaggagctgggagttctacactttgttccaaaggcaaacaggagaagactggctcttctacgctgggcatagcttcaaagcccacccacacttcctccaaggccataccttctaacagcaccactccctatgagccaaacactcaaaccaccatacttccctttgcacaagggtctattaattttatgctagggactgaactggtggccttgatttcctaagtgttcacctacctcatgccatatccccaactcctatgaactctttgcgtacctgctctaactcaccctaacagagttcttaagaacaagaacctcttctgctttgtattgccagagccaagcatggggctcacccatcacagggaagtgtacatcctctgactaagtgtgtggatgaagctgcagctgtgccaggaccacatgaagggctgttgaagaacacatggctcccagtattttcacttctgtatgcctgggttaaacctagaattcacattttttgtaggttctcaggtaacatcagtgatttaggttttggggactgcctccagaactattgtcaaaggttatcagagatagactgcacttactagtaggaatgaagccctctgtgggagtgaggaggccccaggaaatctgtgtttcataaagaactgacattttagaatctgaggaccaacagttgagtcttgacaatctcagagtcttggtgtctgggaccttcggttgctgtaggtgaacccccaggattttatttccatatgggattcataagagcctggcctaccttgcaggcctgtgagagtcacagcaattagatgtaaatgtgagtgtcattgttgcaggaggggaacttgattaagcccatgattgatatgggctcttattgccttttatgaactgaaaaagcaagtaaacttctaaatggatgacgaatgtggtaggggaaagaggtgccatatgagtgaagtaattaaagcagattccagacaagatgtaacgaagcattaaattgtacatgcgtccccagaagggctctcgaagttcaggtgtgtgcatgtgaatgtgtgtgtgtgtgtgtgttggtaagtgtatgtgtgtgtgtgctcggatgaagggaagataactaggaatcttcttttatagtagagttgagctagactgtaagggaggtgagggtttgaacaatggagggcagagggcaaatgggcctgctcaccacactagtagagacaatggggttggaggttgtgcataagaggcagcccagtgacaagcctgcaaagcaagcaggatgaaccatcttctccatggtagtaggtaggatgctaagcttaagactgtgacatgggtgctgccacagggactgggagatggactgagatccgggaaagttgttgggtgaacacatgtcctcagagatgaaaagagaccttggtggctgctgtgaagaggcaggaaggatgttttgagaaagtaggttagatcaagggtatgttatccaataaagtgaatggattttgggtcaggggcagcagggagaatggtcactgtagtaaatgcagaaggacacagagtgtttatatcaagtgaagggtagtgagaccttccaagtgagaatgctgttgaagttgatggagaaacaggtctggtgtttgagggtcaggttagcaaggataacctgttcatctatatcatgttccattctgagttagttgtgacgacctgtgatacacaactgaatccttggtgttttggtcctagatatttcctgttgggacctcttttctcatagttcttgactcatagttcttttctcatagttctcatagttcttatctctcttgcaggggatgctctcacctaccacaatggatggaagttcacgacttttgacagagacaatgatattgccctcagcaactgtgcactgacgcatcatggtggctggtggtataagaactgccatttggccaacccgaatggcaaatatggggagaccaagcacagcgaggtaagtggcaggcaaacagcttttctatcacaagctttgcctgtctccactcccaaagtgatgtcatcctggtgagattgatagttccccctctgtctgaagctttcagtcaggccaggagattgtgcttcggtcttcatggtgtcaccagacaatggacactacacagtgtacatcgcactatcacacaactattcagctgcatgggagtgactcatcactgatatatgacctatgatgtgaatcgcatgctgtctcatctcattattaagtttcttttgtaatatttttgagccagggtgggtctcatgtagcctaggctgagctcacacttgtagttgaggaatggtcataaactcatgatcctcctgccttcgttttttaaattcttggattattataggcatctgtcacatctggctaaatttttgttgttgttgttcatctgtttatacagactcttgctatataacctaggttggccttgaactctgaatcttcctgccttagcctcctgagggttggggttacaggtgtgcaccaccatacctagctatcagaccctgttatggatcaggttgtgataatgaactaccacagattaggtggtttaaaaacagacttgcgtatcttacagttctagaatttcctaatccaagaccatggtgccagccgattcatttttgatagagccttgttacttggtatggagacagacaccttctagataaatcttcacgtgacacagagagaggccatctgacctcctcaatgaacccccctccctgagagctgccccttaatactaccaaattaattgggccaataaaatttcaatacgcagaatttgaagagaacacaaatattaaatcccaaaccagacacttggttgtcttttctagttgcctctccattatagcagagctgtttctctgggtcccttgatgactaggtaaacaggttcggctttgggtcagactcagccttggctccactttaacctaagccaccaagagcctgccacaccctgttcttgtctctgtcaggacagtgttcagggctcagtgtatgtgagggctcctctcttgcaaattttcctgtctgtattttctgggacttccatgacccttgtatgtcatggtgactttttgccagctacaggttatctatgacccctcctggcttcctgaaaattacacttttctcctattcatgtcaatctcttgccctccataaacctgccttgggtttctaatttcaagtcctaggtcctgatcctggctttcaggcagccacctctctccagaactcacacagaccaatattactgtaaatattagcactgctcaaatccaggtgcattcttattactgtagttcttaccacacaatcaggactcccaatccttatgtgatattttttttaaagggaagaagaaatttgcccctagggcaatgaagaaggttggcccaatgaatcatggtggcagcatgtgggccgaccagggaagcctgtgatcagagatcaaatatttgaaatgagcagtcagcatgccctaaaccatccctgtatttgctaataaaagacattcatctggctaatgtgcttctctcgctctgcaagccatttagcttcttgtttattatttacttcacaaattaaaatacataaaattggtcacttgggctctttattggccaggttgcaaggttattaagtgaattaaatattattgtgctcaccagtcaaaagacataaagtgaaatttagttttcagcaggccatttgtcaccccagcgctaatatctaaacagtctaaattgaaaatgattttacacaattggctaattaatacgtttatttttgccttttatttttttgaaaaagaacagggtacggcaatggctgattgactgctctctgcctaagttgatcgtcttgtcaaccttgtgttctggccttccctacatcttgggcacacaccccatcttcctaccacagaggtttctttctctctccactcagcttgtcgaataccaggagagggtacatgatctggaccttgtattttggatcataacccattactgctagaacttcctcttctttttcttcctccatcagagacacagtgatttcttgttctctaggattcccccccccccccacaaaccatcttactcttctcccaaacacttgatgtttgatgtttgttttgcagggggtgaactgggagccatggaagggacatgagttctccattccttatgtggagctgaaaatccgcccgtttggttacagcagagaccgtttctctggcagaaagaagcgctccataggaaaagcaaggatgttctgaaggcttgtctgagctgtcttcacaggagacaagagaaacttggggttggcggggtagatggtgcctaggaagctgaagtttgagggatgctcatagcctccgacttcctagattgctgggtacacagtgctaatgacgtcatcacactttgacctttagaggttccttccatgtcatctgcaagtttgcctgtctctactgagggcttcattgttggctttcaggagccaacaatgttgtaactgaacagtacatatggatagaacacgtgttggaatcacaaggttttttcagcccatccttaatgacagatgtattgaattagggcaaaaaggtgaaccatcctgtagaccatcaattggaaatctttagaaattggtggatatctctgtatccatctgataatatagatctttgtagaaaaaaaaagacaaagtgaggttctgatcccctgggtgttagagctgaggtgacctgctacttcttgtctctcccggacctcctggtgtttgaaggaaatgtttatatcttactccttttaaacttcctgtgtgatgaagaatgaagagactacaaaggggccacgatgcagtcatagttaagttctgactagtctctagcattctagagaccaaagctcccattttattgctatttttaactgccccttttccagacatttgcataagttctttcatagatctgcatatgttgtaaataaatttgcagtcatttaaactttaaataacccatctctctaaataactggtcccctcagctcccccccaccacttcactcacctccatgcctctcccctctcccgggtccatcagccctcagcctccctccttccctgctccccacactggaagcttcctcacatcatctttcttgcgtgtttggtgtcattttggaaagttttctgtaaccaagtcagtgacctttgaagtaacttaaattcctactcaagaaaacacaaataaactgtttgatttttaaaaagccgtctcttgttattttctccccagagagatggcccacaatagcaatacactcaactttttgcaggcttgctaagcgcgcttaagacattgtcttggtcagtgttctgtggctgtgaagagacatcatttccacagcaactcttataaaggaaagcgtgtaattggggctggctgacagtttcagaggcttagtccattatcatcactgcagggcggcatgggcggcacacaggcagatatggtactggagaggtagcagagagttccacatccagatgtacaggcagcaggaagggagagagatactaggcctagcttgggcttttgaaaccttaaacatcccccccccccccagtgacacacttcctccaataaaactatgcgtacttcaacaaggccacaccttctaatccttttcaaatcgtgccactccctgatgatcatacattccaatatataagcctatgggaccattcttattcaaaccatcaccggctagattgtggactccctcttcagatgttatgactcattctaactgctcctaggattgctggcctctctatgtctgtgcagatctatagccaaatcagtgacccatagtctttgttctggaggaggctttgatggccccagatggcaccatgcccatcttaggttcattaaccccagggtttggccactgaactgacctgtgtgggagactgaagctgttttagcatctttttgcttataggtcctttgttgccatggagaaatttcagctgaccttcaaatagtttactctgagcagaaaaggaaatctgggaagttcatttcagagtgtttatagagtgggcaacatccaagcccccacccttcctgcatgctgccccttgctctagcatggtccgtccagcagtttattccaagcttaaaggaggccatcccatgcttcaggatggcccaatgtgaaaggggacgtgagaagtgaggatacactagaagccaggagcagagcatctgtcctacaaacggcggtaaagtttccaaagtgttatctattctgtgcatacacaaggcagagaggagcaaccaagctactggccctggtcaactcttagaacttctggaagatagaaaacaagtcaggacggtggtggtttaaggaaaaagtgagtcactaagagagagagagagagagacagagagagagagagagagacagagagagagagagagagtgtgtgtgtgcatctaatcccaccacaaaggctttagggggctgtagtgatggcatcagatctagaaatgcaggtccgtgggtgtgggggggaaagggagttccggtgctctgggcaggcagatgcgggtggactgcttttcacatggccctgggtgggcatctggctgtgttaagccactgaccccacatggcgggtggtggacaaggggcagccccaggtaccaggttctcagcctctcgtatcccacgctggatatggtggaggagctgagaacagaataggggccccagcagcacttggccctggagatgaggggaggaatgggcagggggaggggcgctgggtggttcccacaagggtgagagtccttggtcaggtctgtggctggagcacaggatggccttctggcgggatgttagacgcggcccatcccatccttcaagcacggcgggccttgataatcagagacatatggttttagagctttattgtagaaaggcagggagaaaggagggaaggtagaaagagagagagaccagccatggccacgtggagagaggggggaagggaaagagagaaagagaactagagagtaagaaagatgagggcttaagagagtgaggagggggccaagcagcccctcttatagtgggctgggctatcaggctgttgccaggtaactgtggggaggagcgtacctaggctatagtcaggtaactgtggggtggagtctagccagaatgccagaagcttgggacatggttggtgtgacttagtcacagaattatggacagacacctgattctgtgaatgtggctcgcctttctgtcccttgtagatttctctattgggccactggagcaagccccattcaaccaaaataggctgcccatcacagtcccacatagaaagacagactgagtcatgagggaagcagccagacatctgagagagccaggctgcacatggacagtatgggggaggcagtgtggcttctcagtggttgaggagcccagggagccagtgggaaggacaggcagggggtcattgctgcaatggctgtcaggtcacattgccattcagagccagcatgagctttgatgtgtgtccttctgctcattgccccttcacaggtcccattccagtgggtctctagtgagttctacgcacctgagcttttcaaagttccccaggggcctctaacatcaactcaggggtgagagtcattgtttccacataagcctttgaatggcggagagctctcagaggcttcgaaaccttgaagtgacacgggaggcttgtattttggaaatattagtttggtgacaggttgaggagggccacagagtggggattttgaaaactacttagaaaattgtgtgtgtatgcatgcgtgtgcatgtgtgttcacatgtatggacaagtgtgtatataggacattaccctgggtctccttttgctactttctacttcatttcctgagacaggctcttattctgaacccagaactcgccgatgtgggcagtctagccagccagtttgttctgtctccagagtataaggatttacttcaggtggggctgccacgcccaaccatcaagtcctcacacctgagtagcaatcacttcttccacggagctatctcccggcccttgtgttatctttggttgacacaaatctgtggggtaaagcatgccattccaatatgcacgtatatgtgaagtggtcagcgcaggtgacaggcatctctatcactgctgacatatatcataccttggtgtggagaacatgcatagacctctctaccggttgctttggaatacacagttagtccttgtcagccatagttactccactgtgattcagaaagtcagaagtcattccttctgtctgtgccccttgcccatccacaaggggtgtggtctagggggaagtggggaggctcgcagaccagctcacagctgctgtaatagttctccaagcagtactgagtcccttggtctgtgtcagaaggggatctatagaatcagcaggagtgagggaggactggcttcagaggccagcctgtgaccacagagcttgaagatgtttatgtgtcacggctgctacctctggaaatggcttggcatttgtgtttgttgagtttgagtgttccgttttataacttacaattattggggattcaagggctactgaagctggaatataccgcaggagagagtgaggaagggggagaaagagagaaacagaagaaaataaagaaagagagagaggcagagacagacacacacacacacacacacacacacaatttaggtgtgggttgtgcaaagagagagcatgcagacaaggaggcatgcaaagaactagaagaaaacgtggtgaaaagctgctggtgaaacttagttattagaaaaggtcctcccattaaaaaaaaaaaacaaaaaacttacatgtcttcactaccttaggtcttccaccagggtcaaggagaggatcaacagagatgatgggaaccaatcaatcaggttggcgcctgcagtctggggcaggcagcctgctatacccactcttgccagtagatggcagtgttgtcttatcaggtgcctctcaaatcaagagagactctctcccacaaagggaggttctggaagggtccccacttctctgttccttcctgggtaactctgtcttaagagttacccagtggggccaagtcagcagccaacctgcacttagtggtttctccggcagtgtttttacctggattaacacaacaggtaagcaggcaccccctggaaggggttgcctagctcattcttggttgtgtctagcctgcaacctctctatcacagtgtgctaggctggtcagtgtgtagaaagttccagggatatttcaaaactcttcctaaaatgcccctgtgagtgaattgtttctgaggacactttaagttccagttccagtgttatataaataaggttcccaggttagctcataaaaccctgctcgtttatagaagacaaacttctatataattatatataaagacagcaaagaatagttctgaagcctgtaaactttagctcttattatatttggcttgccagcttttttaacgttttaaaaatatttattttagaattacttatttgattttatgtgcccaagtgttttctgtctttgtatatgtatatacacaggcacatgcttggtgcccatgaggctagaaaagaatgttggctcccctggaactggaattacagatggttgttagctgctatgagggcctgggaaccaaacctgagacctctgcaccaacagcattcgaaacttttgcatgctctttttcctcactaggagatatgaagagcctgttgtaaggctggttttctgtgaattgtcaagaggactatgacagatcatgggtggaagagagagaaaggctggtgaaagacaaggaggttgctggagtgtgggtaaatccatgccttcctccataagtttcttttttgatttctagaacacaaagcatggttttccttcattaatgacacttaacttgagcacttaagccaggctcagtgctaagtggtttttcttttttttttttatgtatttctccatttaatttctgaagataagttttaatatggaggtaacatcacaggcataaattacatgtgagaactggtgtgggtcccaggatctggacagccctagtcctcagccccagccctcggtgctcagggactctcgtctattctgccaataatagcctcctttctccgctcacccagtgcaacactttgccagcctgacttgatgccagtcttggtgggtgtgtccctctgggaaagcgacaaacacattatatggttgtggtttgttcctttaggccagttgtgacccttcaggacaaatactgtagtatgggctcagtggacttggcacctcgaaagagctaaaatcctttgatatgcatgccctgccattactgaataaatcgtgatgcttggccccatgggaatctgaaaacaattcaataagttgaacctatgaccgatacagtaagttgtccgaagggagttttgttgctgctgctgttcaagcttgtgtgcctgtgactttgaattcaagaataatcttaagggcaaagggcaagcagccagcagagtactccagttgagaatgctaatggatggttgcattgcgcaactctgtcctaacgctccgagtgtgggtgagcctgagcaggcagagttgatggagctggaagggtggtgagccaatgagatgcctgggagttgcactatcgcctctgggcggcccctcctctgcatcagaaactttcacaatattctagagacttgaatagcaggttgaatgaaaattctctgtcccctggttgtcatagctttgtagtgataggagaaaagctgaaggatcagccgaaactgtgaaacagcctgccttgggcaagacaggaagtgtgcagctgcgccgtgggtcttccttctcaagcttccgttaaacagcgcagctgttcactaacactgaattactctttccacaagatgctagcctctgccattcagggtggtgttcctagccatagggtggctattgagtgcttgaaatatggctggcataattgagctctggacttttaatctaatttaattttaatgaacagagccacatgtggctaatagtaccagattgggcagtgccagtcgggaacatttcaccatcttgtttctgttggcccgcactctaggtaagcattgttgggaaaggaatcaagagcatccaagtcatttcattttctaactagggcaaagttgtggttgacttagaaaaaggataaatgtgcttatataaatacatgcacatagacacaggtatctgtgtcccttggtcctttgtttcttagcaccagattaacccaaaggttatttcttccttttcctatgaaagacatggacttcagtggagaaatgttttctaagtgtcgccagggaacatcagtatgttttctgcagccgttgttgctcagttcagcttccaaagtcgcctgctttgcgtagaagggagagatgccacatttctggtcctcagacctgagattctaggaggccagggaccaggcaggaagagcctctgcttctgtcaattctgtgtgagaataatatctcagcggtaagccagtgactcaatccaacgtgcgaggaggatttcattttcaaaacatttatttaaataaacttttatatgtatttgaattttacagaaaacaaaacactgacaaatactgtacagcttcgatcattcatatgagcgattcatttcttgaaaaagtgactggcttttctttacatcttcctgttctttttcctcttcccaagaaatcaaaaaaagtctattggacactggataaagacccctctgactgtttctgagtgtgactaaggcaggccagaagtccagtgtgggtggggacaacccccatgcccaagtccatgccagttgagaaggtctcttctttatgcatcttctttttaaattttcgaaaaagatttattttatgtgtatgagtggtttgcctgcatgtatacatgtgtaccacatgcatgtctggtacttgggtcttctacagaagcaacaagtgctcttaactgctgagccattcctccagccccctggggcctcttaggttcttcatgaacttactgtccccagatggatcaggtaggcacaagtcccaagcaccttaccctaggactgtatccgtggcaactctggaatagaccaagggaaacagtgtctgtagagtcataaaggaatgaattggcatgatgcaaggagaagcagtaatatgagaagaattgtcagggtgaggcagggcgacagggcaccaagcaatactttgggcttctgctctctggtgtctatgggagggcctatcacttcatgggccctgtatcatcctaagtgctctatcaaggctgtcggagagtctgcgacaggaagaggtgatccagtcacggttgggattccaggatatagaagcaactgggaactgcctttctggatggtttatgtcaggaactggctcaagtctatttggttagaaagcagtaggtacacttgtgtccagagtcaggggctttgttatggcaatcagggacaactgactgctgtcttaattcaaactggcagccagttgtcacggaaaccgtgtaatttgtatggtccctgattccggcgatccatccttgcagactgttatctgacatcccatttctgctgtgtcttcacctctacccccaagtcttctgtcttagggcaactgagagaagtgggaagagcatctggtgggtaccaattggcagagaaggggagaagactggtcattctgtgacatgcggaggacagccaggtaatccacaaccagctccctatgtgacaagggggcagagaatcaggaagtgttgctttggtcaaagaggcctgagggtggaaggcttgagtgcctagtggcattgaggtgatgtaggatgagcgggtgaaatgtgactgctgtctgctagaaggcccaggtagccaccattaggtagctaccctccaagggcctggagcacatcgggagtagacatgagtaccaggtggcccagctgaacgtagggtacaactttacattcatagagtctcatcaattttgggaattttttcttgctgctgtaatgtcataatttggctatgtcattaattagacagtgatttttctactgtctataatggtctccatggggacaatatttatagagctccccagtagatgtgcaaatgagccgttggagtataatcgcttccaagctgggaattctctgcttttgtaacatggccacaatacaatcaaaatgccaagcaatttgttttctttgactggggaggaaatgctctcctccactcagaaagtggcatggcttcaggtaccacagggcacatatgtcaatcaaccctggtctcaatgccttgcctcaccttctgtagcagttaatggcgtgtcttaaaagagtaggtcacccaggttgaattgtgaagtattacaagttattcttagcatcattgcatatccatccacagttatgagtacctactgtgtacaagacatttgcctgagcatcaacataaatagcaacagatacctttatagttttatctttcatttaaactatggcttctacctcccactggcaatacattatgcactgctaccaacacgggattgcttctggtatgtgttgtgttgtgtatgcgtgtgcatgtgcaagtgtatgtgtgcatgtgtgatggttatgagactggacttgggatgatcttacttggtttctttctggaagcccttggtcacacggattatagctagctcatgcgaggcatctctccttacgctttctatctctatattacatctcgtgggtacacacctgcaatccagtgaagtgaatatgtgggtttccatagctttctcatagtcactgccaagagctgttcatcactgcttagaaaagggcaccttgctgagtagttatggggtaatgtccccgagaggtcttgggccacattagacatctgttagaggtaatgaggaccttgtcgtgaattgcaagcaaagagctttgagtgtatctggagccatactttaaactttcaggtataggcaaaaggtcagaagcatatagaaaccactagctatgtctgtatcaatatatactgaagtggggactgtaccagggtcttagaatgtccaaatgtatttccagtaaaacattatgttaggaatagaacacacccatctccaacctgaatgatatacagacagtgcatagggccttgcaccatggcttcttaattgcacatatgtgcctaaatctggacatatcttctcataacacatttctgcaagtatatatatttgagcaaaaatatatattacatggctgtgtgataaatagaatatcctgtcccatgtacctgttgtccaaatgtgcatacatatgatacagagttgaaagccatctaagatgcatatgtacatactttctgtgcttttgtgctggagtataccagaaactgctgtccatgcttggggcactgatacgggacacatagctgccaagacagagtaagaattgtctacacgccgcccccatccattgggatgcgtagtctgaaatttgtcccttagttgagtgatctgtgggagtgaatgcatcacgttaaaggctcctccaagtctctgtggttggaaggaggctcggctccaaggggaggacacactgcccccttgcttactagacaagcagtgatggtctcttctccatctggaggagcttgggctgagcagagatccagaggtcttcatctttctttttcttcttctttttctttttcttcttgttctggtctggctgttggttgctcttaggtggccggctacagcagcaatggcaacagatgaagaagagggtgagaaccaccaccaggggcaaccccaggagcacagccaggcagactgtgttgaagacgcctctttcgtgtctgatccggatggtttcccagacagagttgaagaaagaactgtttctctccatggtgctggtctagtgtggggccagaggatcgtcaattatctaacaagccctcggtgtcacagaacacagtgttagacacttggaatttatttttctctcagcttcacgtttgggca

SEQ ID NO: 2018 - DNA, 3375 bp, Mus musculus
atgctcgccttccccctgggatttctgcttgcttctgtgctcctggtggcttcggccccagccactccagagtctcccggctgcagcaacaaagagcaacaggtcactgttagccacacctacaagattgacgtgcccaagtctgctctggttcaagtagagaccgacccacagtcactcagcgatgatgggacgtcactcttggctcccggggaggatggggaggagcagaacattatcttcaggcacaacatccgtcttcagacaccgcagaagaactgtgacctggcagacagtgtccaggacctgctagcccggatgaaaaagctggaggaagagatggcagagctgaaggagcagtgcaataccaaccgctgctgccagggagctgctgatctgagccgtcactgcagtggccacgggaccttcttccctgagacctgcagctgccactgtgaccagggctgggagggcgcagactgtgatcagcccacctgtcctggggcttgcaacggccacgggcgctgtgtggatgggcagtgcgtgtgtgacgcgccctatgtgggggtcgactgcgcctacgccgcctgtccccaggactgcagtgggcatggcgtgtgcgtgcagggtgtctgccagtgccacgaggacttcacagcagaggactgcagcgagcagcgctgtcctggcgactgtagtggcaatggtttctgtgacactggcgagtgttactgtgagatgggctttactggccccgactgttcccaggtggtggctcctcagggcctgcagttgctcaagagcacggagaactctctgctggtgagttgggagccctccagtgaggtagactactacctgctcagctactaccccctggggaaggagcaagctacaaaacaggtccgggtacccaaggagcagcacacctatgacatcaccggcttgctgcctggaaccaagtacatagtcaccctgcgcaacgtgaagaaagacatttccagcagccctcagcatctacttgccaccacagatcttgctgtggtgggcacagcctgggtaaatgaagagactgagacatccctcgatgtggagtgggagaaccctctgactgaggtggactattacaagcttcggtatggccccttaacagggcaggaggtgacagaggtcactgtgcccaagagccgtgatcccaagagcagatatgacatcactgaaattgatggaccaaccaatgtggtcacaaatcaggtgacagaagacacagcatctgtttcctgggatccagtgagggctgacatagacaagtatgtggtgcgctatatcgcccccgatggggagaccaaggagaaggcagtaccaaaggaccagagcagcaccgttctcacaggcctgaagccaggagaggcctacaaagtctttgtgtgggctgagaggggcaaccaaggcagcaagaaagcagacaccaaggccctcacagaaattgacagtccagaaaacctggtgactgaccgggtgacagagaacagcctctctgtctcgtgggacccagtggaggctgacatcgacaggtacgtggtaagctacacttccgtggatggagagacgaagcaggttccagtgaagaaggaccagaggagcaccgtcctcaccggcctgagtcccggtgtggagtacaaagtttacgtgtgggcagagaaaggcgatcgggagagcaagaaggccaacaccaaggctcccacagacatcgacagccccaaaaacttggtgactgaccaggtgacagagaacactcttagtgtctcctgggaccctgttcaggccaacattgacaggtatatggtgagctacacctctgccgatggagagacgagagaggtcccagtgcctaaggagaagagcagtactgtcctgactggcctgaggccaggtgtggagtacaaggtccatgtgtgggcccagaaggggacccaggagagcagaaaggccaacaccaaggcccccacagtggcatccagcaaagagcggtacaagctgtcggttgggaaatacagaggcacagccggggatgctctcacctaccacaatggatggaagttcacgacttttgacagagacaatgatattgccctcagcaactgtgcactgacgcatcatggtggctggtggtataagaactgccatttggccaacccgaatggcaaatatggggagaccaagcacagcgagggggtgaactgggagccatggaagggacatgagttctccattccttatgtggagctgaaaatccgcccgtttggttacagcagagaccgtttctctggcagaaagaagcgctccataggaaaagcaaggatgttctgaaggcttgtctgagctgtcttcacaggagacaagagaaacttggggttggcggggtagatggtgcctaggaagctgaagtttgagggatgctcatagcctccgacttcctagattgctgggtacacagtgctaatgacgtcatcacactttgacctttagaggttccttccatgtcatctgcaagtttgcctgtctctactgagggcttcattgttggctttcaggagccaacaatgttgtaactgaacagtacatatggatagaacacgtgttggaatcacaaggttttttcagcccatccttaatgacagatgtattgaattagggcaaaaaggtgaaccatcctgtagaccatcaattggaaatctttagaaattggtggatatctctgtatccatctgataatatagatctttgtagaaaaaaaaagacaaagtgaggttctgatcccctgggtgttagagctgaggtgacctgctacttcttgtctctcccggacctcctggtgtttgaaggaaatgtttatatcttactccttttaaacttcctgtgtgatgaagaatgaagagactacaaaggggccacgatgcagtcatagttaagttctgactagtctctagcattctagagaccaaagctcccattttattgctatttttaactgccccttttccagacatttgcataagttctttcatagatctgcatatgttgtaaataaatttgcagtcatttaaactttaaataacccatctctctaaataactggtcccctcagctcccccccaccacttcactcacctccatgcctctcccctctcccgggtccatcagccctcagcctccctccttccctgctccccacactggaagcttcctcacatcatctttcttgcgtgtttggtgtcattttggaaagttttctgtaaccaagtcagtgacctttgaagtaacttaaattcctactcaagaaaacacaaataaactgtttgatttttaaaaagc

SEQ ID NO: 2019 - protein, 789 aa, Mus musculus
MLAFPLGFLLASVLLVASAPATPESPGCSNKEQQVTVSHTYKIDVPKSALVQVETDPQSLSDDGTSLLAPGEDGEEQNIIFRHNIRLQTPQKNCDLADSVQDLLARMKKLEEEMAELKEQCNTNRCCQGAADLSRHCSGHGTFFPETCSCHCDQGWEGADCDQPTCPGACNGHGRCVDGQCVCDAPYVGVDCAYAACPQDCSGHGVCVQGVCQCHEDFTAEDCSEQRCPGDCSGNGFCDTGECYCEMGFTGPDCSQVVAPQGLQLLKSTENSLLVSWEPSSEVDYYLLSYYPLGKEQATKQVRVPKEQHTYDITGLLPGTKYIVTLRNVKKDISSSPQHLLATTDLAVVGTAWVNEETETSLDVEWENPLTEVDYYKLRYGPLTGQEVTEVTVPKSRDPKSRYDITEIDGPTNVVTNQVTEDTASVSWDPVRADIDKYVVRYIAPDGETKEKAVPKDQSSTVLTGLKPGEAYKVFVWAERGNQGSKKADTKALTEIDSPENLVTDRVTENSLSVSWDPVEADIDRYVVSYTSVDGETKQVPVKKDQRSTVLTGLSPGVEYKVYVWAEKGDRESKKANTKAPTDIDSPKNLVTDQVTENTLSVSWDPVQANIDRYMVSYTSADGETREVPVPKEKSSTVLTGLRPGVEYKVHVWAQKGTQESRKANTKAPTVASSKERYKLSVGKYRGTAGDALTYHNGWKFTTFDRDNDIALSNCALTHHGGWWYKNCHLANPNGKYGETKHSEGVNWEPWKGHEFSIPYVELKIRPFGYSRDRFSGRKKRSIGKARMF

SEQ ID NO: 2020 - DNA, 89625 bp, Homo sapiens
gagggtctctgctcatttctttctgtgctaaaggctttttcccattttaaaagcagtaggcaggaagtcccagaatgcctgaaacaggaaaaagagaaagaaactttataaatgcacttttgaaccccgagacccagctcctggccaggagacaggcaaactcttttaatatccttattctggattcacttaaatggaaacagcctccagtatttttagctgctgtgtaatcaaagtgaaaaagaagaaggaaatgtatatatttttctttcctagttagaataagagaaggaattgctcattatcttttagcagagtccctgctaggaagggaggaaaacaccaggagtctccatttgctcctcctctggcctagacaggatttaaacccaggaagggaagccaaggagagacgagaaccagggacgaccagcaagtaccaaggtctgcggcaggaggagaccggctcacaggagcagcagcattggaagaggcacccagcagcctcccaggtaagagtgccagttgcccaagctttacttactggagggagggaggtggccaatgcagatgagctcaaaagtggtggctcaggtgcctccgttcccgagcctgaaaatccgggcagtgtaattagtctcctatcacctccatgaagagttaaaatgaattgggaagtacctctcaggacccgtgtactgcatccttagtattatactccagtctcagacagggctaagcatagttatcctctttcctgcaacacagatgcgtctgtgttgtatcagcttctacctggcgtaacacatttttgtataaaatgtttcctttaagatgttccttctcatttttttttctttttaacttacttacaatgtcaaagctttctctctctctgtctttttttggataatttagtattgttgtatttcattattcttttaaatcctaaaacagaattgttattttagttatgattaggaagctatgataactttccctttgtctggattttgtgtgaatcagttaaggggatgtttgcaaacacatttgaacagctttgaagtatctccagacatttaattttacaggttttaattattatttgttaagacgacaacttctctcgaaatccccatactattaccctcacaatacctcaaagaaaacatttcaagacatctaaaaaaatgatgtggttggccgggcatggtggctcatgcctgtaatcccagcactttgagaggctgaggcaggtggatcacctgaggtcgagagttcgagaccagcctgaccaacatggagaaactccgtctctactaaaaatacaaaaaattagccgggcgtggtggcgcatgcctataatcccagctacttgggaggctgaggcaggagaattgcttgaacctgggaggtggaggttgcggtgagccgagattgaaccattgcactccagcctgggcaacaagagcaaaactccatctaaaaaacaaaaacaaaacaaagcaaacaaacaaaaaaaactagtttttggaggtcttactttttacttatttattaatttttgtgcttgggagagatctgggggaaggatggagaaagaatgaatgagaacaggcagggcttcacttaaaagcatgaaacctgtgttgcttatataagcattaaaaaaaagaacaagttccaacataaaagtaacaaactgcccacattgggacacaggttagccacagtgcctaaaatccactggttcttggaaaagctgaggtgtcaccaaggcatcagatgataccttgctcggtcagggctacgtattggcagctggcctcttgacattcagacatttgttgcagactcagaatcaaggtgacagtgtcagacacaggaaaaaatagagtatcaatactggtatcatttttccaggagagaagggaagaaggcacctggcattctttcatacaactctaagtactgctttgtccccagtttataggctgcagctgactcccgaaggagggaaaatagaacaaatgatttcaaatcatcccgtggcttctggttttccagtccagtgctgctctgtggtttgaaatgtagggtgggcagagctctctttctgagaagatgcctgaggaaattgtgcccaggcccagtggaaacttttgtccattcactgctcattccagagccttggctcctataggatctggatacagacatgagatcatggtttaggtcctgtagccacatctggagccaccagtctgtgagcagaggttgctaagatctcaggcctgatctctggatggacagggactttgctgcttctgccacagtggactcactgctaatgctgcccagccaccatttgaatctgtacccagcgagtgtgagtggaacagtgcaaatgcttggaaattagcaaacgctctcctccttgctagaagactggaactttaaagttacttcaatatgtggaaaacaacacgttagctaaagaaagaaattgcagagttttttgttttgttttgttttaatctgacgcccctcacacccatggatattagggctaattgtatacaaagtaatatttagtcattctggggactggctgtttggttgaataagggagaggaaggttcctgaatttaggtcccgtgtctattttatcttgttattgtgcatgagcttggtcccacaaaagctaaaggaagttcttgctgtgagaaagtgattcattctctgggggtaaatgaacatctttgcctgatgtccaagaggagattttaaagtgctttgcacagagcctggcatgtaataaatgcatagaaaatggtagctaccattatcatcactcatttgagcctttgcaaggcagattaagagtcagttgtcaaaacaaaacaaaatgagcctgtggtcacccctgaaaaagtgattgagtgctgaggctgggtcaggacaccatccttgatcttttcaagcctcaggcgggtgggcagacttgatgggatggctctccaggaaaagggttctagcacggtggtgtgagagtcatctccaaggacttcctggacactccctgggtatcccacagaactaggagaatggggggacagagtgatacccagaatgtgaccatactaagccctatcacataaaaccaaatttccattctcttccatacttagctgtcttgtatcctatatgcaatcctatattcaacatcacagagactagaaataaaaatgtttgtatgtacttgcttctactggagtttaacctaggagagacagacctcccttgtatatccattttcttggatctgaaggagaaagagatacagaggtgaaatcggtcccctaagcctctagttcaaggtgagttgagccagggtagattcctcagccagctgagaacttgctgtcctggaccaggttacttgggaagtacagggaaggcccctgagtcacccagggcccaagctgcagatcattagcaatatatgccaaagagagttaaggaaggagtgacaagtttgccagtgacatttgtgacattgatgcatccctagccactcatctccctcattttccttcatagtttaatgatatccaccctgtcatttggggacagaatatcttcttaagtgactctgttggaaatccatgatgatacactttttctaaaacccaaagcagtgctttcattttcctgtggttaactgtcaaggcaggatgagataataagggaaccagagaaagccctgaatttaagtataaaggtctgtaacagtggctagaaattggctacctctcttctttggcgtaagtagtattttttttttcctgacccagggtgtgtgtccttctttggggaaaatgaggtgacacagaaaccatccacccctggggtccaagaggaccatcaggattcaggggccatcctcctcccttggccaaggcttggatgccatctgcccctgcagacagaagtatctgtgcactttggtgtttcctaggaagggaattctccagcttctcatgagaattgactgggacttaacctctatgtgagggaaatgcaattcatgtccccagtggatcatccttggcaccactcagaggaagtaaccctctcttaaaaacacatggcagaacggaggacatctggtgttttttttgtttttgtttttgttttgtatatacaggacatataacagacagatgaagaacacagacgcaggcagtggacagacctggtgtgtgatcccagctctgctgctttttagctgtgtgtcctttggcaaattacttaacttctctgaggacctgtcacaaagaatgatatcaactgactcccaggactttgaggattaaatgaggataatttttatagcgtttggcacaatgtccattatctaataagcacacatacacagacacacacaaatccagtggctattactacttacttcacaaaatattactttggcaggactgtgctatgaggctggtgatacagaggggatcaacacagtcatggccctctctgtcatctctgagctcacaaggatacctgggctagaaacacgcatacagatttggcaactgtcaacatttggctggaaattaaagccacaggggtagatgcagataccaagagagaacacagcagaagcatagagccctgcaacatctgaaggcagaagtagggggaccatccatgcagcccatggtcagtcgtgtactcctcaaagagcctttctggtaaaagcaacacaaggcagcatttgttcctgagtctaatgtatccctccctcccaccttcccacaccacccaacaccccttctgcagtcagaattaaagacatgaccagcctctgtaagacaatgattcttggggacaactggtttcctgtggttcctgcatacacatttcctgcatgtaaatgcccttcgcttcatgcatccctgcagaatttacccaactttccatgggaaaatacccctcagcagaataatcctccctatttggaaatgtatcatcctgcgttttgctcagaaaaatcttctgccctgtctgccccctccccaccctcgcggagctcagcctgtggtttgctgtgcatactgaaagagtcgatgaagtcatccttcccttctgctgttaaacaaggagtctctttcctgccacgtgttggagtgagagccagcaggcttctcttcttgctcattacacttgacagaatgttaggttgaggatttcccttgctctcatcttctttcgaacaatcaacctacccaggaaaatctgagcgcaacttgtggaatctgagaggcagtaattaatgaggacatcttgttacaaatcagaaggacaggcaacaccaagggctccaacagggacttgtgggagttctcatattccaggctacaaaaacaaatgctgtagacctgggctctgggcagccttactgtggttgatggcaagagtccacggcttttttttttttttttttttttttgctttcgttgagaacttcttcagaaaaccatctgcacttcatttatgtctcaggctgggggtggggggtcggatggaaagcacgggcagagaagtctgctttttcagccctatttttgcccaggaagaagatttttggacagtggaaactcatgtgctgccatgaacacagtaggtgctttagagatcaatatgcgttgttactggtgaacggcagaagtgtatagggattagtggctccattgctggacactgtgcatctgggattgcatctgtggccgtgtgctcatcaattgcataatcagttgctcaatgccactgagcctcagttcctatcctggggatcaagtggagaatagcgtgtggcttttatctttgtgatgaacgtctaaggatggccgttgtgaaatatcattatttttatcctacacctgccttccaactcattttcctggcttcccactccccccatcttctgacaaaaatctcaagcagattccagagcttttctggtggcttttggtcttagaagagaattgcttttgtgaaagcaagtccatttcagtattgagcctcagtctctcatccaggccacatcttttcttctttctcagctcagacctgatgctggaacctgcagagaagctggagggaaggggcttggggctttcctccctccacttctctctccttaacatgcatggctgcttctggcttcaccagtttgctgctgcctggggcgaggtgagggttagaaaagaagggagagggcacttttactttactggggctgttgtggttccctctgttggatgcccttgttatggtgaatgcttccagtgctgggccacccctcctttgtggggagcttctgtgggatctttagatattccccttcccacccactgggcatgtcctgctgcagtcgcccccttggggtggcacactcctgctgaacggtggacctgcacctcagctcgggccctgaactgccctcttggtagctctaacatgcctcatttctgtgacatcaacttggcctcgccaaagtctgagtttcagtcctctcacactgcagcccccttcctctctctgccatgcagcctgttccagccaagcttccacctgtgaattcctccgggccagaatcaggcaccagtctctttgcctgccacccccactaattcaccgtgaccccacccccaacccccaaacctccagtggcacactgtctttgaaatgtgtgggcacggccaggtgtagtggctcatggctgtaatcctagcactttggggagctgaggtggacaggctgcttgaacccgggaattcgagaccaggttgggcaagatggtgaaaccccatctccacaaaaaaaatacaaaaattagccaggcactgtgacatatacctgtagtcccggctactcaggaggctgaggtgggaggatcactggagcccaggaggtggacattgcagtgagccgtgattgtgccaatgcactccagcctgggcgacagaatgggatcctgtctgaaaaaaaaaaaaaaagaagtgtgcaggcacttattacccatggtccaagtcacaagacaacaagaagtgtcccattgactattccattccatctgccgggtgttgagtccagtgcctgaaatgcagtcagttctcagaagaagtgagcttttattattatcaacaatacatgcttttggtgataggaagagccatgaaggagtgggagggcaaaggggtaacacaaagaaaaacccttcataggtaccattctgcttaattcacagtggtgtcacatcccttgggtacaacatgtataatggatgaaagcattgcatagggacatgtatctaactgcgctcatttgtcatttgtatcagaatgtcatattggcacagagcaagcataggcttgcaatcagatgggtctgcgtttgaatcctggctctgccacttcgttgttgggcaaccctggcaaatgactttacctctcagatctggtttccttaccttttgagtgaggagaggaacactgaccttacatggcagctctggggattaattacgaggaataatgcacccagccaatgcctagtgcgtagcagcaactcagtaaataacatttagcatttcatgctattgtgattcttcttcttcttttattcttccagggctcttcaccccctgtttcctcaacttcctgatactaaatgaatgatgactattaaaattaaacattttacatattactagaatttggcttagtggctagaaatatttcttccttttataatcaatatagttgaaagatgcctttcaacctaggcgttattattattatttgagatcgagtcttgctctgtcgcccaggctggagtgcagtggcatggtctcggctcactgcagcctccgcctcccgggttccagcagttctctatctcagcctcccaagaagctgggattagaggagtgcaccgccacacctggctaatttttgtgcttttagtagagaaaggtttcaccatgttggccagactggtctcgaactcctggcctcaagtgatcctcctgccatggcctcccaaagtgttgggattacagatgtgagccaccgtgcccggccagcattattctttatagcagaacagatgaggaagaaaaggaagtcacattcagtaaatcgattgaaaataaaataaacctcaaaattttgactaatccttgctcacataccagacatagtgctcactgctgttcacatctaagaggggtgacgcgctgtcattcccacgttacagacaaggaggcggaggctcaggatgaggagcatttttagggatgcacatcctacagcctgtctgaggtgcctttccaccatatcccaactgcctctcaccacgggcagggagagcctgtgctcaagcaaaacacagaccacaggagaggactgtgtttcctgacttcaaattttggcataaataattgcaggtcttgggttagttacagaaacccattgtcaagagacagctctgcagatcactttctagataactgctgctatgcaagcccaactgggatgtatcttgtgactgaggttcctgtgagcaaaatgtgaggtgaaagctgggtctcttgtggtctgtcctgcctcagcttgttagtgtgcaaagaatgggccgtcctagatgggggttgggggcacaaggggaaatggctggagagagtaattctgctcattgacagtggtgaagacaccacctcctggtgaaggaggaggaaaaacctaaccacctgccccatctcaggtcgcctggcttgactgacaaaccaggccacccatgcacggatggatttgagaaacagtgaccaaacctctccgcatgtgtgacagtgctcctgccacaggagggccccaagatgaatcagcccagtcctgtccttaacaggctcacggcctaagacaagctgcatacaagagtaactgtaacaccaggtcaacgctcaagagaccagcagtgagggacaggtccatttctctgaatgcttagcagaagtgaagctagtctccagctgggtaaggcagggggacaggagagaagactttgtggagcaggtaattttattagaaattcttatgttttactggttcacaagtgagtgtcgtgagcaggatgctggccctgcagtcagtggacttgggtctgagtacaggttctgctcttcctggccgtgggactcaggacaacttgctcagctttctcatctgtgcaaagcagcatggcattgtggggatcagcatggactctggggtcagattgcctgggttcaaatcctgccactctgagctgggtgctggttggcaagtcatttaaagtagtagtgcttcagtttccatatctataagatgggggtcatcatagtatattccaacaaacaattgtgagaatggaatgagttaataaatgtgaaacacttagaacatttagaatagtgcctgtcacatagcaagtgctctatgtgcagctcatattgttgatgttgttaaaagggaggataatattagcgttgctgtaaagatccagaattagggggatcaaagcgtggcacacaataggctgtcaacacaagagagctgctcttcttattattaataagtgcaggtgagcctagaatgagaggtgaagagaagggcatcctgggcagtgtgaacagtaagcaaagagaggaggcaggaatatgcaatctgtgaggcaggaacagaaagtaatttggttcggatccttgggagaaatagaatgagttctttctgctggtttcccagcttccttgggctcttagaatctggtaaaaaaaaagccagcttccctcagcacatctccgtggctttcttttgcaatgtttctgaatacaggcatcctggagggtctgctccctgtctttccaaggatgagtctccaggagatgttccgcttccctatggggctcctgcttggctctgtgctcctggtggcttcggccccagccactctggagcctcccggctgcagcaacaaggagcaacaggtcactgtcagccacacctacaagatcgatgtgcccaagtctgccttggttcaggttgacgctgaccctcagcccctcagtgacgatggggcttcgctcttggccctgggggaggccagggaggaacagaacatcatcttcaggcacaacatccgccttcagacgccacagaaggactgcgagttggcaggcagtgtccaggacctcctggcccgggtgaagaagctggaggaagagatggtggagatgaaggaacagtgtagtgcccagcgctgctgccagggagtcactggtgagctcaccacctggtattcattcaacaaacatttgatgagcacctattatgtgccagggtttccactagcctcatgagcactttgtgactctggtgtgctcctacttctcattctgggttttctctagggggcccatccctgctatttattcatttattcactggtactagctccagggggcatctggaagctgagcagggagggaccagcagctcttgcagagagtctagactcctggcctattgcttccagatgggaatgcttccaggagccgtcatacctgtgaatcaaagcgctactcagagaggaagcaatgggatacacaggaaagatagggccttggagctagacaagacaggttacaaatcccagttctaccactttttagctgtgtgactttgggtaaatcccttatgtttcctcaactgtccaacagggatgattctatcagctagtatagttctgagaactagagatgatgtgtagaagattcctggcccttagaggaatttacaaatcagtaaattataattattttattagtaaaaattacaattataattgtaaaataattacaatttaattttacaaataatgaaggttctcccccaacgcaaccccgtcacttttaaacataaactgcccaggctgatccaatgataatgaacagtactttggcataggatttcatgcctgaaggaattgctatggtaaagagcaccttaaccatcagatccagatacagaactcggcaccagggacactgccatgaataaccagcatggacttgcttctgaggagctcccactttggaagcgtttttaggaaggaaagaaggtgttctgaaaagcagaagctgggccacagaggagactgcactaaccagtctgccctccagctgcctcttgctgtgtagggtcagagaggggagcctggttaaatcccttctccactgtacccatagttgagagtaggctattttgtagcttctgcagttccgttttttccagacttcaatctgggctcatttcacaaggtcccagccttgctagttccagcaaactccaacctccctggatctcactttccccccaggagtcctgccctgcagtgtcagctggccagggtggagcatttaaggcccctccataggaaggcactaaataatgaccaccaggtagagaggaaggaaccggggaattcacacgggaagggaaaggaaagaagggtgggtcctgcagccttttcaggcagagaaagaaggagacgtttgcagatgtcacagattagaaagcctggcccaggctggaaagggccaacaccttttctcccttgtggagctccaccatcctccaaaaaatagccgtgcaagacccagaaatcaccagacccttaagagtggggctaatgatttctgggtcttgcatggctgatctcagaggaaggagatccccacgcacaacccttcaacccaacctactgtttctcctctccctcccagatctaagccgccactgcagcggccacgggaccttctccctggagacctgcagctgccactgcgaagagggcagggagggccccgcctgcgagcggctggcctgccccggggcgtgcagcggccacgggcgttgcgtggacgggcgctgcctgtgccatgagccctacgtgggtgccgactgcggctacccggcctgccctgagaactgcagcggacacggcgagtgcgtgcgcggcgtgtgccagtgccacgaagacttcatgtcggaggactgcagcgagaagcgctgtcccggcgactgcagcggccacggcttctgtgacacgggcgagtgctactgcgaggagggcttcacaggcctggactgtgcccagggtgagagcggagatgtgccctcgggccgccggactcttctttccaatgcaccatttaaccctcaattacacgttgtcatctttgggggtctcttcctttagcctacgccagattgctgagtcccaaccccagagtttctgattctgcgatggggcctaagaatttgcatttctaacaagttcccaggtgatgctgatgctgctggttagaggccctaaccttgaggaccactggtcttgtgatctaatggctgtgtgtgagtgtgtgtgtgtgtgtgtggtgagggggtcagtattaattacctgtcgttcggataataacttctaggggtcgggaatggcgccttacacaggtctgcatcctgcacacccacccttatagtgctcagggaatactcactgggtctggatcgcctcccttgctcaccctctctgccctgttcctgttctgcctgcagtggtcaccccacagggcctgcagctgctcaagaacacggaggattctctgctggtgagctgggagccctccagccaggtggatcactacctcctcagctactaccccctggggaaggagctctctgggaagcagatccaagtgcccaaggagcagcacagctatgagattcttggtttgctgcctggaaccaagtacatagtcaccctgcgtaacgtcaagaatgaagtttctagcagcccacagcatctacttgccaccacaggtgaggaagccacctgatgccccagggttcccaggagaggccccattctaaatggtttctttcattaaacacctgtaggcagttgccttgattaggggtttgaaaaacacacctgccacaatcctaggttctgaagagtcccagttctctctcttctttccttgctccctgattactgggttctccaagcccatgaagacctgctagatgggggctcatggggtcttctctgtccctgagattatttgggtctgcaccttctcataagcagtcaaagtgtagacatgaatccccagtctcttactgaacccccaaagccattcagaaagttcagataggtatgggtgagaggctgctgaagccacctgtatcagttagattcatcttggtgggaaagacaggacacaaatggggtaaatgaaatttcaaagtttaactaacagattgttcacaaaggtgtgggtaggggttggatggtgacacactaagacctgcatcaataaggatactctcctgcctgaaggggcaagggatagatgttggtacttggacccagagagagctgtagaaaagagctgcctggtagggttgttttggtagagggatgcaggcagtccaccgtgtctccaaagaattctgtctcctgccctctgatctgctggtgattcctgctagctgaacctggaagccaaagggtcaggtaaacaggcagactcaattcacagagatcacagcctggggtacagaacaagatggaggatggtggaggcttgatctggagaaacagaatctcctgtgcaccagcaaatgccaccaaaatgtttagaaggattagcatcactgcttactctttaaacattcttgtctcctcgtgaacattcttaaagcagcttagatcttcaaggatttggagaaacgtagttggttgaatgactaactcattccttcacacagtacatttttattgagcacttaccatttgtcaggcactgttctcggtgctaaaaatgcactgcctccatcctgccctaaacttctagggaaagatctaggaagatacagatggatggaactttggcatgcagttgtctttgcagagacatcaagctgcctgtcctttatggtggtgggactagggtggaggtggggatgggtcagtgttggaaagggctgtgagagacttggccatcatgaggtcaccatatgtgattacctttgtcagtgccctcaagctaaagacccccaggagcacccctgtagttgaacaacttgggtgtcttgattgttctagcatgggtgactgcacactatgggggaccatagaggtatctcagtaagacagcgttagaaaggactggttagagaatctgggcctgtgttaggtaatttgggggaaggtgtaaggaagcagggattgggtgctgtcaagaagtggggagagcctctcccctctgagaggctgaagttggtgattgtaacagaagtggccatcactcatagtagtcaggagagtgggtgttcagctatttgtgtggtttggacaatggtcatgtttttgtctgtgttcagagttgatcatggaagtgtcttgtttttgtcttgatctatgcggtcacagagtgacctgacattgatgtcctgtgaaatggtttatgttcaataggagacaccaagtcctcactgtgggagccaggcccattctggctggcagagtctgcttttctctttttccccattttgtctgtggctgcctctggtacagctagcactgtgtccaaagcctcccagtgcagcacagagatgcctattctgaaagtcctagcaacccctcatccatcttgctctcgggatttgtaaaattctgcaagtgtgaagtttctctttctttctaatctgattcaggttaaacacattcttatttgctcctcaggggagcctaagacaagaggtactcatccccaccataatcgtgaacattctcattaagtccttgctttttcatttgtgattccctcccaattcttttacaccatgtaggaactcttatataagcctcaagtcacatttattactcacctcttgacctggccttcagggaattccatctttaatgggagtctaaaaacagcacctggcagatggaagccagtgggtgagaggaaaagcttcagagaaaaggctctgtgaggctctttatccataactgattgaatcggggacgttcagagcccagggaccttgagatcactgagttcacacctggcctgacactaattctcgatccttcatcatccgtcagtggtcagtaggcctgggtggagacacctccagggaggtgaaggtgggggcgtgactgatgaagaggggaagcctgagaattggagggccttggctttcctgtcaaaaacttagaaggccaggctccctcagcctgggatatggctgttggaatttgaagtgcttctcaaagaccctagtcctcccatccctagaaaagttctccccttagagctgtagcaatgatccattcctttgtattaatcactgtaacttcatgtttttttttttttctgagtagaagagtaaacatttagccgttaatactttactatgaataaatgtatacaataactctcttccttcacaggacagacagattgggcagcatgagaataccaggtaccagatggaagtgctaaaattggtaaaaatagcaggaagtacactcagatggaccaagttaaaattcacctactttatagttttgcctagggttcatccttagaggagaatttgagaggcaagggctgcaatttgggagatggagaaaggagcttgttggattaccaatgttgtccttgagaaagtttgaaatagattctctccactttccgtggaagtgcctgagctgcttatcctgaggtcgtcttagagggcaggggctctgcagctgaagagtgggcctttagttcagggctgtagctgtcagagctctggactgagtggtttgggtggccaacctgagaggtacagtttgggcttggccaaagtcagtgtggacagggaagaccacatggcctctgatgggatggggaagtggaggctttcccaaaagacagtctgcccatggaatatgtgaaaaccagcagcttagttgctactttggtagctcaaagacacctgctaagaactgtgtcctggggctgaagccagctcttgagatgtcaagaaagggagctgacctgataaccaacagcctgtcacagaaccttggaacctctgctcttcaccactttctcttgcctccgtcacccctgccctagaccttgctgtgcttggcactgcctgggtgacagatgagactgagaactcccttgacgtggagtgggaaaacccctcaactgaggtggactactacaagctgcgatatggccccatgacaggacaggaggtagctgaggtcactgtgcccaagagcagtgaccccaagagccgatatgacatcactggtaagagccatcactggaatgtgagatgtatgctgtggatgcagaggtggggatagtgtgtgcagagggcactggcatctgcactgctcaagtgtgcacagacagcccaggggccttaggaatcacacttgaatctgacccttgaatctgccagacataagcccacctgggaggcctgtagactctgccccagcattccagagctcgatcccagggcaccttgttaacagattatatttgtgagatgttctccaagtcagcaaactctcttgaagaccctgtctgtgtctcagaatggatttgatggtgtatagatattccttttggaggaactttagtatttgggtgttggggacaggagggaacagaaagagagagagagagattgagattggtttgttgagcatgatgcatggaaggggttgtgttgggggatgtggaggggggcagggtgcagtgagcaggggtggctctctgtctctgatttctgagctaatgctgccaagagctagagctcaaatggctgctaaggaaacaaggctgcagggatggatcaagtttggcagtgcttgaagtctgtacaattccagggctcttttttaagaaaagtaatacgcaatcatgaatacccaatcaggtacaaggccttggaatgggcccgtgaaagtgtggggcttattagcttcatggtaaattccctcctggagccttgttctgctgtccactccttgagttctgtcttgacaggacattttggggttcttagtgtttgtggagtgcagaatgagggtgtgtgcctcacacaagcttctgtttgtctgcattttaccaccacagtctgaatatttgtgcccaaggaaaaataattctagttgcttctacagagaaataacttttttttaaaaaaagggctgggcataatggctcatgcctgtggtcccagctacttaagaggctgaggcgggaggatcccttgagcccaggaggttgaggctaccatgagccgtgattgcaccactgcactctagcctgagtgacacagtgagatcctgtctctaataaaataaataggaaaaaattaggctaaatgtcacaatgagaaggagagatgctttggaaggaaaagggttgctgggagcagaaacacatttgggtctataaataaaattgggaaataagtgctaggtggcccagtgaagaaccagagaacatttgaaatgcatttcaattgctgtcatctcatttgctgtgatgccctactcccatccccagcctataagccccctcagtgacacctcatgttctattgcacctgcggggctttatttgcctgcaaatacagattcatctttggaggaggaagcatcacctctcatcttccctcacgggagaaatcccagggaggagtagtgctggggagaggggtctggagcctgcactcacatcctgcgctgcctgcttgtttccaggtctgcacccggggactgagtataagatcacggtggtgcccatgagaggagagctggagggcaagccgatcctcctgaatggcaggacaggtgagagctacttggaggcactatgggcatttaatcatgtttgcattctcatatttttcttggctgactcctctctggataagaattctgggatttgcagacagacggggtggctcacgcctgtaatcccagcactttgggaggccaaggcaggcggatcacctgatgtcgggagttcgagaccagcctgaccaacatggagaaaccctgtctctactaaaaatacaaaataagctgggcgtggtggcgcatgcctgtaatcccagctactcgggagactgaggcaagagaattgcttgagcccgggaggtggaggttgtggtgagccgagatcgtgccattgcactccagcctgggcaacaagagtgaaactccatctcaaaaaaaaaaaaaaaaaaaagagaattctgggatttacatgtagagagagtctatccctttatgtactgatgtctatttttgggcagggaaagggaagcaaacttttcctatttcaaatttttcttgccattgaaaatctctcccagggtcttggagtcaagggacaagactgtctgacaccgttctgcttattttaatagcttctatcaccgcgttgtttttaaggcatttattatctaggacataggcacatagctccttattccctaaagacaagtgatctataattttcttcttgccacacctgtgttttttcctgatgcccacattcagtagactcctctaaaatgtcaaaagatattaaaaaccctcacatgggagtagtggtatgttgtcatctgtgtattgagaaaatatataatgataaaaggttacaaatcagtcatatttgacaataagtttgtaatttattaatcagaacagaattggaaaacatggtaggcatacatacgagacatcctaggtaacttttagtttttaaaccatgcttgagcccatattgaattgtgaacttcctcattaactctgtgctcctgccttccccatgctggaaacctgtgatctagaacatagtgccactcggggagactaatccttggagctggtaaagaaggagtctttgagttttgagtcttcgttgaaaagttttttagttctttccaattcagtcctggaaatagctggttatggtggtgagaataagaggtgagatgttgtgagaattgaattcactatttcagctgcctaacagattgcttatctgcagtatgaaacagttatagttgggcatttataatggagaacatataacttaatttacaaactagacaaggtagactgtacagtctgcctgaatagtggactagggaactgttttaatgggttagaaaatggtaagtacttctgtgcttccagtggcattccctgtagctgtgaattaattgagagcttactgagtgccaggcattataatcactaagcactttttatgaatatctcatttagttctcacagcaatccaatgaagtagatactattattatttctctgccacatataagaaaactggagaagttaagctcaagattgcccagccaggaaaggacagagctgggatttgaacccaggatacccaagtctaaacctttgggcttagctactgcaaaccaaaaagtatctgagataggccttaatcaacttagaagtttatttttccaaggttaaggacatgcctgggagaaagaaacatggaatcacagaaacaatctgtggtctgtacctttctccaaagatgattttgaggacttcaatatttaaatgggaaaagtgggctgaagaggaaatagggagggtataattcccatgttggaagagaaaggagcaggtagcgggatagtcaattacgtgttgagtacatttgcacttttctcaggataaggtgaacatggagtagctacctgtggagatatttaaccttttatccggcgtaggaacaaaaggaaaggcagcttcttgcataactcagctttcagctttattttttccttttggcagagtgaattggggtcccgagttttttattttcatttcaaactacaaagctaaagtgcttcccacttttaccttcctgtaagagataaacactttttcttctcttacacagtcaacacaacacagaacatttcacctctggaagtgatttttccccatacaccagggagttttccatcggacacaaactggatgttctataattcaattcatatctgacattgtctccctggaaatagcctcagatcccacaagttaaaggcccagtcccacaagactttcctcacttcagatgcctgtcacagtccccgggttaggacctgtacttctgaccaatcagctagaaattgggggttcttatgactcccctccttgagttccattaatttgctagagcagctcacagaacgcagggaaacactttacttacgtttacctatttagtataataaagaatattacaaagatccaggtgaagaaccagatggaagagatgcataggtcaaggtacgtgcttccatggcctctgtgggtgtgccaccctccccaaacctccacttgttcagcaaccaggaagcactctgaacccagtccttttgggttctcatggagacctcattatataggaatgattgattacatcattggccactggtgattaactcaacctttagcaactgtgagcgcctctctccttccccttgttaggggggtgggtaggtggggctggtagttccaatcctctaatcacaatgttggttccctggaaaccaccccctttctgaggctacccaggagcacccctcaaccccttacagcagtcatctcattaacatacagaagacacctcactttggagattccaagggttttaggagctgtgtgccaggaatcagggacccaaaaccaaacatgtgtttcttgttataaatcataacatcacacctcccctccttcttgcccattatttctggttaattttcatactgtttgcttcctaactgaaaaattttctatgattcctcactgactgaggaggaagcataatgcttttatcttggcctccgtggcccacccagcctgggccactgttattctcattacttccccagggaaagccttcctgtagccagactgtttgtggggtttcctaacagaaagcttatctctgcaagtgggtttctgttgttacttagcctggaaaacccttgccattatttctagccacaaattaatttaattcaacaaacatttattgcaggatgtatctgggccaaagagacctggtccctttagaaatttccagagctgataagccatggtccttttccttcaggggatcacagcaataatgtgacgtatccttccaggctgtgctcaaacagtttctccactgcagccttctatgaccgcattaaatgtcagccagatttgtttctgaggtctgagagcatttaatcacatatggccttgaattgctagttagccttccacctatactggaatgttgttactcaaaagtgtttttattgtcaattatatcctaaaaccaggatagaatattttattggattgcaaataaatttgtgtcatgtgttttaccagcatcaaaaagaaaaagacactgtaatttatagggtcaggaaacactcttaaacctggctagactgttaattaatttaagggaaaagaagaatctctgttttctccaaacgttttgcatcccaccaggtggaaaaggatgctggaacttaagaacagcctaagcatgtgcaggaggaaacgaggaaatgacaccgttcagggatttttcatgtaacgaggcacccagtgtaactaacaccatgacagggaaatggttgactgaaattcctcaccctgttacccaacatgctcaaagtgcgctggaacaccttccagaaaggccagcctcagaagcaggtcagcttaaggagcagcaagcatacgccaggccagtgtctctgggggattggcgaggggaatgtccctggacttctgcatcataccctgacagctatgcttcccattcaatgaaaagaaagggaggctactaactgagaggtgatgtcattcttttgtcctctatctataaaatgaagagttggactaaatgagtttaaagtcctttctcttttcttatgatgatggtattctgttaatagcttcatgcttttccctggtgtgtataaaacaaagcatgcttgctttgttataatttcacaagctcccatgcacagcaaaggttatagcctagaatattcacttgtcatcaattttctcagaactttcctccttagactatgctgtgaaatagcagttttgcttttcttaatatctttttcactttttactgatttccaaacacaatgttccatttgaaatggcttagcccctaaaactttggaaactccttcatgtcctaggctgagctcctgtcaccattgagaactcctgtctcatacacagccaccaacacacacatttagcatctggacaacagcaacaatctctatcatttgcgcgatcactgtattctagtgggcttctgtatattgtgagactttgtaaatattatctctggtccttataatatcaataggattgtaagcattattatttccattttacatatgagaacactgaggcctacaaagtttaggagactcagggtgagctagtgaacagctagctggtacaacttaggttcgcttgaaatcaaagtcaataacctttttagaagcaaagctggaggacaacaggaagaagggctgacctctctgagtgcattttctacaaacgatgccttttggataattttgttgccacaattgaaagacattagaggaggtctgtgaaaacaagagtacagaacgtgtaggtattgtggtctcaaggcacctcttccaggaacccaccttcaaatcaatgacacaggtcctgccccccgtgtcttcctcccccaagatcatttctcatagatttttcatcccgtcagtgccatcttctactgcaccaactgggagattcacaggtggaaattgtgagtggagaaacctgttcctaatgcctgtgactatgtgctcaagtgtggacaggagctttcggatgttacagcctagtgtgaagacagatgttccctacccaactctgtggcaaatcttgttataaagtggaataagctttcctgatgtgaacagagcttctaattaacctcctccatatactgtgttcaggttttgcaaattagatctctttgaagtgaagtgcacctttattctaactaacgtatgtactcacaggcgagtcccacctatccagttttacaaaccttactttacatctcattgaccttgaatgtccctaagaaaggtcccaccagggctgctagtgtccagcagttgggaagttccagcctggggaggatgttggggccagggtggggagagcctgtcttgtagtagaggctacagctgtggctaatctgtgatttagccagctgctgcagctgctgaaaggcttccttgcatggaaaaactatttcataatctccagatccctttttggtagaaagaggtttcagtcctgcaaagctggcctcttccagcaatgtggcctatcatggaggtcccatctctgaggccttcctcccattcctgtgtctcagcacctgatccccatcgggggaatggtcaaggagagcaagctctgtgaagagccccttctgagttgagttgctgtggttagagaactgagagaaaagggaaggcagggggccaagagctgtgactggcactgtgagcttggagaagtcacatctcctctcttaaacttctttaaacctccaggtctcctataaccctggtcataatatgattcagttttaccttcctactcttcatacccaagatgctgtttcctggttcttctccatcccttgagtgctctgggactggtgggagagaaaggagctacagagctggctgctgcttcctctttccacccatgtggacatgatggatctttcctttatttatttacttttatttatttattatttttatttatttatttatttatttatttatttatttatttattttgagactgagtcttgctatgtcacctaggctggagtgtggtgcatgatctcggcttactgcaacctctgccttccaagttcaagccattctcgtgcctcagcctcccgagtagctgggattacaggcatgtaccaccctgcccggctaattttttgtgtttttagtagagacagggttttgccatgttggccaggctagtctcgaactcctggcctcaagtgatccacccagcttcacctcccaaagtgctggaattacaggtatgagctgttgtgcctggctatgatatatttttcaatacacacaggcagcaccaaccccacaaagccacaggcctctgctgtgggtcctggaagcaatggtagcaagcaccaatctggggcagggagatggggtgggaggcactgctgggacctggggttgtacagatgtggatgcttttgagaaggtgagggccatgaacttcacgagcaggactgctagggtgttcttgctcgcttcttcctgcctccttagttttccatttccactttgtcactaatttccccagattgagatattggttttggatggctcttgtcatctcttccctatgacatgcaggatcatgtcttgcacagaaagttgtaacaggatggggagagagttctctctatcgttgcactcttttccttgactgtcctcttacagcctgctggagcctccagaggccctggccatggggtcagacagtgggtgcctgcatcctaattgtccactctgtcattcctggaggcccacaagtggcagactattgtgagactattggctctgagctcacagtgccagtcacagtgagactattgtctcacaaggcaatagttcaagaacgagtttctctctctagttactgtctattactgctgctggatttcatgtcacagtaacctttcagttcacactttactttatttataatttattattattattagttgcaaaggaaaatgctattgatagtgctgcttaggacatagacatataaagtggaaatgtatagtctttgttagataagaatgagttcaaatcttggctctaccacttaatgtatccaaaagcaaacgcttggtcctcttcctctccccactccctactgcaaatgcttccctccctcagatatccctgtctctataaatggccactccattttgcaaattacttgggccccaagccaacaaatcattcattgtatcccatgttgaatccatcagcagattatgacagccttacctttgaaagctccaaagccagccttccccatgaccctcattactgctgcagtggcctgcacccccaccatcttgcatatacaccactgaagcagcctcctgggtgaccttcactcttggttcactagagtgagtattctcctcagaagccagagggatcctttgatagcccaagtcagatcaggtcattcttcttttcaaagcccccagagacttctcttgttacttagtgtaaaagacaatgtcattacaatggccttcaaggccatccatagtccactgtccctctcacttccctggcctcccctccagccgcttgacttaactctgtctagatgcactggcctccttgctgttgcttgaacacatgaagcaggaccttgggttagcagggacatgtgtcaaagaaaaaatgagagattttctaaggtcatgggctcaggatatgttcttgggaagcacagtctctaggacacagctggcatattgttctgggttatttctttttgaatataagctccacattggtggggatttctgactgttttgctcattggtaactcttaaatgtcattacattccctgacacataatggatgttcagtgaagtgctgttgaatgaatgaagtgagttttggagatttgtatttgaaaagagagagaggagcatgtgtagataaaagtgccaggtctggaaactgtgatttggaagcaatgaacaggggaggtgatgttgttttgatttgaggagaactagggaggggaatgatgactcttcttgaatacttgctggttggtcttctggaaggggaattagatgtattctctctgtctacctagggtagacaattagaaggagttacatttgaaggagttttctctaatatgttcagtagtctgcaaatggaaaatggaatggattgtgttgtctattggagagtcctttcttagtttagggttcaagcagaagccagttgtccacttgtcactgatgatggagagacccccttgtattgcataaactattgaactaggtcacccaggtgaactagatctttaacaatctatgatcttgactaaccaactggtttctctgatttttctttctcatgtgtttttatgaagaaattgacagtccaaccaatgttgtcactgatcgagtgactgaagacacagcaactgtctcctgggacccagtgcaggctgtcatagacaagtatgtagtgcgctacacttctgctgatggggacaccaaggaaatggcagtgcacaaggatgagagcagcactgtcctgacgggcctgaagccaggagaggcatacaaggtctacgtgtgggctgaaaggggcaaccaggggagcaagaaagctgacaccaatgccctcacaggtaacagaaggacgggagcataaataggtttcctcatggcagggagaaggttgatttttgaatcaggaggtcattgctcacctggcatcagctcttttgtttgcaggagtggggaggaggttgcaaaaccaattttgattttcataattatatatatttttcctttttaacatcaaacaaaagagatcagctttttcacttgatgcagaaggtcatacttatttgagttggaattccgtatgcaaccccctcagaatagagtaacacttcctaattttcattttttagatgtgaaaactcaaaacattgggctgacagtgaatttgaatgcttatctcagtttgcagtggctgtgcaggcactttgcatataatctggagctctcttttagaccgtggaaatagtttgcatcctaagtcaacatttactaaatggaccaattcttcctttaagctttcagaagccatgagggttctcatacttcacccagtcattctgctcagtttgcgcctgcaggggtcctgggactatactgggacatagcccagccattctttctgcttaaatcctctcctggtgcttctctgaatttagagcagcctgatcctggtgcccgcatgaggttccaaaacacctggcaggaaatcagagggaaaggcttcgcttattgtttgcattctattctggacagttactgagtatagagactctcagagaagcagagagatggttaggaatatggtttcagaaaattgactgtccaggttttaaccccagctctgccattgactagctgagtggctttgagcaagttactttacttccgttcctgtttcttatggcacaagtgagagcaatgattttttagaatgttaatcagtatttggctcttgaaagatttcgtggtgcacagcctcctagatccatgtgggcctcaatagttgacctcttcttcaggggagcagagaagatattgacagtaaggatggtgatatctaaatctgtttaaagtcaaagtcagcaaatttctgtaaaggaccagatagtaaatatttttggctttgggggtccaacagtttctattgcaattacttaactctgccattggagcatgaaaacagccacagacaatgatgtgtaaatggactggtgtgactgtgttccgataagactttattgataaagattgacagtggatcagatttggcctgtgggttgtagattgcccctcctggtttacattacacgtgactctctgtttactaggattttgagtgtcgtgaaaagaaagagcatttgggtcagcatttttgtttgtttgtttgttttgttttgtttgagacagagtctcgctctcttgcccaggctggagtgcaatggcgcaatctgggctcactgcaacctccatctcccgggttcaagcgattctcctgcctcagcctcccaagtagctgggatttcaggcacccgccaccacgcccagctaatttttgtatttttaatagagacgggttttcactgtgttccccaggctggtctcgaactcctgagctcaagcaatccaccctcctcggcctcccaaagtgctgggaaatacaggcgtgagccaccacgcccggcccatttttaaaacaaaggaagttggaatagagaagaaccttcccttttcttaggcggtggtggtgtgagcagcagggagcctctggagggtggcattgccactgggaaggggtcagaccagagctgagctctgggggcacaaacatgaaggaagtgattcacgcctgtatggcattcacaatcctctgggtagagaagacaagttaaaaagataaaggacagtgagttatgttctagagcaaacaaatgtccctggagctatgggaaactgaagaaaggggacctaccacagactaggacaggataggggtcatgcaggctgtgggaggaggtgacacctgaacaaagcctggaaggacgggtgggagttagcagtggaggcagcatatgcagaggctaagttgtgagaatatgacaggttaggtcatctcaaggggttttaatggagggccggtctgtgtgtttggtgcactagtgaaggataagccagctcagaatcctgggtgctaaatcatttgtcctcatgtcagatgtctgtggtgcatgctgaactttgctccctagggtgagtcactgcatgtggctgtgcattccaccatgctggcctgtcccccttggcaagtggtcctgtgcaggtatgaaatgcaggtgctgtcacaaaaagtacagccttttttgaggaggtagtttctaaaagaggataataaagtcatgctaaccatacacacaattgcttggatttttgactccctaaggatgtacattttgaggagaaagtggtatttcatgcctcaaatgccattaataataacaacttatatttaagcatttgctatgcaatatctcatttactatcaccataacctatgaggtaggtagtggtatttctttcttcatagagttgaggagacagacacttaaattacacggcttgtccaaagttagccaccaggaagagatggagcccaggttctaacccactttaatcacagagaaacccagacagattctacaagtttgattctttttattagaccagacctcagatactatcaattaaaaagtctcctggttccctggccacagatgtaatgttttatatggaaagaactgatggctactacttctaggatatttttcttctcaaagaacatattagagcagatgcagaggtttattcagtataattgctttctagtacaaggagtcaggaactagaagaatatgttatataaatccagggtaaaggagaaatttgaatgtgaagaccaattatttttatcccaaagcgacttccgggaaaagtttatagagttgataaagatgctggctttgtctgaaaactccacttcttattaaatgttattagcttattactggaatttcagaccatttgcttaattagacctttacattaactcaatcattgacatattagagactctgacatttgttgaggttatcactttgactgtgttcgtgctgtctttatggaattagagggtggtaaaggctacattcttctttcatctctctcttaaagaaattgacagcccagcaaacctggtgactgaccgggtgactgagaataccgccaccatctcctgggacccggtacaggccaccattgacaagtacgtggtgcgctacacctctgctgacgaccaagagaccagagaggttctggtggggaaggagcagagcagcactgtcctgacaggcctgaggccaggtgtggagtacacagtgcatgtctgggcccagaagggggaccgagagagcaagaaggctgacaccaacgccccgacaggtaacaaaagagagatggtcaattggaattgagttttagcttgtggatttgaataggtatggtatcaaaggatgtggcctgagcagaaagactttgcaattagaagtcttaaagatgaaagaaagactgagctctcgtggtgatggcggtgggctgctctttcctgacagtgatgagctgttcatgagaccacttggcccactgaaagagagaagtaaagtcttatagtaacaatgcttttagcagaagatgggtacaggatctggtcattgcagtgcttgtgataatatttttagagtgctcatcagtgaagtagcccttgataaaatgttatgttaggaaccctaaatgtcatggcagctgtttaattggaggttgtgatgtgccatatgctgctgagaagacatcgttcctccaacattttagggaactgaaagccaagaaagaatgcctcatttataatgattcctcctttgaagttcagaaccaagggctactttctccttagactcccagcggagactcaggatgagaatgccattgccttgttctaaaagagctctggaagatgaaaatgatgaagatgggggtaaggatatgtcttccatggcttcagagcttaaacctttccaaacattttccttccagatattgacagccccaaaaacctggtgactgaccgggtgacagagaatatggccacggtctcctgggacccggtgcaggccgccattgacaagtacgtggtgcgctacacctctgctggtggagagaccagggaggttccggtggggaaggagcagagcagcacagtcctgacaggcctgagaccgggtatggagtacatggtgcacgtgtgggcccagaagggggaccaggagagcaagaaggccgacaccaaggcccagacaggtaaggagtgtgcattattgctgtgccgatgccatgctcagggtctgtctacatggggttttcttctctgaccttggcataaagggggactttatggaagagcaggttggtatcctcccataatacattgtgtccccctcacttccttttactggcctctcttagaatgcctaagtggtggtctccaaactctggtctttaaagatggctgatcactgcacatagttctttgttctttctttgcctgagtacctttgtcattaacacactaactgcttctccttgacaaggagtaaatattaagaagtaactatcatgctgagggagccagacttagggattgtgatcaatcccttaaaaaaaattcctcacctgtttaaaccctttgcaagcttgtttgtttttgttcctgccatctgaatgaatgttttaggcagaaataataacagtgtttccattagctaaaaataaaatatctagtcatttttagtcccccagatgtaattatgtctattttcatgtaatagtccctacttccctacatgaaatcttctcctctctctcgacttgggccacctgtgggccagctgcctgctccaggcaggggacatgcacaatttctcttgtattttctgctgtgtacctcaagcactgctcttctagcttgctgtatgcagtttctcacccatttatctttggcgttgctgggagaggtaaactgatgagaggtgaggggtgaggacgggcagaagtgaagggtcaggaaggaggagaggtgaagggtcaaggggaaggagaggtgaggggtcaggaggagaagaggtaaggggtcagaggaggagaagtgaggggtcagtaaggaggaaaggtgaggggtcaggaagaggagagatgaggcatcaggaggaggacaagtgaggggttgggaagaggagaggtgaggcgtcagtaagaggagaggtaagggtcctggaagaggagagatgagggctcaggaggaggagaggtgaggggtcaggaggaggagaggtgaggggtcaggaggaggagaggtgaggggtcaggaggaagcgaagtgaagggtcaagagagaatagagcccaggggttagggaggagggagctgggggtcgtggaaagtcatgcttgactgtaacaggtgtttgggcctgccctggagcctgacgagtgctaaagctgactcggtcatgaagcacttctgtgctcctcttctacttgggtctctcactgtaggcaaatgcctgtcttccactggtctcttactccccttcctctgccaatacatcaggggttcccccagcgcctctctggtggggttgccttgcccctctaggtggtcctcttggacagcttcccaggcctaccttgctgtgctaggcccaagtctggtccatggagaacctgcatgcatcctttgtccattcaaccagatgcacagctcttttgcaatgctacagcctgtctttgctctgtgtcagagcaaccagctattttcttatctcttagatattttagcatatgtcagacaccagcccgtatgattccccaagctttgggctttctcacccttggcactattgctatcttggggtggataattctttgctgcagaggtctatcttgtgcattgtaagatgtttagcagcatccctgatgtctccccctatcccacactgagttgtgacaaccaaaagtgtctccagacattgctgactgcccctggttgagaactgctgctctagggtatgcaaaacaaagtctgtaagggattccattgaaaactgcttattcaaggcttgggcctcacccatgggactcacagtgtatctttttccaaataaatcccttcttcaagtcccacctcactggcttctccaatgtcttttatagggcgaaaatgattggtcagccaagggtcacaaaactgttgttgatcttgccttgactgtggttcctcaggttggaatgtagatatccattttcttggggttacagcctaaagcaacatgtgtaataggacgtatgagcaagtgactttgggaaaacggcttttgcaatgaattatttaggacaaagaaatgctagtttttttttttggtgaatgtatttttaagtatcttctatgtatgtggtatggaggaacataatttcttgtatttataatgtatcaacaaactggtgttaataatgatagcttatggtcattgggcatctactcagtgctaagaactcataatagacatttgtttcttttttaaaaaaattgatacataataatatacatatttataggtacatgtgatgttctaatacatgcatgcaatgtgtgatgatcaaatcagggtaatcaggatatccatcagctcaacatttggcatttctttgagttagaaacatgtcaaatcttctcttctagctattttgaaatgtacaataaatcattgttaactgtagtcatcctgtgtccggaattggtgggttcttggtctcactgacttcaagaatgaagctgcggaccctcgcggtgagtgttacagctcttaaggtggcgcatctggagtctgtcccttgtgatgttcagatgtgttcggagtttcttccttctggtgggttcgtggtctctggtctcgctggatcaggagtgaagctgcagaccttcgcggtgagtgttacagctcttaaggcagcgcgtctggagttgttggttcctcccggtgggctcgtggtctcgctgggctcaggagtgaagctgcagatcttcgcggtgttacagctcataaaaccagcgtggacccaaagagtgagcagtagcaagatttattgcaaagagcgaaagaacaaagcttccacagtgtggaaggggacccgagaaggttgccaatgctggctcgggcagcctgcttttattgtcttttctggccccacccacatcctgctgattggtagagccgagtggcctgttttgtcagggcgctgattggtgcgtttacaatccctgagctagatacaaaggttctccacgtccccatcagattagttagatacagagtttctacacacaggttctccagggccccaccagagcagctagatacagagtgtcgattggtgcactcacaaaccttgagctaaacacagggtgctgattggggtatttacaatccctgagctagacataaaggttcaccaaggccccaccagagcagctagatacacagtgtcgattggtgcactcacaaaccttgagctaaacagagggtgctgattggtgtatttacaaaccttgagctagatacagagtgccgattggtgtatttacaatccttgagctagacataaaggttctccacatcctcaccagagcagctagatacggagtgttgattggtgcactcacaaaccttgagctaaacacagggtgctggttggggtatttacaatccctgagctagacataaaggttctccaaggccccaccagagcagctagatacagagtgttgattggtgcactcacaaaccttgagctagacacagggtgctgattggtgtgtttacaatccctgagctagatataaagactctccacgtccccaccagactcaggagcccagctggcttcacccagtggatcccgcactggggctgcaggtggagctgtctgccagtcccgcgccatgaacttgtactcctcagcccttgggtagtcgacgggactgggtgccatggagcaggggatggtattcgtcggggaggctcgggctgcacaggaacccacagaggttggggaaggcttaggcatggcgggctgcaggtcccgagtcctgcccggcgggaaggcagctaaggctcggcgagaaatcgagcgcagtgccggtgggctggcactgctgggggacccagtacaccctccgcagctgctggcccgggtgctaagcccctcactgcccggggccagcagggctggccggctgctctgagtgcggggccctccaagcccatgcccacctagaactccagctggcccgcaagcaccatgcgcagccctggttcccactcgcgcctctccctccacacctccccgcaagctgagggagtgggctccagccttggccagcccagaaaggggctcccacagtgtagtggtggactgaagggctcctcaaatgctgccaaagtgggagcccaggcagaggaggtgccaagagcaagtgagggctctgaggactgccagcatgctgtcacctctcaatcccccctctaaacaggacaccccaactgctgttggcaatttggccgatgaccactctagctacttcctgctggatggggcaaagaaggggccctgcagttgcggtgtccttcagaggggaactctctaggccaggggaagtgccagtgggttgatccaggggtcctcggtagaagttgttagttgaactcttttggggttccatttgtaagaccatctgtagcttgatggcctcgattctagaggaaacaaatttgacaagaaggttaaaaatacagggcccaaaggcgagtaacagcaagatggctgccacaggacctagaaaggggagaagccatgttgcctaactccagaagttggtataagaatttgaaaggcgttgtctgatttcagaagccttttcctgtaaactccgggcagcatctcatactatccccgactggttagtgtaaaaacaacattcttcccctaagaaggtgtagtgtcctcctttttcagcagtgaggaggtctaggcctctgcagttttggagagtcactgctgccaaagagtctatttgggattgtaaagtaaggatagatttcattatttcttgcaaactgtctgagaggcagatatgggttgaagatccacataagtagaatatgccttggctgggtagatagaaatttaccctggcttttaaaggaatgggatatgctgtttttttctttactacttctatctctctctttctctcttcgacttcttctttgtcttttcctttcttcttaactttttttttgactttctgtgtctgtccctctttctgactccttttttttgtctctgtttctgactacctctttgactttctgtctctttgtctcttcctctctctgtctctttctctgactttctctttctctcttttcttcttgctggtctttccctacctctgccagccgcttatgctgctgttctcctctctccttcccattttgatggctttgtcagtgtaagattcctacctctttgtgtttttttgcattacgtgactgtgcgggcatttttttgcccttctaaattgtccttccaatgcccagacttcagtgttgattccctcctcaagtaggggacaacaaatgggtaacttgttccccatatttatgtagataatagctccagccttggctaatatatccctccctaataagggtgtgggactttcagacataacaagaaagccatgtgaaaagagcaaagtctcccaattacaactgaggaggtgggagaaatacctgattacaggctgtcccaggattcctcggatggtaacagaccttgaggacagttgtctaggacaggagattaacactgagaaggccgcgccagtatccaggaggaagtcaatttcctggccctcaatagttaaacatacccagggctcagtgagggtgatgacatgagctggtgcttgccccgggcaccctcagtcctgttgttggatcatctggttgggggcttctaacccagggaaccttcatcctctggggcagtgcaccttccagtgattgcctcggcatagtggacacggatgagggggcagcttgtttcttattggacaatcttttttaaagtgtcctagtaaaccgcactgataacaagccgtaccaggtgattggcctgctccattttctgacctctctgaaccaccaaggtttgtttgtctgagggccatgactaaggctgcggcctttctctgatctcgcttttccttttgggcctgttcctcttggtccctattatagaacaccaaggttgccaggtttaataatgtctctagattttgttcagggctcagggcttgcttttggagctttctcctgatatctgtggctgattgggtaataaacttatcttttagaatcaattgaccctcgagtgattcgggtgacaggggagtatattttcttaaggcctcttgtagccgctcgaggaaggcagaaggattttcttcctttccctgggttatggtggatatcattgaataattcatgggctttttcccaattctccttagtccttccagaacacagatcaacagatgtttacgactccagtccccatgatctgagtcaaagtcccagtggggatccatactggggatggcttgctgaccagtagggaagttgtccctttcttcggctgtcattctttcatttacttgactaggataccaggtatctccaaactctcaggctgcagctaaagccgcattcttttcattaaaggccagggtttgatctaacagtagcatgacgtctctccaagtgaggtcaaaggtttgccctagaccctgtaggacatctatgtacctatcaggatcatctgaaaacttccccaggtctgccttgatctgctttaaatcagagagggagaaggggacatgcacccgggttgggccaaattcccctccccctacagcttgaaggggacataaccgatagcccgggggtttttgtggacctttggagatttctttgcttatttccttctgggcaggggagattagaggaggagtatcatcaataggaagggaagctatagggaggctaggatatgggggtaagctgaggggtcctcctgtgggatgtaaattgcaagctttgcatagttgtgtattctccctcaatgaaaagaaagcttggacataaggtatttcactccatttgccttccctcttacagaaaagatcaagctgcaggatagtattgtaatttgtgcttccctcaggtggccatttttccccatcagaaagagaatattggggccaagccgtagtgcaggaaaaaatgagcctcctctttttcagggtttgtgggtcaaattggtcccaatggcttaggatgcatttcaagggtgaacctgttgatgcctgagtgtttcccatatgaaagacaaaaccgcccacagttttggtttgttttgtttctctccctgcccaaggacctgcaatggtcctgggaccctgctgatcagaatagttgcattcaccaatgcagcagcagaaacaacccctgcccaagaacctgcaacggtccctggaccctgctgacttgaatagttgcgctcaccgacgcagcagcagaaacactagttttcctcccagaccacatggaggaccgaggaaggtcggatttagtggtccttactgacgcattctcgaaaacctgcacccttgcctgtcctcctagaccacaaggaggaccgactgagaaaaatcagatttagtggcccttactgacgcattctcaaaaaacctgttagagtcctaagcattctcctgttagtattgggactttaccccatcctataaagatgttatgccacaaaaatgaaatggagggccataccctgagggagggaggggatcttcagggttggaagagtgacaccttttgttctcacttatatgaataggaaggatacaatttctgaggctccccatatcctagcttcaggaataacttttgttaggcctgttagtctgaggagggatcctaaaattcctagtagtccccactacagcagggctttgggcaaaaactgtgtctttctgattggtgagcctgggtgcctaaagaaggtaacagagtcctggagtttatactagaagtcattcttataggagaaacaagaaaagcaccagaggcaggtagcaatttttagaagcgggtctagcctcagagaagagaggcgagaggaagtttgtctggcaggcattaggacccagagggcaagggtcaggatagataggatagataggcgagtgtcgcttgggcgacatgcttttgagagttccactcatggccgcagggtcaaccaacatgttgtcgggaccccggagatgcatggctttcctcactgtcaacccacggctcagcccagaagtacaggaaaagcggaagctggttctaggcaaaccaacggtcccaactccaaagagttgggggttgttagagagccctttcccagaaagcttgacacccgtgtctttagtccggcggcccgctagtcacttttaaatggctgacagatgcccggtatttagcccccgaattctaaagaaagataggacagaatagcaagtgaaaggggtccgatggtactcactgcttggcgattgggaaaggtctcaccgctcggctattgtctcaccgcttggcgatatgcgaaagtcccttcgtggtcgccaaaatgtgtccggaattggtgggttcttggtctcactgacttcaaggatgaagccgcaaaccctcgtggtgagtgttacagctcttaaggtggcgcatctggagtctgtcccttctgatgttcagatgtgtttggagtttcttccttctggtgggttcgtggtcttgctggctcaggagtgaagctgcagaccttcgtggtgagtgttacagctcttaaggtggcgcatctggagtctgtcccttctgatgttctgatgtgttcggagtttcttccttctggtgggttcgtggtctcgctggctcaggagtgaagctgcagaccttcgtggtgagtgttacagctcttaaggcagcacgtctggagttgttcgttcctcccagtgggctcatggtcttgctgggctcaggagtgaagctgcagatcttcgcggtgagtgttacagctcataaaagcagcgtggacccaaagagtgagcagtagcaagatttattgcaaagagcgaaagaacaaagcttccacagtgtggaaggggacccgagaaggttgccaatgctggctcgggcagcctgcttttattgtcttttctggccccacccacatcctgctgattggtagagccgagtggcctgttttgtcagggcgctgattggtgcgtttacaatccctgagctagatacaaaggttctccacgtccccatcagattagttagatacagagtttctacacacaggttctccagggccccaccagagcagctagatacagagtgtcgattggtgcactcacaaaccttgagctaaacacagggtgctgattggggtatttacaatccctgagctagacataaaggttcaccaaggccccaccagagcagctagatacacagtgtcgattggtgcactcacaaaccttgagctaaacagagggtgctgattggtgtatttacaaaccttgagctagatacagagtgccgattggtgtatttacaatccttgagctagacataaaggttctccacatcctcaccagagcagctagatacggagtgttgattggtgcactcacaaaccttgagctaaacacagggtgctggttggggtatttacaatccctgagctagacataaaggttctccaaggccccaccagagcagctagatacagagtgttgattggtgcactcacaaaccttgagctagacacagggtgctgattggtgtgtttacaatctctgagctagatataaagactctccacgtccccaccagaccaggagcccagctggcttcaccgagtggatcccgcactggggctgcaggtggagctgcctgccagtcccatgccatgagctcgtactcgtcagcccttgggtggtcgatgggactgggcgccgtggagcaggggatggtattcgttggggaggctcgggctgcacaggaacccacggaggcaggggaaggcttaggcatggcgggctgcaggtctcgagccctgccccgtgggaaggcagctaaggctcagcgagaaatcgagcgtagcgccggtgggctggcactgctgggggacccagtacaccctccgcagctgctggcccgggtgctaagcccctcactgcccggggccagcagggctggccggctgctctgagtgcggggccctccaagcccatgcccacctagaactccagctggcccgcaagcaccatgtgcagccctggttcccgctcacgcctctccctccacacctccccgcaagctgagggagtgggctccagccttggccagcccagaaaggggctcccacagtgtagtggtgggctgaagggctcctcaaatgctgccaaagtgggagcccaggcagaggaggtgccaagagcaagtgagggctctgaggactgccagcacgctgtcacctcttaatcctactgtgctatcaaacactagaatgtatttcttctatctaactgtatttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatgcacccgcctcggcctcccaaagtgctgggattacaggcgtgagccaccgggcccggcctatctaactgtatttttaaacccttaagccaacctgtgttcattccccttactcctacacttcctagcctctggcaaccatcattttattcgcaacttccaggagatcaatttttttagctcccacatatgagtaagaacatgcaatgtttgtgtttctgtgcctggcttatttcacttaacataataacctccagtttgatctgtgttgctgcaaaggaaaggattttattcctttttatggctgaatggtattctgttgtgtatgtatatgtgtatatatatattatatatatatatacacatacatatgtattatatatatacacacatacatatatatatatcaaaatttccttatccatccactagtggacagttaggttaattcagtattttggttattatgaatagtgctgcagtaaacatgggcatgcagctatctctttgatatactgatttccttttttttggatgtatactcagcagtgaggttgctggatcatatggtacatctatttttagttttttgaggaaactccatgcttttactcatagtggctgtactaattgccattcccaccagcagtgaactagtattcccctttctccacatcctcaccagtacctgttattgtttgtctttttgataatagcagttttaacagggatgagatgatatctcaatgtgattttgatttgcatttccctgatgattagtgatgttgaacattttttcgtaaatgtttgttggtcatttgtatgtcttcttttgagaaatgtctatttagatcatttgcccattttaaaataagatgatgatgatgattgttattattattttgctattgagtttgaactccttatgtattctgtttattaatactttatcacatagacagcttgcaaatagtttctcccattatgtaggttgtctctgcattctgtcgattatttcctttgctgtgcaaaagcttttcagcttgatgtatttccatttgtctatttttgcttttgttgcctgtgcttttgcagtcttacccaaaatatctgcctagaccaatgttctaaagtgtttcaccaatgttttcttctgtagtttcatagtttcaggtcttacatttaattctttaatccactttaatttaatttttgaatacggtgagaaatagaggtctagttttattcttctgcatatggatattcaattttcctagaactatttattgatgagcctgttctttccccattgaatgttcttggttacttgtcaaaaatcagttggcagtaaatatgtggatttatttctgggttctctattctgttccattgtgcctatgtgtccgtttttatgccaggtccaagctgttttggttactgtagctttgtagtacatattagagtcagctcatgtgatgcctccagctttgttatttttgctcaggatttctttggctatttggggtcttctgtggttccatatgaattttagaatttttttttctaggctgggtgcagtggctcatgcctgtaatcccagcactttgggaggtcaaggcgggtggatcatttgaggtcaggagttcaagaccagcctggccaacatggtgaaaccctgtttctactaaaaatacaagaaaaaaaaaaagggctgggtgcggtagctcacgcctgtaatcccagtactttgggaggccaaggcaggtggatcacctgaggacagaagttcgagaccagcctggccaacacggtgaaactccgtctctactataaatacaaaaattagctgaatgtggtggcaggtgcctgtaatcccagttacttgggaggctgaggcaggagaatcgcttgaacctgggaggcagaggttgcagtgagccaagatcacaccattgcactccagcctgggcaacaagagtgaaactccgtctcaaaacaaaagcaaaaataattagctgggcatgatggtgcacgcctgtaatcccagctactggggaggctgaggcaggagaatcacttgaacccaggagatggaggtcgcagtgagctgagatcatgccactgcactccagcctgggaaacagagcgagactctgtctcaaaaaaaaaaaaaaaaaaaaaaaaaaaaagaattgtttttctaaagaatgtcattgatattttgatacagattgcattgaatctatagattgcttttgggagtacaattttttttacaatattcttcccattcatagacataggatatatttccattttttggtgacatcttcaatttctttcatcagtgttttatggtttttccttgcagcgatctttcacctctttggttaaatttatttatgggtgtgtttttaaaagtagctattgtaaaagggattgcttccttgatttttttttttatgctagttcattgctggtatatagaaacactactgatttttatatgctaattttgtatcgtgaaactttattgaatttatcagctctaagagtgtcttggtggagcttgttagggttttctatatatgagatcatgttatctgcaaacagggacaatttggcttcctctttttcaatttggatgctctttattcctttctgttgcctaattgctctggctaggacttccagtactatgttgaataagagtggtaagagtggtcatccttgtcttgttctggttcttagagaaaagctttcagtttttccccaatcagtgtattgttaaatatgggtttgtcttatatggcctttagagtgttgaggtatgctttttttatatctagcttgtttagggtttttatcatgaaacgttgttgaatgttatcaaatgctttttgcatctattgagatgatatttttttttattcttcattgtgtttatgtgatgtgtcacatttattgatttgtgtatgttaactattcttgcatccctgtgataaatctcacttgtatcctcttgctgaattgatctctttttctttacataataacctcctttgcctctttttatacttttgacttaaaaaatctgtttaatctcatataagcatagctactcctgtttgcttttggtttctgtttacatggaatatctttttccatcctttcactttgcatctatatgtgtttccacaggtgaaggaagattcttgtaggtagcacataagtgggtcatttttttaaagatccattcagccggccgatctttttttttttttttttttttttttttttttttttttgaggcaaagcctcactctgttgtccaggctggaatgcagtggtgtaatctcggctcactgcaacctctgcttctcaggttcaagtgattctcccacctcaaccctccaagtagctgggactataggcatgtgccaccatgtctggctaatttttttttgtatttttagtagagacagggtttcaccatgttggctaggctggtctcaaactcctgaccttcaagtgatctgcctgcctcgacctcccaaagtgctgggattacaggcatgagccctatgcccggcctcagcaagtctatcttttaagtggggaatttaatccatttacatccaaggttattattgataggagaggagtgactcctgtcatttgtaaattgttttctagattattttgtatatcctttgttaatttcttcttctattattgtttcttattgtgatttggtaggtttttgtagtactgaggcttgatccttttctttctcctttgtgtatctgctctgccagtgagtttatacttttctatgttctcatgattgtgattatcatctttttgcttccaaacgtaggactcccttgagcatttcttgtagagccagtttagtggtgatggattccctcagtttttccttttctgggaaagactttgtttctccctcatttctgaagaatagacttgctgggtgtggtattctcagttgacagctttttttccacccctttcagatcttgggctatatcatccctttctctcctggcctgtaagatttctgctgagaattttgctgtttgtctaatgggattcccttatatgtgacctaacacttttcttttactgtttttagaattttctctttgtctttgactattgacaacttgactataatatacttcaggaaggacctttttggggttgaatctatttagggacttgagcttcctagatctgaatattcatatctctccccagacttgggacattttcagctattatttcattaagtaggttttctatacctttttacatctcttttctttctggaactcctgtaatatgaatatttattcacttaatagtatcccttaggttttgtaggctttctttactctttttcatttttatttcttttctttctctcactgggtaatgtcaaacaatttatcttcaagttcagagatccttttttctgcttgatcaagtctgctgtggaagctcttcattatatttttaaattccattcattgaattcattagctgtgtttcttttttgtgatatctatctcttcactgaatttctcattcatatcatgtattatttttctgatttcatcaaatagtctatctgtattttttgaatttcattaagtttccttaagatcattattttgaattccttttctgacaatgtatcgatttctttttaattggggtctgtttctagagagttattatgttcctttggtggtgtcatgttttcttgctttcttcatgttccttgtgtccttgcattgaggtctgtgtatctggtggaacaattgcctcttctaaactttctagagtggctttcttagagaaatacttttacctcagttgaattttaatgtgccagttgggaagggtggttcacgtaggttcggtggtatagtctttgtgcagcttctttggctgtgtttgacatcagcaataactatgggcatatcagtggcctagactacagaagtttgtggtagtggtggtggcagtataggttgttaatgtccttggtagcaagggctattctattcttattttctccataatgggaagacttagctgaaagtctccctcttggggtcaggtctgacatggcatagaagcagttgccatgacactgggtttcaagtacaggtgctcaaagcaactgtggggcaaggtcttacttaggctcaaggtcttgtgaacctatagtggcacttgagtcttgggatgcagagtgatctctgtgtcagggctggatataggatgcctatagtgcctagcagcttggcttcagggggtcagtttgtaactgtaattctacccctgatgggcagggtgcagccgtggtttaacttggaggaagaagaagtgctctggaagtgtgagaccaggttgcaggatatggctgtaattgctgtaatttggaaacctgcaccaatagagctcagtggcaacttggatccctaggggtgaggaattgtgtagtggggattctaaactctacaatggtgggacttggcagtatcccagtctctgtaaggccagatgcagcagcagcaagcatcccaaaataatcaagcacactgttttttgggctgtaccagggcagggagcagcacaacaatgactctactccctgggagaagagtgtctcaggagctcagactcagggggcctagtccagctctagggaagaataatactagagttgtctggccagtagggtggggtgtcttagccaaccactgctgtatttccctgggacctagggtactatgtcagcacagccctaggacgtgcagctgctcagcttggttgaggcactgattccccagtgggcaatgtgccactccagctcagtcctgagggatgtgactatgctggatggcctcaacaccattttcctgggatatagggctctgccaaaagcattgttccctggggagcttccctgaggagctgaaactagtgcagtttcagctcaggcccctacgagtagagtgctgcctagtgtgacagaagtggatggagctgttttaccaaagtaatgattctccacgaaagagcgtgcagtttcagctctggaatgagtgggtaggggagggggatgtggagtcgttccactgctgcttggccccatggggaaaggtgtaacagttgctcacagctccgcttggagatgtcaggtcactgggtggtggtgtctcagcagcagtttacccttagggatgaaggggtgaatggctactcaccccgagagcaagacacattccaacagtagctccagttccaagacaccaagacggtgtagtacaatagccatgcaggccacagggggtggggcacagtgttggctccatttctgagggagcacagttgtgtacctgtaggcagctccctcagctgggcttagtgcctctgagagctgtaggagatcccagtggtgaggactgtaggtgtacaaggtgctgataggggctactgggatcttcttgcttacgttttgctgtagggagaagttcttcctggtttccagctgctcttacctgggcaatggggtggtggggtcccagtgtttccttctgttctctatgtggccatcctgagtttctgtgctcaccagagtttctgtttctcctttgacagaattctgcactctcctttagttattttttttttaaatgtcgttgtttattcttttagttgtttttgtgcagaagatgagtgtcagggatttctaactggccatcttgctgatgtcacactaggagacatgttattagctcatataatattcacaataactctgtagaatatgtactaatattatttttccctgccttttttttcttgtggagaaaattgaggcagagaggtaggtttgcccttaattatattttaaattatagagtaaatattctgtggcttcagagtggtaaacactgtaatactttaacattttcaaagcccctttgctacatatcatttttttctcttggtttacagagctactcagagtgataagtgcaataatcattaacaaccccttgttacaaatacagaagtaaagcaacttgccccaagtcacaaaaacaagttagtaagttatgaaattagttacatgcatggaatattcatgcttgaatgaaccttaaaagtttatctaacccaaacctcagattttacagatgaagaagctgaggcccagccaggaacagctgaactgtccggagccacaactggcagatggcagagctgggattagattgctagtaacctggctccaacctgcacctctgctctgcctctctgggctggaactagaacccagtgcttctgactttggatttagttctcataccactctcctgtgctgccttgttgaaaatccaagaatccagctgtggggataaggtctatatccatgaaacaactgaaaaccagcatatgatatggagaaaccataagaacaggaaactgccttaccacaagtaaaatgcccagatctcactctttggtaccagttcatagtgttcattgatcagcaattttttttttcagacattgacagcccccaaaacctggtgaccgaccgggtgacagagaatatggccactgtctcctgggacccggtgcgggccaccattgacaggtatgtggtgcgctacacctctgccaaggacggagagaccagggaggttccggtggggaaggagcagagtagcactgtcctgacgggcctgaggccgggtgtggagtacacggtgcacgtgtgggcccagaagggggcccaggagagcaagaaggctgacaccaaggcccagacaggtaaggagcattgttctttgggaatataagagctttcatgctaagtcagtggatgacaagttttgttttccttctctgacattggcagaagtcaatgattaatggaagagtgggatggcatcccttcataacagattgcacacaccatccctcattttcctttaactagtttccttgcaagtcagggccacaaggcagtctccaagctatgattacatggtcatgtccatcaactcctcttctgattgcatggatcttttgctgtagacagtatcgagggtctcttagtgagtttgtgagtgggaacagaaaatgaaaatcaaattttgttaataataatagtatattgaaaatttgactttaagaacgtagatgtcacatctgccatagcaaggagatgtatatcatttgctttatgacaaatgaatcacattataactataaaacatatttataactagaaattatgataagttctatgaaggagatgacatggtgtaggtatagagaataatgaagtagtgatgtttctcagataggaaggggaaatagtaataggatacacatggccaaaacaaccaaataacagttgcttaaacaagaaaggagcgtattcctcttgttgaatagcagagtgtacgttggccagagttttgaggataaggatagctcctacgttatattcttattttagtggaagcgatatctaaccatattttgtacagtgatttaatcagcaaaccagcatgatgagtgaatctatgatatgctagagaatattcaaccagggttttactttttgcggattcctttagtaatatatagtgagcattttccacgtgccctgcccactactaggcactgggaacacaggagaataggatgctgccctcttcctccaggggcttacatttagaagtggcttttagaatcttctagtatgaaatgggaggtctttactgacatgatgtgagacacaaaattgttagttcctggtgagcagagaccatgtcttttccaattctggattctgcacactgtctagaacatttcatggacagagttggggcttgatatacccttactagatgaataaaagatttgttttgctaaagacttggtagaggtaacagcctggattctcaggttctgatctattgtgctttctacttgaggagccaggtatatcttgggggagaagatgatgtccatgaaacagctaaaaatgaaacaagagcatatgaggcggaaaccccacacaacatgaaagggtttcaccccacgcaaaatgaccaccagtttctgcactctggcacctgttcatagtgcatattggtcagcattttttttttcagacattgacagcccccaaaacctggtcactgactgggtgacagagaatacagccactgtctcctgggacccggtgcaggccaccattgacaggtatgtggtgcactacacgtctgccaacggagagaccagggaggttccagtggggaaggagcagagcagcactgtcctgacgggcctgaggccgggcatggagtacacggtgcacgtgtgggcccagaaggggaaccaggagagcaagaaggctgacaccaaggcccagacaggtaatagaagtgaagagaagagcaaacccgggtagtagctgcaggttgatctattgcagctgagtgatgatgcagctgcttttggcatctgtaacctcagggctgcagactgttttaggagagtttgctgtaaaaacaaaacaaaacaaaaacaaaaaacaaacaaagaaacaaaaaactttcattcacccaaagaaagaacaacgtgttataggaaaggcgtcccgatccagacccttagaaagggttcttggatcttgtgcaagaaagagttcagggtgagcccatagagtaaagtgaaagcaagtttattaggaaagtaaaggaataaaagaatggctactagccatgggcagagcagccctgagggcttgtggttgtccatttttatggttatttcttgaagatatgctaaacaagaggtggattattcatacctcccctttttagaccatatagggtgacttcctgacattgccttggcatttgtaaactgtcatggcactggtgggagtgtagtagtgaggatgaccagaggtcactctcattgccatcttcgttttggtgggtcttggccggcttctttactgcaggctgttttaacagcacggtctttatgacctgtatcttgtgctgacctcctatcttatcctgtgacttagaatgccttaaccatctgggaatgcagcccagtaggtttcacccttatttgacccagttcctattcaagatggagtttctctggttcaagcatgtctgacaaaactatagtaatggacccagtgggagcagtcccatgaatgccttttttttcttttttttttttttttgagacagtcttgccctgtcgcccaggctggagtgcagtggcgctatctcggctcactgcaagctccgcctcccgggttcatgccattctcctgcctcagcctcccaagtagctgggattacaagcgcccgccaccatgcccggctaattttgtttttgtatttttagtagagacggggtttcaccgtgttagccaggatggtctcaatctcctgacctcgtgatccgcctaccatggcctcccaaagtgctgggattacaggcatgagccactgcgcctgggcccatgaatgtcttaaaactctttccaaagcctgtgtttttaatcattgtgtctctcagctataggaaataatgtaaaaccaatataaaattcttaaaaccactgattaaaaacctgttttgtggcaagctattttgtataggtttgaccgaatagacgctgtgtgatagaaaggagcaagtattcacctgggtggctggagccctgtttccttgcagtaggcagctgacttttaatgagcatcatctaagtgccaggcctggggaacacagtggtgaacaaaacaaatatctctactctcttgaagtctagagtgaagatagacaataaataagaaaacacatttaaaaccgtaaattatgctaaattctgtgaaggagatgaacatggtgtaggtatagagaattacagggtaaggatgtcttgcagatgggaagggtgagtagtaataggatatacatagacagaaacactcaaataacagttgcatcagcaggaatggagtgtattcctctctgtagaatgtccagggctgatacggtagctcctcgtccaggagacccaggcttcttctgtgattgttgcttagtcatccctagcaatttgccctcctttacctggtcaccaccctgtctgcattgtagccagtgggaagaggcatgatgaaagtcagggcatcactgggacattgcacatatcagcccttctcatgttccattgccaggtcccagacagacctcactgcaaaaaaggctaggaaatgaggtctttagctggatggccctgtgcccagctttactttggttatgctgtcctgaccaacacagcagctgctagctacatgtagctattaaaattatttttatttttattttattttcagagacagggtctcattctgttagctaggctggagtacagtggtatgatcacagttcactgcaggcttgacctcccgggctcaagccatcctcccaccttagcttcccaagtagctgggaccataggcacgtgccactaaacctgtaattttttatttcttttagagatggggtctcactgtgttgaactcctgggctcaagtgatcctcctgcctcggcttcccaaagtgctgggattacaggcatgggtcactatgcccagcctaaattttaattaattaaaaataaaataaaaatattttctcatttggattagccacatttcaaatggtcagtagccacatgtgactaatggctacggtatcggactgtgccgattatagaatactttcatcattgcagagagatctgttggacagtaagtgtgcttacagaagaagggggagaatggattttggcgaaaactagccatttctggcaaagggaagagtatgtgtgatgtcccccagctggaatagtacctgggatggttggagaatgaaaagaggccagttttgctggagcatagagggtggaagagcaagtggcctgagatgaggtgggaggagcaggggcagatcagccaggaccatgtggtacttagaggacaaaatgggctatacttattaatactagaagagtgatatgatgcagtgttcatttaaaaaacattttccaggccacagtgaggagaataaatggagaaaatgacaaggatagaagttgggaggttcgtagggaagctgctagaaaagtctgggtgcaaaatgctgattgtctaggtaagcatgatggcaaaagggacagagaagaggggatgtctggaatatatttttgaggtatggataatacctgttgatagatgtggggtaggaagaaaatgaggactcaagtatgacctgtgttttttatttgagcaacatgggagattggactaccatttcttgagaggggagactgagaaataaaaagtttggggagaaacatcaagacttttaaatatttaagttcaagatacttgtgagattccttggttaattgagtgattcatttattgattacataaatatttattgagtgtctaatacaggccaggcaccgtggtggagatgcagttgtataaactagtcaggggctcagaattaatagatattatggagcgattagcatccagttggtatttaaagccatgggcatgagtgagatcacctaggtggaaaagtacagagaggaaaagagggagctttgggacaggtgcagtgactctcacctgtaatcccagaacttttggaggctgaggtaggtgaattgcttgagctcaggagttcaagaccagcctggtgaaatcctgtctttacaaaaaaaaaaaaaatacaaaaattggctgagtgtggtggcatgcacctgtattcccagctactctggaggctgaggtgggaggattgcttgagcctgggaggtcaaggctgcagtgacctatgatggcaccactgctctccagcttgggtgaaagaccgagactctgtatcaacaaaacaaaacaaaacacaacaaataacagagaaagggagctttgggtgctccagtgtttgaaggttgaagtcatggaagccaagggttgagagtgtttcaagaaggaaggagtggatcagctctgccaaatgccacccagaagcagtgtaaagttgagaatggcaagtatgcattagatgtggcaacacggatgttgttggtgacttagactagcagatttagttgtgtggcatagaaagatgcaaacaggattgattggaagagtgagcagtgaagttaaggtatgtagacattttctcttgagacaatctgtcagtttaaggttgcagagaaatggaatgatacgggagaggatgggggattctagaccttgcttgtctgggactgatgacagagaagaagagaatgatgacacaggagagaaagggcagatctgcagcaaagtccttgagagggtgggaaggcctaaaattcagagcgaagagtcttggctttaacataagatgtcaacaggaacttggcctagaccttccatttccctgggcctccattctcatccccttttataagtcggaaaggttggaggatatgacttcttggctctcaaattctgtgaaacaaaataactagataccagggagatcagaaaagaggttatatccacagcagttttggtggcttatcttgttgctcaggaagttttattgttattttgatgagaattacaaggacagaaattttttatattaaaaagtgggagatgatctgattccttccagttttatatccagtggtttgtttccttggaaatggagaccaggggcctttgactcgtgttttaagtggaattctaccattattaatgataacatgatggagagctcctggtgatgaggtggtaagatgcgatgtcttcctttgttctaaagttcagccttttctaaatctttttaaaaagaaattgacggccccaaaaacctagtgactgactgggtgacggagaatatggccactgtctcctgggacccggttcaggccaccattgacaagtacatggtgcgctacacctctgctgacggagagaccagggaggttctggtggggaaggagcacagcagcactgtcctgatgggcctgagaccaggcatggagtacatggtgcacgtgtgggcccagaagggggcccaggagagcaagaaggctgacaccaaggcccagacaggtactgagagggaccaggccaggggaacacctcacacttaccaggagagaaccttcctccatcagtgggctggggaggggagcaggagggtggttgctttacccgaggacattcttcaaagtggttccttttttacgtctttgagctaattaagttgacacaacagctcagataagatgagagagtatagagggagtgctggtgtcaaaggtggcctccctcacccctccacccggcccagcgctcagaatctccacacttgctatggagaaaatggttgggcctcagctgcagttgggagaagacagaggcaggagcctcttctgtttccatcttccagaatggaggcaatggggatgcatctttctccattccatcctcagttgatgatgaaaggtgcctgaattgcatgtattttgtgtgtgtgatggggcctctgatcttggcagagcatcactgaggtcagaacccagaggcacttggaagagagcactgtgcccaccctgaggtctatgagcctcttctggcagtacgggcaaggtctgtccattccatccatggctgagctcaccaagtgttgccacgggacctagagatggcttgaatttctctatggtttttattagttaaaattagcttgcatttttaatctaaaaagtaatatatgcttatagtaaatattttcaaactaaatagagacgtgttaaaacaaaacaaaacaaaacaaaaacggccaggcgcggtggctcatgcctgtaatcccagccctttgggaggtcgaggctggtggatcacctgaggtcaggagtttgagaccagcctgaccaacatggagaaaccccgtctctactaaaaatacaaaaattagctgggtgtggtggcaggtgcctgtaatcccagctacttgggaggctgagacaggagaattgcttgaacccaggaggaggaggttgcagtgagccaagattgcgccattgcactccagcctgggcaacaaagagcgagactccatctcaaaagcaaacaaacaaacaaacaaacaaacaaactcctctctctgtcctggactccctagtatgcagggttgctctccagatgcaaccagtagccagttctcccttcttccctctttcccacttcctacctccttctccccttcctttctctgttcctttctctcttattcctttcttctcctcttccttgtttatcttctcttggattcaccttctccatttttgaagacagcaataaaaagattctcattttcctgcttcatagaaatgtgaaagtaactaagacagacatctcaagtccataaccagggagtggtgggcagtcaaagaggtggcaggagattgcttaagatgttaaaatagccacagttttgccttgattgtgaaatcaggaaattcagtttttctgtgagacgaatagaataaaatccatgccagatgttatgctttagaaaatcaaaccaagttgatattacagaaactcaaaatttgtcaaaacatcctaattcaaaacaacagctgtctgatttctattaaaatactgcaattcagctctcagctgaaatgctactgggtagaaaatagcctggagacgtctttttgggaagttataaattaaaataaccttctatgataatgctttttcaaaagagaaatttccattcatatcttctttggttaaaaaaaaaaagagccttctgaccagtgatgttgaccagtatttttgctgagcttctgttttcctggtctacagtgcacacttgcttacccacgcgttccctctagtgtttgggtgaggaagtacatagaagaagagctctgcttttcctatatcccttctctttccctcttccctcccccacctcttcctttcttctcttttccttccttctctctctctccctctttctttctctttctttctttctctctctctctccctttctctcttcttttctctctctccttccttccttccttctctccctccctccctcctctctttctctcttttttctctttctttctttctttctttctttctttctttctttctttctttctttctttctctctctctccctccctttctctcttcttttctctctctccttccttccttccctccctccctcctttctttctttcttttttctttttctttctttcttttttctttttctttctttcttttctttttttctttctttctctctcccgctctctctctcttctctttctttctttctctcgcttctctccctttctttctttccttctctctctctctctctctcctctatacaagcacctgttcccttgccttctccttctcttctttctctactgggtatgcatctaaggccacacacttcaatatgtaacagtatgtaagaaacataactttttgtttctttcttttttttttttttttttaagacagagtcttgctctgtcacccaggctggagtgcagtggcgtgatcttggcttactgcaacctccgcctcccgagttcaagcaattctcctgcctcagcctcccgagtagctgggatgacaggcgaccaccaccacacccggctaatttttgtatgtttggtagagataggatttcatcatattggccaggctggtgtcgaactattgaccttgtgatccgcctgccttggcctcccgaagtgctgggattacaggcatgagccaccgtgcctggccaactttttgtttctatgccaacttaatttcaatcataagcccatattctacttagggtaagctccttcctcagggctgtatgtaagtcttgggtagtttcccagtgacaggcattggggcccatccagcatttcaggcaactttccaggcgggccaagtcaccctggtttctttgtgcatggccctttcagatctgtggccctcttatctttccacatccttttgggagccctgccatctctgaggatctatctgccaatctaggctgttaatatccaccactttgtgggaacctgcctgggaaatgggggcccagattcctttcctctgggacccacccaacgccctgttcttcttgtctctaatgggtctgtacttgtagaaacaaaggtcagaaaggtcctgtggcagggaggaagagagcctgcaaactgcttgaaagaaggaggagaaatgggagggtttgaaaaggggaaaatataaactgatgtctcaaaaattaccttgcctcagttgtatcttagtaataacaattacctgactttctacgtacagaactcgaccctcccagaaaccttcgtccatctgctgtaacgcagtctggtggcatattgacctggacgcccccctctgctcagatccacggctacattctgacttaccagttcccagatggcacagttaaggtacggggattccttgtcttttctcctggtgccttctcttctgtgtgaagcaactaacttgggccaatcagctcatttgctggcctcacggcaacttgctgatctttactgatcacattgctggttgtacatctgccccgggttattttgtttattgttagtcttccccaataaatgtaagctctatgtttgtctgtttcatttatcaccatatctaaagtgcataggacagtgcttagcacatggtaggtgttcgatatatatttattgaacaaattgattaacccttatttcaagggttatacctccccttagaatctgaaggccagcaaattttcaaaacctgtcccaatggaaaattattattctccctccttgccaatgaagaaagaagggaggaaataaaaacaggaaggacacttaggtttatgtgttaccttaattagtgcttatgacagcacagctaggaaggttagccctatgtttatagaggaagtaagactggttcagaaggaagtttattgaaatatcaactatctccttgtctcagatatcagtggccagtttcacctcccctattaatttctccttagcgcggcattgccagcctgttcctgctggcaatgtagccactatagttagagcccctgtgtgtatctgaaggccaaagtctcccagaaacttggccggtgatcctgaagctgcagtcctgggtgctggttctcagctgatgctcccagtagtgctgactctccatggcatggctctccagagaagtggctgggacccactgcgattctgggctgccactgaggcttcggagagacaaaacactgtgctctcagagagcttctgtcattagcaccagggaacgctgttgacacctagggtgctagtgggtgataaactgagtcactggctgtctaatctctcccttgtttggtaggagatgcagctgggacgggaagaccagaggtttgcgttgcaaggccttgagcaaggcgccacctaccctgtctcccttgttgcctttaagggtggtcgccggagcagaaatgtatccaccaccctctccacaggtaatatggaatcctgtactctgaacgaccatgcaatgagaaccagcatcggaaagcctagcaaaggagtccagggaggagcaagtggatgcagaactattgatttctctaggcatggggaagtggaaatggggttgtgtgttcaaaagaaatccaccccacagtggggaggctaaagagaggagtgaaatagagtgttactttgtgagggagctgagttgggggaggaagtgatgtgaacttgaccttttcctggtgcatttggggagttgatgagaaaaataagatatgagtgaagagttggaagaagctgaagtaggaagttatgaaataatttccaaacaaaataaattgccttaaaataggaagaaactccacctctttcctccttgcccttgtcctaacaacactctctctgcttggctcccagttggtgcccgtttcccacacccttcggactgcagtcaggttcagcagaacagcaatgccgccagtggtctgtacaccatctacctgcatggcgatgccagccggcccctgcaggtgtactgtgacatggaaacggacggaggtggctggattgtgagtcacgcagaaccctggggagctctgtgtagggccttccttctcagcccaggatgccggtcatggatgctccatagagtgtttggagccctatttcttctccactcatggaagagaggagttttggtggcttgtagctgtttttagagagatcccaatgttacaggaaaggggtccccatccagatcccaagagaaggttcttggatctcatgtaagaaagaattcagggtgagtccacaatgcaaagcaaaagcaagtttattaagaaagtaaagtggtgaaagtacagctactccatagacagagtagggcgtttctgaaagtaaggaggaatgcatgcaccctatgtacaagacttgtttatatataggataaaaaaagatcatgaggggatgtgctctattacaatggttcgtgataaaggattaattttcttaattactatattttgcgagaatcaatattattatatttaaagcaacattaggagtgcttctgttctcaagatatcaggacattcctaagtctgggtctgtttagtaaacactgtcaatctgttcccttaaccataaacatctggaggctaggaatacctaactttctgggaatgcagcccagcaagtcccagcctcattgtcttagcactcactcaagatggctctggttcaaatgcctctgacaccaatcaactgtaaggatagagcctagtacttaaccactgtcctagaacaggcttggttagactaaggctgatgactatgaaggcttgtgagttgatcatcatctagtaatgccttatatgtatgtattacctatattttaccttcttcaaagcacttctgtacacatgaccctcacacaacagctttagagtaagtgagagaggattgtttttcttattttacagatagggacagtgagtcccacagaaagaagtgcctggcctaagtcatacaagaatgacaaagctgggaccagatttcaaaactccagcctcctaatcattggtcttctcagtgagttcatctcaggtcatccaagatgcgaatgcatagcctgactggggagttcagacctctgaactggagtccattgtccaagttctgtaccctgtctccacagtacagcaacaaggcctttgaggttttgattggaaagactaaagtctgaaagacggaaacttgggcaatgctctaattgtccctcttctgtgtagatgttttattctcttgggccattgtctgcctaaaccacatggcagcttctttgattgcatcagcctgatccaattatatgataagctgtttttgagggttgcaatctgatccttccatctccccttgccccttttctccctgtgcctgaatgataaagactctcactgctccaagccagcatgcagccttaacctgctgtgcatccgcaactcactgtgggaaagagagagcatgatctcatagtgctcaaaccttattcatttacacattcactcaggggcctgggaaaccaaagacacttgagcagccatgaataaaaagataccatctgatgagcagcaatgaagaaaacttattatctgcacagcgacatctgacggttgaaaggcagtaattggattggctgggggaaattcccgattgatttataaaaacaacagagcagaatgtaacatgggaggtcttccacttgaccagacccatagggctgtacctgctgcttttcatcagcaccattgtaaggctaagcattctgtcccttcaggcctgcagcccaatttcctgcctttgtgcctgtaattgacttttggcaggacgtttgtattgtctagtgtggcctttttgtaagccaagctcccacacagaaggagttatctggggcaacatttagaaagagatctgtcagtctgtctgccctggaatagtcatgacttattgcacatatatttattgagtgcctactatgtgtcggcactgcttcatgtactcaagatccagcagtgaaccaaaccaacagaaatccctgcccccaaggagcttgccatttacatcctgctcatgcaaatgacccctcctcaaacacagagatcggttccaaaaataataaaaccactgtgcattctcaccctccccagccccaaccccaccccaagtcttgttttctgagccagactcctgggggtcatgcatgaactgaggttctgcagggttttacttaaagccaccatgctccagaaaacatggagtcctgaaaacttccccacaaaacattttactgacagttgttacagtttttttgggggggttcaagagtcctttgtcactgaaggatgacccatggtctgtttctctgttttattgagctttcaaaatccttttatggtaattcttccatcccaagcaacaggaactcaatctgaagaataggccagaagaactgtgccctgaggtaaactctgccgctggtgggaggctggaaagaacatcagggaacacttaatgtttcaaatatttccatctttgttttccatcttgaaagtcttaatgcattagaggctctttccacagacatttcaatgcaagtttgactttttttctctgtatttagtcattcagggcattgagtaagttctagaatgcaatgacaactctagtatagaaccagacacaaagaggtttcttttgtttgtttgtttttctccctttgaaacttatttggtaagggggttttgtgatacccaaatagttcattatagggtgttttcatctcatagaatgggagtggattagactctgagtgagtcaattaaggctgcctgatcaagatgtataaatgatccctgtgggtcagttcatttggaaactgatataataaaatgcaaactaacatttattgagagatcataataacttattatatctatatatgccagggtctggcttaactactttatgatttactatgattaatgatcttgccgaagccttgatttaagatcgtgacggagaggctgttaacatcttaatctaacagtttagaaaagtgaggcttgtcaaggttgcccaaagacacaactagtaagtatagaactggttctggttcaaaacagtgatgcaaagagcaccagaatcatttttggaagcttccctggcccagatgaagtattattacacacacacacacacacacacacacacacacacacacacacatcgctggaaagctcctatcaagcttgggcactgggttcactgataggagatagagaccaaatacctttgtaatgcattctaggggggcagggttggatttgagcctgaccttgtggtgggaacgtgatttgacgcgatgtacgtggagccatacatcggtgctacatgtatcctaaaattccactgtccttggtacaacaagagtcccaaggaaggggttggaccaggcaccttgctaggaaattagcaagttctcagagtctttgaaaattcgatttgggaaacagattcagtagggctggtattttcaaactttctgacagaaagataagatttatgcgtggtctttgtatcagtgattagctgtaggactctggatactcgcttttctggactttcacatctgtcaaatggcatcataaatacttgctccagggccagcactcacgaaatgattgtcgtctaagtgaataaatgagtgaagaaaagtgagggaagccaagaaggaaatagggcatttttaaaagatggatacttgagcaaaggggaaagagaacaacaatgttaatgtggtgttagctgtttgccgtgatatttcctacattctgttcagtagctcttgcctatttatagaacatttttatgtggtgtctcatttagtcctcccagaagtcttatgaagtaggctcttctcttcccttccattcctgttttaccatgagctggctgagggtcagcaatagaagaggctgcctcagcaatccccacccatcccctgcccaggaagtggctgtggtctgacttggagtctggagccttctgcatccatggtgccccactccttggccagcagacatgaatgggtgctttggaaggagttaaatatgcactcccatgtggagctttcagcattgctgcagggtaacctactctctcttcccggagaaaaatataaagaaggcacaaatatcaggtggtttaccttataaattcaagataatgtgttttacttcaaggcacatgctgtgaagtctagtggaaaggagggagattagattttgtgttggggcttctgcatctgaatgaatgcaaagaaaaataggcagagagagaaatgcaattctagcctttggttagtgggaatcgttcctgaggttagctaggatggcattcagcttggctctcaaggtcatgtggaattagatgtattatcaattccaatagtgtatacaggtgtgtgtgggtacttttcagatttacttcctataaaagaatccaatttactgtgactggaactgccttccttctccaaacagaggaatttttgaaaagaaggcagtccacactttggtgaatggcacccaactctgcctccattttcttgcttctcactcattctttggcccgttccagtttggcttctgtccatatctcacactgacacagcccttgctaaaatcaccagtgatttctgtgccactaaattctagggatggttttggcctcctgttccttgagctctcatcagtacttgacactattgaccacacctttctctttgtggcttttgtgattccatatttttctagtttctttttctccacttctgttgccccttctctctccttaatggattcgtccttcttcattatacatattggatgtcctcaaggcttgattctaggccactttatcttttcagttcccattttcttcctacgtgatctcagcttttcccatgacttcattttaccctcctctgggtcccatgcttctctgtactaattaggatagaatgggctccaaattccagcgactgaacaaacacagtgtatttttcttatatgtgcaatgtgttgtgcaggtttggcagccagatataagtgtgactcagggattcaggctgtttccatcttgtagttctgctgtttcagtgtgtggcctttcccatggccccatggtgcatggcagtagaagagagagtgtggagaacccacccacacacaaaaggctcccacctacagccttttggctgcaaacagtcacatggctccaacttaaatgcaagggaagctgtaaatggacatcctcctcctgtgttcctgggaagaggaaagtgaactgggactcagtgaactcctagcattgcctgagacacactctaccttaataagtctagcatagacctctctttagaactccagcccttacatccaattgctctgtggtattttcattcactagcacacctcagaaataactcacacttaaccacatccccaaatgagctcatgacccattcataaaacctgtacttggccaggcgcagtggctcacacctgcactttgggaggctgaggtgggtggatcacgaagtcaggagttcaagaccagtctggccaatatggtgaaaccccgtctctactgaaaatacaaaaattagccgggcatggtggtgtgtgcctgtaatcccagctacttcggaggctgaggcaggagagtcgcttgaacccgggagacggaggttgcagtaagccaagatcacaccactgcactccagcctgggcaacagagtgagactccatctcaaaaaaaaaaaacaaacaacaacaacaacaaaaataaataaataacaataaactaccacctgtcctctctgaatcccccatctcagtgaatagctgagagaagagtcatctgcaagcccatactataagaaacttatcttaccttgacttcctcctctttcagttccacattctgtcaccacctctgtcaactttaccttctatgcacttccatctattctcagggcattcctcatccaagctactgtcccccttcatctgcactctacagtggtctcctaattggtcatctcacttccactcttgcccctgaccagtccattccatacactacaagctagagacgaatctgattggatctcatttcctgcttaaaactctgcaataatttccagcgctcttacctggaccaacgtcttcaacaatcccttttaaaggctcaccaggactgactcttgccatcttctcagcctccctttccatcccttcctcagcccccagaagccccaacattcacccccgtgctcttgcctgaccactcctactcatcctgcagctcagccatgtcctgggggtggtttcttggctccttggtcaggtcctcctgttttatgctcttacagttctgttgcatctttccctcatagcccttatcacagttttaactgcatttaaaaattatttaatttagtaattttatttactgaactattagttccaggagggcagggactatttctgatttattcactttgcacactatcttgcatattgcctagtacatagtagatgctcagtaaatatttgttgtgtgaacttttttctccataagtattaaataatcgctatattaagaatcaggtgaattaaaaaataattcctaccctcaaactatttcagaaaaggggaaaaaagatgccataaacatgatgtgccccaattgagttgaatgggtgttgaaagttacatgtgagagttagcagaggtctggaatatcttgccctagacaacccacactagcaactgaatcacacaactaacggaaagaattgaaatttcttgagggcaggaaccttctctgcttttgctctacatgtcttagtacctggcatactactgtacatataaagaatgcttattaatatagtgaatctactgacatataaataaaaagcctctctagaatgaaaggcttgctagctggaggaaggcagtgtatgagcaagctcttggtcttctcttgtctcccagcacctatgtctgtttggagggtcagagtgaagtattcatcttccttctcaggtcttccagaggcggaacactgggcagctggatttcttcaagcgatggaggagctatgtggaaggctttggggaccccatgaaggagttctggcttggtatgatctcagaatccaggaggctggggctgtggggggtgatttctcccaggacaagctagctaggaggcttagggaagctcaccaccttcacagagaggccccagtggcagggagacagaggactgtgccgagcagggtgttggtgggcatgttgatgggaaggctgtcttgcactctgaacttgttgaaaggtagggtggtcacaggggttttatgctgatttaagctctgcaggatctgcctgcagcctgaagatcttagaagccacagtagtagaaaaaaagttcagtgattgggatgctggtccattactgggaggtcactctagcagtctctaaaattctgttcgtgatgccaggcattatgagcaattttttcccccttttccctctgctctcctctggagcagatgttcacagacagtgaaatagccaaaagcatgaattgggaaatgaagaattaaaaagtcatagttcagatacccagtgtctaataaagtagatgatgtttgtggtttgctcagtgtaaaatctctttggggatcttaggatgagtcgttgacctgctctcctacttggtgagataaatggatgataaatacaactgcttctgttttagaaggatggagccaatggaggcagattccttctggggttaccctgcccccttcactgctcccttccatagaatgtggtcttcgcactccttagtgtgactatgagcccccaaaagagaaagtgctgagactgccccttattagcagagaaggtaaagactaaagtgactttaggttctgaaaacctcagacacacatgttgagtgcttactcgcacacatgggttgattgattattggaattccattttttatttttaggacttgacaagctacacaacctcaccaccggcactccagcgcggtatgaggtgagagtggatttacagactgccaatgaatctgcctatgctatatatgatttcttccaagtggcctccagcaaggagcggtataagctgacagttgggaaatacagaggcacggcaggtgagaaaaaatgttttcttactgcgaaggtctcttgctgtctgttgtgtaaggattggtttgccgtgtgccactgatctgggggatggaatattattctgtggaggtgaattgttctcattgacagtggaggtcctactctctgcagggggtcaggagtgaacaaatagttgaagcaatccttgaccaccataaaattggaattttgtatgttatatgtcatccccccaccccaataaaaaccctccccttgtactcctcttattcaggctgttgtacattagctgatgagcccatattctgaacaatttcttgatgcttgtcagtctttcattcggctttagcagtgtggctgtcatctttgtctgcacagtagtgtgtgtgtgtgtgtgtgtgtgtgtgtgtgtgtgtgattgagcttttggtggcactttgctataaaaacagaataaggaaagtgctgattcaaataataagaagtataggtctcattaatttaattcaactgtgacaacacagaaatgagcagttcagtggaaagtgaaggaacctttagcctctagtagctgctcattggagctaagccagttgctggtgtgtttggttgtgagggaaaagagcaaaattaagcaacatgactgaaatgctggaatgataccagtaaattaaatacattatgtaagagggggaggtgtggtcattgttttaataccaatattttaaaagcggtatttatggcttttaaaccataacaagtgttttgacatttgcctgtgttttgacatttgcgtttttgactttggtgtatttacacaggaatgtgttaccagccagactgaccgactgtataagacatggcggtctctctccttagacttaaatgtaaataggtgaatacaaatagaaggtaacttttgcagagagtcaaataaggggtgagaaacataaacagttacaggagtgtggagaaggtgggcacatggagtacgaagcaactggagggagctggatctgcaaaaaggggcaaactcaagtgggaggaaatagagggctctccaggcctgggggctttagggtgagtagggactgagcagaggcaagaatgctggagtttatctcacagccttgctggacttctcaagaccatgtactcaaggacccctgatggcagaagactgtgaacagaacttctgagtgtctggggccatgatctgggtggccaactatgaatgcaaaccttctttgagatcttataatttcatttaaaaaatagtcacatgaattttgcatttgttcttgtttcccagtgcctatctcagagcctggtacagagtaggagagtttaaaaaatgaaattgctagcaggacttttctatatacataatcttagggatgtttagtatcttacattatagtccctgagacccaaataagttccataggggtgaatgaaaggtgagtttggtgacatggtgacatgggaggggacaaagagggaggggtaggcacctaccagagtatgaggcatttgggctacagacacggggaaactgttccaggattctgagtaggagttgggtgagaaaaagtatgcaaagaattatttcagggaaaagacaatccttgaaaaaaaagcattgcagctagaagatcctcactgcctttggatactgtcacttctttcctaagtagtcctgggtctccatgggctgaagacaggctgtgctacatgtacttgaagtataacatagtcatgcattgcttaacgacagggatacattctgagaactgcattgttaagcatttcatcattgtgcaaacatcatagaatgcacttacacaaatctagatggcagagcctgctatagaccaaggtatatggtgtagcctattgctactaggctacaaacctgtatggcatgttactaaatattgtaggcaattgtaacaccatggtaagtacttatggatctaaatatatgtaaacatagaaaaggcacagtgagaatatggtataaaagataaaaaatggccaatctgtaagggtacttactatgaatggagcttgcaggactggaagttgctctgggtgagtcagtgagtggtgagcgaatgtgaaggcccaggacaggactgtgcactcctgtagactttaggcacactgcccttcggccacactaaatttatttaaaaatgttctttcttcgttaataaaaattaaccttatcttattgtaactgttttactttataaactttaacatctttttcaatttttttgactcctttggagtaacacttcgcttaaaacataagcacattgtgcagctgtacaaacatattttctttctttatatccatattctgtaagtttttttttctatttaaacattttttatttttattttttactttttaaacctttgtgttaaaaactaagacacaaatacacacattagcctaggcctgcacagggtcaggatcatcaatatcactgtcttccacctcctcatcttgtcccgctggaaggtcttcaggagcaatagcacacatggagctgtcatctcctgtgataacaatgccttcttcttgaatacgtcccaaaggacctgcctgaggctgttttacaggattttttttttgtaaagtactcatacactctaaaatagcaataaaaagcatagtattattcacacaaaccagtaacataattgtttattatcattatcaagtattatttactgtatgtaattgtatgtgcaagacttttgtataactggtaggtttgtttacaccaaatcaccacaaacacatgagtgatgcattggtctgcaaccttacgacagctgtgatgtcactaggtaattttcaggtttattgtgatcttatgagaccactgtcgtatatgcagtcccttgttaactgaaatgttcttatgcagggcatgactgtataaaacatgaaagtcagatatagaaaaaggcagttataatacagttgggaaacatagatggacattcatatgattatgaggatattaactgaataagaggggatttaaagatgctattttgtgtgactaagcacactgtccatatcctcccaccccatctctaaatgagatcagactatgttcctgacagcttattccaggttcttccaaccctttggtataatacagtacacacattccagtctgtcccagagcccttgggcctcttcagtccacatggagtccatctgatcatttctttggtttccagtaccctgttgtctgctcttgatcatggccatcggttagcctcagcctttccttctcaggttaaagaagtctacataagctccatgcgtgggaccctccctggacacaatatgaagtgggtgtttttctttggcccgtgtgccccacatctctccctgaaacccagtgccctccctggcctcctggtcaggaacctcactcaggcctgtcctcccgggctgcacatttcctttcccttggccattaccatttgccttttctgaagcctgtgttaaagtgatccagcaaatgaactgatgccaatgggaaagagactgaaagggagtcaacatgtttggtgagttatttaattctcctcccaggtactctgtttgcatgttaactgcaatgaggggataattcctgttctaaggttgttcaggccaacagtgccagcaagtagaggatgtattttttaatagaattattttttaataggagactttcacacagcatttaggcagcgatctagtcttcccatgtgtactatcattcccgcttttaaattctgaattacaatggtagggttagtggagttttagcgttccttatgtacactgatttgtccatgaggagggtttcagaatttagaaagctcctggctactcatgtcttgaatgctgaggcactgtttagaggacacggcattcaaatggaaggtgaatattttgatacctccctgcacgcaccagctctccccagcctctatcttcattttagctctgattagaactggcatgcatgcagcctggcaggaatgtgtggcttaaggcttgctccccactcagactgtccaggtgggccctcaacttttgacttccactcaagttatatcagaaagtccattttcccttcatgaagcaaattccagcaaggtaatgatgtgtaaatttagtttctgattctgagtcttctagtgggggcagggaggctatcttatgagctccaccattaagatgttattcatctatttagagatcataatgcaaacataaagagctaggcattcagaatggtgcagaatgaattctagggctaaccaatgatttacagctgatttcgagtcccacctgcatgggccacagtggggacacaaccagggatggatcccaacctgggggcatttggaaatgtgactggggagctctggaagcatttagtgggttgggaccagggatggatttttaaatgctggcacctgaaaaagaaaaaaaaaattaatgggtacctggatgaaagggagagctagaaatggcacaaatcatttgtaatcatccattcctaatcctgaaataaaagacattcaaggttctgacacacactactgtgtctgtgtgtgactgacaggggatgcgatgttaatggcttctcctgatctttgaaggttcagctgcctgggccatctttcccaacctggtgaatcctagagggggagagtgggcctcagagggacattttgatgagatggatggtgaccaacttgatcccctctgagtttgggcacagacctttcatgggcctgccatgaacccctccagtcctcattctcactctctacactctgaacattaggatggcttcagtttctagaaggtagaaaatccttctgcagaaaaagacctcccacatttgggtgaaaacctgctttacctttctttatcccagtgcccaggtttagatcatcacaaacatgtctttaagagagcctctgcacagattcttagaaagcagccctgggaaccttctatgtaaattagctaagctgtgctcatttaaagaaggttactaagggagacactgcacgttatttcaagctgtggttaactttctgtacaaagtctagagggaggcggaaatgtgtatgactagcatgacaatatacctttcttggattggagaaaactactggagacagacctgtctgctgtgtttgcgtggaagtggcctccgtggccccagaatcctcctgctttttctgggtgaggcataaacgagctgctggtgagattgcagacttggagggggcaaattaggaccttcccttttaacatatgctaccaactctgcatattcaccccacccactccaaaaacgtttttgagagcaaggaccttcttatttttgtgttcacagagccaagcatgtgctgctccatagcaggtattcagtaaatgttccctaaaaaacaaataagtgaagttgtagaccagaggttctcacactgtagcctgcgtcagatcatcggaagggcttgtcaaggcataggttgccggggcccaacctgtagtttccggttctgtaggtctgggctggggccaaataatttgcatttcttttttcttttctttttttttttgagatggagactcactctgtcacccaggctggagtgcagtggcacgatcttggctcactgcaacctccacctcccggattcaagcaattcttctgcctcagcctccagagtagctgggactacaggtgtgcaccaccatgccaggctaatttttgtattttcagtagagacggcgtttcactatattggccaggctggtcttgaactcctgacctcatgatctgcctgcctcggcctctcaaagtgctgggattacaggtgtgagccaccgtgcctggcccatttgcatttctaacaagttctcaggggatgtggatgctgctggtctgggaaccccacttgaagagccattgatagatagctctctcttgctagcgtgcaagaagccccccattgaaacaaggaaggcataggtggattggtgtctcagaaagaaccctggacttggaatctcaggacagagatttgagtcccagctctgctgtttgtggacggtgggaccttaagaagttcctagagtctaacctttttgaatttgtttccccacgggactaagagctgccctgctcacttcacagggttgctgtgagagtgagatgagaatgcacatgcgaagaagatcgctaaacttagagctgagatataaatgtaagaatctttattgcaggaacagagcttgatgaagcttgtgattgatatgggcccttattgccttttatgagcagaaaaagaaagcttgtaaaaggatgaaaaatatgatagggaaacaggagatacataagcaaaataattaaagcagttttccagatgggatgtaatgaaggactgaattttacatgtgtctccagaagggctctggaagttcaggagtgtttgtgtgtaggtgtgtgtgtgtgtgtgtgtgtgtgttaggagggtgcatgggaagaccaataaagagaatcttctttagaagtggccttgagctaggctttgaagggatggttgggatttggacagatgagggcagagagaaatctcctggaaggtgggctggtccacagtggagggtgtgtggtggagatggtgggatgcaagactgtgcatagggcacaaccaacctacaggcctgcaaggcatggaagaggaattcacctccacgtggtatgaagtagactgttaggcctgagatgatgaaaatggacgtctaaactccagaggggctggcaggcaagaagccagagagaaggctgttttgttaacacagacccaggatgagagaaggccgagggtggctgtcatgggagcagagacataggggtgtatgtgagtgacctgcagagggagggcttgagaagaggtatgaagggattgccaaacatggctccaggttccaggtctgggtggtgtggagaagggtggacccaaggcagagtggggagagtggagagtggtgctcttgtgtgtggtgtggtcagggacttggggagagttgttatgtttggatatttgatctgactgtggagcttccaagtgaaaatgctatgagaactgttggagaaacaggcctgaagttggggtacaggccaggaaagacagcttgttcccatgtgtcatgttcccatttgggctgttttgagagagcggtgactacctgtgacatgactggctgcatctttggcattttcatgcctagagatcttcctgctgggtcctcttttgatcatctcctcggtggctaaccctgggctctcgcctccgtctcttctctcctgcaggggatgctcttacttaccacaatggatggaagtttacaacttttgacagagacaacgatatcgcactcagcaactgtgccctgacacatcatggtggctggtggtataagaactgccacttggccaaccctaatggcagatatggggagaccaagcacagtgaggtaggtgacaggtgaatgtcttttctgtcccagggtatgtccatattcagcttccaaatggacaccctccaggccagtctggcagcccctctccttctgaagcttccagtcaaagcagtagagcttctcctccaggctccatggccttgaggtcgtggcctcccttcctgatggccatggccctgcttgttttgcattcccagagctgcacacttgcctaggggaaggtgcgggaaaagcttgggctgcccactgccatgtaatgacagatgatgtgctctgcacgctgtctcattttactagttcacacactgtcagctctagctgctgtaacaaaataacacagaccaggtggctcaaacaacagacatttatttctcacagttctggaggctgggaagtccaagatcagactgctggcagatttggttcttggtggtggaccttgctggcttgtggctgtgcgtcctcacatggcggacagaaaggagctctgatctcttcttcatataggggcatatgtcccatcatgagggctccacctcatggtctcatgtaaacctaattaccttccagaggccccctctacataccatcatgttggtggggggtggttagggctttactacatgaattttgaagagacacaaacattcagtttataacaaacactgcctactttctagttgttctcctagttgaacaagagctatttctttaggctgagcatggtggttcatgcctgtaatcccagcactctgggaggctgaggtgagctgattgctcatgcccaggaatttgagaccagcctgggtaacatcgtgaaaccctgtctctacaaaagatacaaaaattagctgggcattatggcgtgcacttgtagtccctgcctctagggaagctgaggcaggaagatcacttgagcctgggaggttgagactgcagtgagccatgatcaagccactgcactccagcctgggtggcagagaaagaccctgtctcaaaaaaaaaaaaaaaaaaaaaaaaaaaaagctgtctcaagtcctttgatcaccaggaaaacagtcttttgtgccttaggtcagacctactcttggatccacttcacccaaaaccttcccagaacattgagctagaccagtctctccacattgggagtgtgcgcccagggcccaggggtccaggagggctcctcttcccacattgccctgaaactgtcccacccgctatttctcaagcctcctctgccccagtgcatcatcctgactctttgacagctgcggggcacttcccacctgctccctcacagtttcttgaaaattgcatctttgtctctgctcgtcattaatcctctcccctccacaaaccctgagtccccatcctaggtttctaatttcccatctgcagccctgatcctaagcctccaggaagccacctcttcagaactcaccttgtaccaatattactgtaaatattagcacatccgaagtccaggtacattttgattactttggccctgaccagtcttcgggactcccaatctttatgtgatttttcaaagggaagaagaaatttgcccccagggaagctggggagggtgggcccatgaatcatggtggcagcgtgtgggctgactcagggaagccagggataggagatcaaatattggaaacgagcagccaggatgccctgaaccatcccatatttgctaataaaagacattcatctgtttaatgcgcttttcacagtctgcaaggcatttagcttcttgtttattatttacctcacaaattaaaatacataaaattggtcacttgggctttttattggccaggttgcagggttattaagtgaattaaatattattgcgctcaccagtcaaaagaaataaaatgaaatttagttttcagcaggctatttgttaccccagagctaatatctaaacagtctaaattgaaaatgattttacacaactggccaattaatatgtttatttttgcctttaattttttggaaaggaaaagagtgaaggaaagataatttgcccattgccggcccggttgacccctgtgttgtctctgtggctgctctggcctcacccagctcccgggctcacacccccttgctcccaccatagagaccgccagcttccaaatcgtccaagtcctctcagcccgtctaaccccagctgcccagcagagggcgcgtgtgtccggatcctgccctcccctcccttctcatcaccccgtctctttctctctcctgagcagagagggagtggtttcactggtaattaattaattaattaattcctttgtaccataacccaccctgccctcctcctaagagcctcttcttgatgtggcttttttttttttttttggtagggggtgaactgggagccttggaaaggacatgaattctccattccttacgtggagttgaaaatccgccctcatggctacagcagggagcctgtcctgggcagaaagaagcggacgctgagaggaaggctgcgaacgttctgatggcccgtgtgagcagtcctcgcaggagacaccaccagctgtgggagcttggggcggggtgggtagtggtcactgcggtctgggagtgctcagatagcccgcagaacaaatcatgtcaccaagcttcaagccatggaggttccttccctctcacctgcatttttgcccgtctttatgagggtcttgaaaatcaaaatagtagttgcacagtatgtgtaggaaagacagtactggaacggcaaggtttctcagcttatcttcagcaacatatatactggattagggcaagagaaggaatcacccagcacttcaccagttggaaatctctggaaatttacatctatgtatttaaagttctgctaatgcaaatcttttctctggaaagaagcacagaggaggagttctgatgacccaggggttagggctgagacaaccggacgtttgtcacctcctttcccattgggtttttaggaaaacagtgtgaacctcccccttttaatttctggtgttatgaggaagaataaaggggataaaaggggctaagatggactcatgtttagctaagttctgacttgtatccagcatgctggagaccaaagctgccgccttactgctatttttaagtgccctcttttcagtcatttgcataattgcgtccatagagctgcatatgttgtgaataaattctcactcatttcaactttgaataatttgactgtcttgataattggttcctcccaaagactcttctgcaactcccattcatgcccaccaggcctcagactccctcttttccccgccctgcactattggagccctgggttttgtgggagtgctcagcaccgtgagtcttactgtttgatcggacagttagcaagatcagatcctttttgcttattttctatcactttggagggttttctgtagcaaaatcagtgaccaatgaagtaacttaaattcctattgaagaaaaaaaataataaaccacttgatttaaaaaaaaattgccatgtgttattttcctccacgtaagtgcacttgaattctaaatttaacctacatgcaagtgaaggtacaattcgtgcattgtaatggaatttggttggctgtggactctgatttgcatgatgggaaataatggtatttagaatgcagaagtgagtgaatgggaagtaaggcgaatgctccaaaagctgccgtacccctccaggacgagggtgtagtctattgcctagatgtctccaggttttaacctctgggtgaatgtcaaaccatacccctgaaaccgtttctgtcaacctttaaagtcttcagcatccccctctggtgccttccttccccagacacacacattgagcaatgccatggtaactgctcgctctgataatgagtggtctcagtgaaatacagttttagtgttgatgctgacgatgaaaaaatgtgcttgcatgttattaattgattcaacaagagtttgttgtttgctttgtatcaagcagtgtgctgggcactggggaaacaaaggtgagcaagatagacactatccttgtattgatggagcttgtgtgctgtcattcattcattcgtttacattcactcattcaacgaatagagatgaagccctattatgtgccaagttccattctaagcattggtgttaatcaaggacataacatcatattcctgtccttgtgctaatattctcatggtggaggctgacattaagcaacaaataaatgtgtggttacaagaagtgggaaatgccgtggaagaaaaggtaggatgagaagatgaaggtgttgcatggtgttggactatgaagcctctctgaggaggagatgtttacagaaattgaccaaatttctcctagtcttgatctaactttatcagggcctgagcctgagctaatttctttgtctgcctttttttttttttttgaatggggtctctctctgtcttgcaggctgctgtatattcacatgatcaaggctcactgcagacttgaactccagccttgaactcctgggctccagcaatccttccgcctcagcctcctgagtagctgggactacaggcacatgctactgtgcccagctaattttttacttttttgtagagatggagtcttgctatcttacccaggctggtctcatctgtcttaaaggtctgtctgcacaacttcccagttccaagtcttctcctcaaattctcttcttttaaaaacatttttgtagttttttaattgttttatttaatagaaatggagtcttattgtcacccaggctgtgtgaggaaaacagtgtaaatctctcccttttaatttctggtgttgtgaggaagaatatagggaataaaaaaaggcgagtgcaatgtgtgaccacagctcattgtagccttgaattcctggactcagcaatcctcccgtctcagcctcctgagtagctgggactgcaggcgagtgccaccatgcccaactatacatctatatctatatctttatctatatctatatcatctatatctatatctgtatctatatgtatatcatctatatctatatctatgtctatatctatagatatatagcaggctcttgctatattgctcaggctggtcttgaactcctggcttcaaatgatcctccagccttgactcgggaagtagatgggactacgggtgctagccgccgcacctggctggaattcccttctgctgttccgtgaccccgtttgcatgtggggtactcagcttcgtaattatgaagctttgggctcatcacagtgatccagggtttttagaaaagtgcctcctttgcaaaatggattaaatcccagaaattgacttcgagccaaggatggtgattgttggcaatgcttctcaactttgaacatgcttgttaacacagagatcacggggtcccttccccagacgctctagttaagtaggtctgggccgagggctgctgctggagtggtgtccactctgagtagctgtggtgtgggggagccgccggtggtctttttgctctggaggagcctgtgatggtagcaaattacaaaacacacacccctgtgttcattgaccccagggtttctccaccactgggcaagaggaggacttttgggaaacaggagctatttcttacattattttgcctgtaggacccatggtgcacaaaggagcgggtgaagaaaacctcagctgacccttcaaaggttctactggggaccaggaaggaagttgagagaaactcattttcaaagggcctctgtctgactgaggaaaacattccaacttgaaacttccatgcctaacctcattttaacgtgaccagtgctcacaacttccaatctggtagctgaatatgggcccgtggaatgggtttctggatagacctgctttttagagagagtcaattttcttagaaccaggttatgagccatcaaggttttgaagcttacagggacgatttctaccctttagaacaaactaaagcaaacaaaagctctcatagaaggcacaggctgcaagccaggcactagggtagatgcaaagacagaagtcttggtaaagtttccaaagtgttgccttttatgcaggacatgagcaagacagtgataaacagaacacaaatgtggccttccagcagctcttggagtggtggcagaggcagccatggaaacaaactggggagagtgagtccacagggaggtggactgaacactgtgggcagagtcagggtgactcatcctgccaggggtgccaagggagagagcttcacggggatgtgatgtcggctttaagtctggaaggatgagttctggggggagaaaaaagaggcccaagaggggtggggcccatcgggtacaggcgacttggcagcaaggaagagaaagtgtggagtgtggcatgtctgaggggggcaaagtggtttcttactggggtgaggagagcttggtggggagccaggctggtgagatgagtggggattcttcctttgccaggccagtactgaggttctcagcgctcactacctgtcggcggcggcagggggcctccatgggtacagaagctccactcccctcaacgggctctgctccagtgggtctcaggtgagttctgtgcacctgagcttcctaaagtgcccccaaggattccaacatagaccacgcttgagagccactgctcagatgaaagcatgtggaaagtggggaacacacaggtttttaaacctgagagtgacaaggtcagatgtatatttcggaaatatcagtctggtgataggatagacaacagggctgggggtgttgagggaagttttggaggaaggatagggactcacaggcaagttgagtgctattgtgatagttcaggcaagcggtcataacttccttggcctgtggcagaaatggtggagaaggggaggagggtctagattagtgagatatccaggaagaaggaatggtgggctttgaggaggatgggtggtacaggcaagagatgggtcgtttcatgtcagagcttagagctggttgttcctgacagtggcttcctctgggaatagggtcccagagtttatgtttgtcaaatgagatcaaaagctctgcgtttaaaatttgaattctcagggatttaaagatgattaaagccaggaaatgctgaaggagctgaggagaaagatagaaaatgcctccagaaattgtgattgaggaaggaaaaaggccaggtgtggtgtgtgaggagatgtggacaggggacatgcagatgaagggatggcatggcagaaggaaaaacaagtataacagcgagaaactcttggtgaaatttagccagttgatggaaaaggccctccactaatcccagctacgccggaggctgaggcaggagaatgcttgaacccaggaggcagaggttgcagtgagccgagattgagccattgcactccagcctgggcaacaagagcgaagctccgtctcaaaaaaaaaaaaaaaaaaaaagaaattccaagtcattacctcaagcgcttcgctagggtggtggaggggatcaggagggagttcatgtcaatacggagctgatcaatacggttgggaccgcagcttagtgcaagaggtttgctatattcagcctggccaggagatggcagtgttgtcctgtcgggagcctctcatttcagcgccacttctctcttctataaaggggagttctgggggctaggtccccacttttctcttttcctgggtgatgctatctggagagtcagtcggtgaggcccagcttaacattgggcctgcacttggtggtttcttaggcagcgttcttgctggacaaatgcgcaaaaaataactgggaacaaccttgaggagattgcttggtgagattggactctatccccagacccggcgcactgggctgctggggaggaaaggcggatagaggttgtcagcctgatgaaaggtgaaggggggcacccctgggagagatttcaggcagctcctaatttgcaaatgaattcacttctccaattccttctgtcagttggctgtttctgtgggtgaaattatttgagttccaattataatgttatataaagaaggtaggttctcaggttagcccataaaactctgtttactctacaatatagatgagttgcagtgtatgtataatgaaaaataggaaacaacagtattgcggtactgtaatttaaataaaagaaagaaacaaaatggaatggaaacagttctttattttggtgagtgaagaaaattaggttgaattagagaaggagaaggaggcagatgaggcttgctgtgggacatataaaggaggcatttgggcactttaaaggcttatgggaagacccttgattgtgttctgtaagtttccaactcaagggaggggcgtctacaagttcaacagtctttgaggagccaagatcagattggcctggatctcgatgcctggtgtgcagaaggaacactggggtaggagtctgaagacttgggtttctattccagttttgggtaaactggcttaccttctctgggcctcattttcttcatttataaagtgagaatcaagtgaaataatgaaagtggtttttatgtacgaaggcactctggaatggtaaaatagtgggcttggatcttcagtcttcatattttcatttaaaactttttctttttttcttttttttcttttgatagagatgtctctttagcagctctaaaacatatttgctatgaatagccaccaacaggattattatgggttgcaaatggaagaaagagaaagggaagagtaaaagagaaagggaagagtaaaagagaaaggttcataaaggttagtgagaatctgtgtacactgcagaaacagtttcctctggagatgacattgactgagtctgtagtggaagtcaggagcagaggaagcgtggagtgcgcactagctctctatggaagacgggagcaggggacgcgtggagcgtgcactagtcctccatggaagtcaggagcagagaatgcctggaatgcgcactatccttccatagaagacaggagcagaggacgccggagtgcgcactagccctccgtggaagacgggagcagaggacatcggagtgcgcactagcagtccatggaagtcaggagcagagaatgcctggagggcgcactagccctccatagaagacaggagcagaggacgtcggagtgcgcactagccctccatggaagacgggagcagaggacggtggagtgcgcaccagtcctccgtggtagacaggagcagagaatgcctggagtgtgtactagccctccatggtagatgggaggagagaatgccaggagtgtgcactagccctccatagaagatgggagcagaggacgcgtggagtgcgcactagccctccttggaagtcgggagcagaggacgccgcagtgcgcactagccctccatggaagacaggcgcagaggacgccggagtgcgcactagcccttcatggaagacgggagcagaggatgcgtggagtgcgcaccagccctccatggaagtcaggagcaaaggatgtgtggagtgcgtactagccctccatggcagcatttcccaaatggtggcccctgaatctttgttcctccagatgtgctaaaagaaaaagaggcttgtggttaaataaatttgggaaaattttaaggggagttaaaccaaattctttattacagcacctgctagaaactttaatgtgataaatgcgttgcagatcccaagggggtgaagtgggaaagttatactatgcagtgtttgcaaacttatttgaccgtacacagttcttttgttgttttgatagtatttctcaaggtgtggttcagggaccacctgcattgacctggtgtttattagagcaggttgtctggcatcaccctagacttaataatcagccagaagggcagggagagacagggaatttgcatttttaagaaacacctcagtgtttatttcccccaatcaacacatttatttagcatatagtatgtgccaggctccatgctaggtgttgaagatatactagtgaataagacagttctaattctaatctcataaagctaattctaatgggggtcaaaataggggtggggtgctgggaatagaagcaacacacaattgcaatgtggtctagtcttactgcaatgggcaagacttgtgtggttagggaagctttactgtagtgaggctatatatagaacacttcaccaaaatatgtttgtaacaacagttgagacctatgatttatggaaatcccccatatgtcacatgagcacggcattccggaccctgacagatttgtgaatttcacataaaacccggtgactcttttgcacatttaatttgagaacaggtgaactagctagatggatgttctccaggaaacacttctaaggtgaaaaagatgttgactcacgctttctcctgatctggccaccaggtggcactgacaagctggggcgacttcgttgtgggcagaggcgggacagataattaggcagccttgcctaatctgcaaatctgcagaccttaatccatggagtattggtaatcctgtagatagtgcagtatgtggtgaaattagggaacacatcacaccatggggaatagaaaatgctaattattttcaatccctatctcattcgatttgcctgcatcatttgactctatggaccatcactttcttcttggaaatttcttttcctttggttcctaggacacagctctctcacggttttccttcaacccttaataataataagtaacatttattgggcacttaatataagccacgtcctgtgctaaatgctttgtacacacgatcatttaatgctccctatgaggtagctactctcattagctttatttagcaggtaagtcttacagagagattaagccatgggtccaaattacataactagtgagagtcggagttagcatcagggttgggacaaccctagtcatgagtcctagctcactgcacttatggcttccagagagccctgatggtttctgaatcgtccccatcatcctgtctgcttgcatcactactccagggtgcacttgcctttgtagactgtgcagctggggccctcctttctcagtttcttcctgtgcaagtctctagacacctcctaggcgatctcccccggcctgtcctgaagccagcctgggagcttccctctaaggaagcaatggccacactgtcttgtcatggtttgcttgtctgtgcccccctaccaggttctgagcccctctaggacaacttagtatcactggcacctagcgtgcttggcatatagtaaacagtcagaaatgttaatgggatgaacagcctcaaaagagggctggaggtacacagtcacagccattcctgaagaaatatagtgtgacattgcccacacaggtgtttgaaaacaaccctttgagtctaagacagaaagcgggttgaagggatttttttccagtccagtaaacctgtgactttgaattgggaaatactactaaggtcaacgggcaaggggccagtgcagagtgctgtgataaactgagaatgctaaggacgtgatggcattcattgtccaaatccatattataccccaaggccaggatggagccggggcaggtgcggctgcaggcattgagcactggcatcccctcaggggtgcagcagctgctcccctcccagatggtttctgagcatcagttcctcctctgcaccagaatgtttagcaatgtcctgggtggatgaacaaggagctgaatgaagagtctctgttctctggttgtcatgagtgtgtggtgatggggaagggagcccaggaatgaactcatctgaactacagacataacctgccttgggcgagataaggcaaagagtccacctgtgctctaggccttccttcttaagccctccttgaaatccagtcagcatggctgtttttcccaggtgtctgaccctgcccccaagatcatagacctatgctgtccaggatggcagccgctagccacgtgtagctactgagcacttgaatcgtggctggcatggccaagcgcagttgcccatgcctataatcccagcactttgggaggctggcgggtcacttgaggccaggagttcaagaccagcctggccagtatggtgaaaccccatctttactaaaatataaaaaaaattagctgggcatggtggcacatgcctgtcatcccagctactcaggtggctgaagcatgagaattacttgaactcgggaggtgtaagttgcagtgagccaagatcataccactgtattccagcctggatgacagagcaagactccatctcaaaaaaaaaaaaaaaaaaaaaagaaaaaagaaatatggcagacatagctgagctagtatacctttaattttatttcattgcaatgaatttaaatagtcacatgtggctattggtaccatattgaaccatattga
